United States Patent 12,642,819 (COMPOSITIONS AND METHODS FOR TREATING INFLAMMATORY BOWEL DISEASE) - sequence listing, part 93

SEQ ID NO: 48 - DNA, 2682251 bp, Lactobacillus paracasei (residues 1-1,341,126 of 2,682,251)
  modified_base (2389101)..(2389198): a, c, t, g, unknown or other
  modified_base (2582402)..(2582637): a, c, t, g, unknown or other
ccgcactgaaccatcgtcccagacgtattctgaactatcttcgcccatgcgattactaccgatgcatggcgtaacagcctagaccactatcaagaattcgttatcatcgttgcacttgacttgaaaattgaggaaaaaaatataagtgattggtaggacgtgaccacttttcttctaggaaaactaatgattcaaaaaagggtcagtttggtcatcctggtacttcagagagatgggtttgaaagaggcctgatacatctgccgaataagcggtaaatccgcttgggtgacggtagcaaaactaaaggattcattcatagcgatctctccctaattgataaaatcaccacggcttattcatagctcacagcttaactggcaactgaacaacgattaaccctctgattcaaccgtaattatcacacattttaagacaatagcttcccaaaggtggtctgttttgttatactagttcttgtgttttggagagttggcagagtggtaatgcaacggactcgaaatccgtcgaaccggctaataccggcgcgcaggttcaaatcctgtactctccttattatttcgataagagccgtctgatataacgccagtaaaaggtgtggtatcaggcggttcttttttcttcccgaaaatacgtctctattgctcaccaccaaagtgatggttatgcgaccattttctttgcacagaatttaattcaaatctaatcatccagcgggctatgcgaagaagctatttaagttcatttagaaaacatgttggcagcatcacttaggcaagtatcaacgcttggcttctctttaatcgtcgtttgcagtttgtttttatttccagcaaaagcagtgatcaaattatttatatctaattgttctattaagaagatacagacatctaatctcccactctttatcggattgtcttattctcaagcttcatatttgctctcctcttggttaaaaaggtggaaattgatcatttcgtctgggaaataacttgttcaaaaatcggtggattatattctttgaccaaaatcttcaacccaaacacacgaacaagtaatcgccaagctaatgtcggcgacaaacattaagaacatcaaaccgatcgctagaattatctgaccaatgtctaacatagaattgaacagataacatcatgcaaaattcaaagggaacactagccaaacaaacttgatgcactaaccacgaactgatacattttgcctgctcgtcttcgctatgcaacaagttgtttgacggcttaactaactagtgtgaaaaccggtgcctgaaaaatgtaactttctcccccgcttctactgactttagcttcggatgaaccccctatcgtcttaaaaggaataataacaaagaatatccgaacagaagaaggtaaattgggaacttaggttattttaagcagcaagtcaagttattttgatggctacccttgcttgcgttaattaaagcggccaagtatgccatagcaaacaaaatgtctgccactatttaggtcaacaggatgttgaattgttggcgtttcacggatagcgttcagtaaatttaaaatttcaacgggatttaaacacggtatttgctaaaaacgaaagctcttttcggctacttgttgtaaatatcgctgccgttttttcaaagtagactttgttatgccgccaaaattataccagtaggcgtgttgcaccccgatttgtttgagtgtgtgatgcacaaaaacaccattcagcgcattgccgcaaaataatcgaaggtaaaatgttggcgaagtcgaagtcgtgagaacgtaagcatgttgtaagttagtcagtaaacctttcacgccggttttagtcacaatatgacttaatcccgggccttctttcatcactttatcaatgaaccccttcaacattgctggaatatcattccaccaaactggcgaaatgatgactaaaccatctgccctttgtaagagtcgcaaatatttctgaacgagcggatcatgggttttaccagcatgaaacaagcgaagttctgccacatcataactaggaacaaattggtcttgataaagatcaataaccgtataggacacttgatggtgatcaaaattatgttcgactgcttccaaaattgcatgattaaagctttttgcatatggatgacaataaacaatcagaattttagtcatttgaaacctccaatagatccttcaatgttttacgcaccagattaggatcataactcgtaatgccactatcaattaacaaaccgtatccttgaataaatgaccacaactggataaaaagaatctgggggtcaatagtgatcccgcgtttgcggagtacgtcttttattagttggatcacttgatcgtaaaatccgaattgcccaggttcgactttcaacacatcgcgagctgctggattgaaaaacaaaaagtgcatcaaatgcggatctgcttcaaaccgctctaaaatttcggcagccatcaccaaaagtttttcttctggatcggtgatttgccccagcacttgcgccatctctgcctcctctcgctgtgacagaagctgggtaacagcgcgcaatagagcgtccttggttgcaaaatgcttgtagaaagcgccagttgtcaatccgatggcccgtgccaattttcgtaaagatagctgatcttcaccattttcacgaatcatattcatcgcttgttctaaaatacgttggtccgtatcatgactgattcctaccaaatactcacccccaaaaaaagagataacaccgttacccattaattaattatagggtaacagcgttatctctctttttcaatccttaattttagtgttccagcaatctttatcgtaactgtttcagaaagtcccgcaaaaatcgcaatctatcttgcgctttgcaaaataaatcagtctgatgccgagtcaacacttcttctctaaatgagcgctggtcaatgtattgatcgtatcgtagctcaatttgaatggcggtgatattaggttgatggccgtagtagcgcgttatgtcgccgccacgaaatggaaagttattttcaactgtgaaatcatgtgcgacaaacgcggcgaatagcgtttgtcgaaaaattttactagttgttcggtcatggtcattgcctaacacgattgtttttggcttgataccagggtaatgaggatattgggcaaaactatgcaagtcaattaagtaagcatggccaaattttgcctgtttttgctttaaaatcattgttagggcgtgacgatacggccaataataggttctcaaccgtgattgcagtgtttctggcggtagcggccgctcgtatagaggatggttgaacgtatttcgctgataaattgtggcagaacgataatcgtgatctaaatctaaggtaacagcacgattgggatcggcgacatagcgattaacacgattgatcagcgtcgtgaagccggtttgcggcaggaagtcataaagcgcaggcaagaaccagtcggtattggccaacacagccgttggcaataaatgcttacgcatgtcagccgggatccaagtaccactgtgcggcaaactaatcataacaggagatgctgcgtctgcatgcagtaactcataggtagctgacagttgttcgttttcgctcattgtcttttcctcctcggtgactgttatcggatatagaacaggtacaggttgagacatacttctaagtcgacaaagcaaaagcgaacaattttccatttggaaatttgttcgcttttgcctgctcatagataatttattatgattttaaggaccgtagtgccaaggcggagcaatcgtaggccagctggggctcagccgtgcaaacaacacagcgacggtttgttgttaggcgacttcgagaccggtctttgggctcgaagcgccgtcacagcgttccagccccagctggccggagattgcggagtttggcacggcaaggaaattttggcctagcatcttcctacgattattcggaatttaatgaatcacaagttctatgagggtaagatggctcaccctcttccgcatacaggtgatttttaattacttctggtgtccttcttcaggcagcaagatagtttgactctcgccgtcgtcgtaagccatgactgtgtcgggaaaactgggatcatacgggaatggcagatcaactgacatctccgttgccgcgccactttcactaaaatgaacggtcagcttcccctgattattctgcagatcgaaacgtaacaagttatttagcggaacaaccccttgcagatttcgatcgatgatcatccaaatgctatcaatgatttcacctggcagattcgagatgacgccaaaagtcgcgaaccgactgtgatttgtctcaaacatacacgcgatctccttccttcagtcttgcgtggcaatatccgcaaattgtgcatcaacaaattgcgccaaaattttaggatcaatgccaactgagcgacccactttaccggcggaaacaatgatcgttgcctggtcctcagcctcttgactgataaaaataggatacttatgccgttcgtgaatgccaataggtgtgttagcaccatgctcgtaacctgtggttttcatgagatccttcagcggcaccatgcccactttgcggttaccagagaccttgcttagttttttataatcaacatgccgatcgagcggcacgacgccgaccaccggaccagttttgttgccggtcaagaccagcgttttataaatctgatgttctggcacatccagatggtcaattgtcagctgagcaacatcgcccacctcttcagtcggaaattcgtaaggcacataagcgatccccgctttgtccaacattttttcgaccaaggtcttttcaaccttattgtgatgtttagccatcgcgatccccccctaaacgcgatcacagtcgcagcaatctgcgtgtaagaacctcgagtgcgatgagcccaaacccggtcatcacgccttaggccacttacacgccggtttctaagcgcgactgctcacgctcttgcttaaatgcgccaccttgcgtagccaacctacatgcatgtaaggaccttggtcgcaatggtcaaaagacggccatcacgcccaaggccgcttacacgccagctgctaaccgcactggctcacgctctgtcttacgttaatcccgatgccacttaaaatactagggcattttgactgaaaataccactatcatgcgccagtgtatgacatcagcgtgaacatgtcatagtctttgatcttgtcgcggccgtgcaagtcgcttagctcaatcaaaaaggcggtgccgacaacgatgccgccaagctgttcgaccaagcgaatcgtagcagcaatcgtgccgccagtggccaacagatcgtcgcaaactaggacacgttggccaggtttaatcgcatctttatgcaagtataaggtggcttcgccatattcaagatcgtagctggctttaacggttggccgtggcaacttcccttttttccgcgccggagcaaagccaatacccagcttgtacgccactggacagccaacaatgaatccgcgtgcttctgggccgacgatcatttcaacgcctttgtcctgtgcgtaagcagcaatttcatctgtcgctgcagcataggctttgccatctgccatcaaaggtgaaatatcacgaaaaataatccctggttcagggtaatcctgcacactggcaatgtaatctttaaagttgatggtcatgattctacctcactgtctgaatgctccgtcagcaacatggtttcaagctgagcgcgcggcatggtctgtaactgttgcgccagatctagaaaggctgtgcgcgctgcataagccttcgccgtttgcagcggctttttcgccggggctgtgactggagaaataaaagcaccctctattgtaacaaaatcgagttcaaaaaacacctgaaccgccaagatcacttgatggacagttaaatggaccgccttagcaatcgctggaatgtgatgcttgtcgaacccaggatgggccttcagaaaacgcaacacggccccaaattctgcccgcgtcggtatagcaaccaagcggcttggtgcgccgtaaaacatgacggcaacaggtggctgcacatactgcatcacctgatgcaacgcggcagcatcttttggcaagtcgactaaaactgcattcgctaaaggcgcttgaacctgagcagcgatggtcgttggcccaccaaaggaaaattgccgctcaaactgttgctttactttcgcatcaaaaaacacatacgtgcggctggctttgaactggccgccgtcaatcgttggcattcgccagtcaatgacttgcggctgtttgacttcatagtctttcaacatgagttgtagactggtatgaccttgccaagtgttttgatccagctgaactgccaatttaacggcctgtgccgttgccagtgtttccgcagcatcaccatagccaaaaccaatcacattgatgccttggtcgatttgaaaacgcaggtgattgttttctttaccaatctgtttcacattttggataacttgcgggcgtactgagaaaaccggttcgggattgccttgaccaaacggtgccaactgacggatcaattgatagtgatccaatgtcaaatcagcatcttccagcctcgtggtgataggcaatgttggtttcggaacagttttcagcattgttgccgcagccgcctccatctgtgcatgaatcgctggtaaatccgttgttttagctgtgagaccgacagccatatgatggccgccaaaatggaccatgtgttcctttgctggctctaaagctttgaaaagatgataagcctcaatcgagcgacctgagcctttggcagtttcgccatcatctgcaatgttcataattaacgttggcttgcctgttgcttcgacaaccttgctggccacaatcccgacgaccccttcatgccaacctttactggccagcaataatgttttggccgcttggttttccggcgcctgtgccatcgtcaaagcttcctgagcgatctttgcaactaatccttgtcgttcctgatttagcttgccgacttgttcggctaactcagcagctacgtcatcctcaaatgtcgtcagcaacgttacgccgggattcgcgtcgcccatccgcccaagtgcattcaaccgcggtccgatgacaaaaccgaccgttgtttcattcacagtttccggggcaacaccggcttcctttaaaatagccgcaagcccgacccgtggctgagtctggatcattttgagtcctaattgcgcaatcacccggttttcatcggttaagctgaccagatcagcaatggtacccaaagctgccaagtcaacgctttctaacggtggttcgcctaataaggccgttgcaaccttaaaggcaacgccagccccagaaagatcaccgaacggataatcgccatctggatgccgtggatgaacaacggccaccgcatgcggcaactttgctggcaactcgtgatgatcggtcaccaccacatccatgcctgcagcctgtgccggatcgatgactgcggcaccagccacaccgttatcaacggtgattaccaactgtgtgccagttttttgcaaataagcataaacttcggcattcggcccataaccatcggtgaagcgatcaggaataaacacatccggatcggcgcccagactttgcaaggtctcaagcatgatggcactgctggtcaacccatcaacatcgtaatcgccataaatcgtgattttttcattttgctcaattgccttcaaaatccgggcaacggctttatccatgtcatgcaaggcgaatggatcatgcaatcgactagtgtctgggtgcacgaacgcatcataatctgcctgatcattaatcccgcgttgcagcaacaaggtcgctaaaaatggtgggacattcaacgtctcgctaagagcatgctcatcagctgctgcaggttgtggggcgagttgccattgatactgcgtcatatcgtctcgttcctttctaaccgatccagtataccagagaaagcttagcgaattaaccggtaaacctaagttatctttggcagatgctgactgacagtaacacaaacagaatgcgtatcggcatgacatgttattgtgtcggacattcaatgcaagccgtccgtgcgactcattgaaaacgtgatataattaaattgtgaataagcccaactccagtcagcgacttaagatgtgtgatcagcttaagttggtcatgcgataaggaggaagcatcatggcaaaatctcaagaccaattcaatgaaaaggtcggtaaagaaattaacgtttctgacgaggccgtcgataaagcagctgcccaaatcgagaaagtcggttacgtcactgaaaaggacgttccggaaatgatcgatcgcgattacactcgggcattgtccaagaaggtttcggcaaaacttcacaaagacaatgacgatgattacttctacgaagagccttttgactatgaaaatggccgcattgcaaatatcatgtgggacatggataaaattaagacccgcgaagaagccatgaaaattttggctgatgaacttggccttaccgttcctaagattgtaatgcgtaaaatcgacgaacaggtcttctagtctggaggaccttcacagcttcagtttctgcggttgtggacgcggttcaactttaataaaacaaccggtatcctttgcggagccggtttttttgtgagcgcgaacaaaccacacttaaaaaacggcgcgtaagtggtcttaaggcaaacggtcaaaaccgtggccttatttttcacatgtaagccttttgcaattgcgagcacgttatggcgataatcggcaacatcaggatagcagctagtgacaaggatttttcaaacacatcatcatgcaacggccagcttattgtgtgataatgatgataaagaaaggatgtgaatgccatggctgaccaacaggaattagatgatttttttgcccacgccaaggctgctctagatttgtccgctgacacctatgaagatgcttaccaactcggcggtgcaaaatttgctgataaactcgctgcattggttaaaaccggcaagaaaaccgcaacttcaagcggctttgagctgtatactattgaacaggatccgctacccaacgccggcgtctataatattatcttgaatcgggcggataagcctgttgccttgactttcacggacagtgtttttgtgacgccatttatgaaagtgactgccgatattgctaaacgcgaaggagaagacgatcaatccttagctagttggcgtgaagtccatcaagcctttttcagtcgggaatatcaagcaaatggcattcaatttgatccagaatcatccatggtcgtagtcgaggaatttcatactgtgtacccagtcgttcaaacgaggtgaaagcaatgaatctcaagcatcgtacagcgagcacagaaaagaaagtcacgcaaaagctcgatgacatcccccatcccacacttgatgccacactctacttactcgttttcagcatcactgccatcggcggcctagtttcctatggcgcctatcagctctttaaaccggagcgaaagttagcccacaaagcaaaaacactcgttgatgaacatgaagatgaccaccaacacgaggcataaaaaaagcaggtcacaacggcctgctttttgcttgttttgaagaagaggtgggcaaatcaccaaggtctttgtttctatgaaaacagaactgcctatttaccttggctttcctcatcattcatcttcagaatactcataaacgcttcttgtggaacttccacagaccccactgatttcattcgcttcttaccagccttttgcttctctaaaagcttccgtttccgcgtgatgtcgccgccataacattttgcaagaacgtttttacggtaagccttcacagtgcttctggcaatgactttattgccaatcgcggcctgaatcggaatttcaaactgttgacgcggtatcgtggttttcagacgcgcaacaatggccttgccgcgttcgtaagcaaagtccttgtgcacgatggtactgagcgcatcgacaggatcgccattaagcaagatgtccatcttaaccagatcactttggcgatagccggtgatttcatagtccagactggcgtatcccttcgtgctgctcttgagatcatcgaagaagtcgtaaatgatttctgaaagcggcaagttgtaaatcacattcacccgatacttgtctaaataatccatcgtcacaaactcgccgcgcttacgttgcgataactccatgactggcccgacataatcattaggcaccatgattgaggctttgacatacggttcgcgaatttctttgatttcgctaacttctggcatgtcagctgggttgtcgatcgttttttcagtgccatcggtcatgatgatttcataatccacacttggcgcggtcatgatcaagtcaaggtcgtaatcgcgttctagtcgctcttggacgacatccatatgcagcaagcctaagaacccgcagcggaagccaaaaccaagcgcctgcgaagtttctggttcgaattccaaagccgcatcgttcaattgcagcttttcgagggcctcacgcaaatcgttaaacttggcattatcaactgggaaaagccctgaatacaccattggcgtgattttgcgatagcctttcagcggcttttctgctggccgatccgctaaggtcaccgtatcacccacacgagtatcctgaatggttttgatcgcggctgtgatatagccaacatctccgaccattagaaaatcacgtttgaccgctttaggcgacatcacgccgacttcggtcacttgaaattgcttgccattgctcatcagctgaatggtgtcgccgactttaacttggccttccttgacgcgcacatcaagcacaacgccacggtaatcgtcataaaccgagtcaaaaatcagtgcttgtaatggcgcattcaaatcgccagatggtgctggcacatcggtcacaatccgctcaagaatttcaggcacgcctaggccggttttaccactggccaaaatagcatcggaggcatccagcccgatcatctcttcaatttcctctttaacgacatctggctgggcactcggtaaatcaaccttgttaatgaccgggatgatttcaaggtcatcatcgatcgctaaatagacgttggctaatgtctgggcttcgacgccttgggtggcatccacgatcagcaaggccccttcacaggccgccagactgcggctgacttcatagctgaagtcaacatgtcccggtgtgtcaattagatgaaaaatataagtttcgccatttttagctttgtaatgcagttcaaccgcatttagtttaatggtaatgccacgttcacgttcaagtgccatatcgtctagcacctgcgcctgcatatcacgtttggcaatggtatcggtcaactccaaaatacgatcagcaagggtcgacttcccgtgatcaatgtgggcgatgatcgaaaaattgcggatatgcttttggcggtccagcatttcttcttgattcatgtttagtagtgcctactttctaagcgaatgtgatatgagttctattatagcagagcttggcgcagctcggtagaaacggacagctaaaggtagtgtcagtttgatcttgattccattctgtaacgattcaaacatgtccccatcaaaaaagcgatccatataggatcgctttttgcttacttaccgcctttaaaagcttccttaacccgatcgaacagcgtgccattgtgcggggtgacatcctcgccactagcggctgcgaactgcattaaggctgacttttgcttctcattcaaatgctttggcgtctgcacttcaacggtgacaatctgatcaccagtgccgttgccgcgtaagcgtggtgcccctttgccgcgaagtctgaacttcgtctggctttgggtgccagcaggaattttcaattcaactgcaccatgaacggtgtcgactttgatctcgtcacctaaggctgcctgggcaaagctcaacggaatggtcagatagatttctgaaccgtcacgttgatactttttgcttggtgcgactcggaaaacaatatagagatcaccataagggccgccgttggttccagcttcaccagcctgctgtagtcgcatttgctggccgtcttcaacaccagcaggtactttcacatcgatggtgtgacgttcctgttcgtggcccgtgccatgacaagtcgggcacttttctttgatctccttacctgtaccgccgcagacatcgcaaacctgccgcgtcatcatggcgccaaatgcggtattgcgttgaacctgaatatacccactaccgtgacacttatgacaggtcacgggactggtgccaggtttagcgccgctgccattgcaggtgtgacaaacggcttcacgatcataggaaattttggtgtctttaccaaaaatagcttcctcaaacgttaggtccatgcggtattgcaaatcggctccttggcgcggagcggatggattagcctgcgcaccaccgccggcaccgccaaagaattgactgaagatatcgtcaaatccgccaaaaccgccttgtccgccgccaaagtcactaaatccgccttgaccagcaccagcgccgccaaacccttgcggaccgtcagcagaaccatactggtcataggccgcccgtttttggggatcagacaaaacctgataggcttcattaatgtctttgaacttctgctcagcccctggtgcatggttgagatccggatggtatttcttcgaaagcttgcggaacgctttacgaatggtgtcatcatcggcatctcggcttacaccgagtgtctcataataatctttctgatccgccatagttcctcctcgattcagatcatgactgaaaatgcctgttcagcatagcataattcaaacaaaaagccaaaaccgcgccgcggcttcggcttcttgctcatgatacaacatgttacttcttatcgtcgtcggaaacatccttgtagtcaccattaatggtgtcatcgtcagactttttatcatcgctgccttgagctgcgcctgcatcagttgctgcaccgctggctgggccgccttgcgcctgctgattcttctgggcattttcgtacaacttcacggtcatatcctgaaccagtttgctcaagtcatcccgtttttgcttcatgtcgtccaagttgttttcttgttgagccttcttcaaggcttcctgagcatccttgaccttcttgatgtcttcttcaggtaccttaccgtcaacatctttcaatgtcttatcggtttggaagagcagctgatcgacgtcattctttaagtcgacttcttctttacgcttttcgtcggcatcggcgttttcttcggcttccttcttcatccgttcaatttcttcatcggacaaaccgctagaactcttgatggtgatgttttgcgacttgccggtgccaagatccttcgcagaaacctgaacaatgccgttcttatcaatatcgaatttaacttcgatctgaggtacgccacgtggtgctggcggaatatccgtcaactcgaagcgaccaagtgtcttatcgtcagctgccattggccgttccccttgaagtacatggatatcaacggctggttgactatctgctgcagtagagaagacttgactctttgaggttgggattgtggtattacgatcaatcagtttggtgaagacaccgcccatggtttcaatcccaagagacagcggcgttacatccaacagcacaacatccttgacatcaccagagatgaccccgccttgaatggcagcaccaagcgcaaccgcttcgtctgggttaatgctgtggtctgggtccttgccagtccactgtttaactgcttcctgaactgctggtgtccgagttgaaccaccatttaaaataaccttgtcgatgtcagcgttggtcaacttggcatccttcaaagcattttcgactgggatcttggtcttggcaaccaagtcagcggtcatttcgtcaaactgtgcccgcgtcaaggtacgttccaaatgcaacgggccattagggccagcagagataaatggcaagctgatctgtgtctgggtaaccccggacagatccttcttagccttttcagcggcatccttcagccgttgcatcgccattttatccttggacaaatcaatattgttgtctttcttaaattcagcaactaaccagtcgatgatcttgttatcaaaatcatcaccgcccaaatgggtatcaccattggtcgacagcacttcaaagaccccgtcgcctaattgcagaatggaaacatcaaatgtcccaccgccaaggtcataaaccagaatcttttcgtccttgtcgcctttgtccaagccataagccaaggcagaagcggttggttcgttgataatccgctgaacattcaaaccagcaatcttgccggcatccttggtggcctgccgttggctatcattaaagtaagccggtacggtaataacggcgtccttaactggttcaccaagataatcttcagagaacttcttgatgtattgcaaaatcatcgcagaaatttcctgaggagtgtattccttatcgccaaccttgactttgtagttagcttcacccatatggcgcttaatggaaacaatcgtgtctgggttagtgatcgcttggcgcttggccacttcaccgacttggatttcaccatctttaaacgcaacaacagatggcgtggtccgattgccttcagggttggtgataatttttggctgattaccttccagaaccgcaacagctgagttggtagtccctaaatcaataccaataactttactcatagtttataccttctttattttcagattaattattttgcaacgacaaccatagcaggacgcaacacacgatccttgaggtaataccccttttgcaatacctgcgcgactgtgtcagctggatgttgatcatccgctgcgaccgtttgaacggcttgctgggtattgggatcgaacttgtccccggcaccatcaatggcagtgatgccgttttccttcaaagcgcgttccagatgatcgtaaaccatttgaacacccttcttcagggaaactgcactgtcatctttggcctcggttgcaagcgcccgctcgagattatcaacaactggcaaaatggctttagccaacttttgcccatcatatttcaacagcttttgctgctctttctcgaagcgagcattcatattttgaatttctgcagcggcacgcaggtatttatcttcaaagtcgtcgcgttcttgcttcaactgctcgccgtcatgtttactgttcgaaagttgttcgttaagatccgcgatactttcttgtaaaatatcttcttttaacgaagtctctttcgtatcagcagacttttcagctttctttgcggcgtttgctgcatgctttgctttttgttctgccatggtatcctcctttaacgcgtttcctgacgtaaaagcctgtccataaggaacacatgcacaatgcccaaaaaagaccattgcatttgtgcgccgatttctgaacgtgtcagttcacgctattctttaaacgcatcagttggcttaaaaacaccaactgatgctatttgctaacatgattattgatcaaagttggcatagtagtctgtcaaccgtttagctagctcttcgcgaaaaacgtcgagcaagccgatcatcttggagtacggcatttgcgtcggtcccaagagggcgatcataccggtaccgtgaccaccaacatcataactagcagtgatcaagctgaggttcgctagatcaataggttttaactccggacccagttgcacttgaaccggtgtttggcggatcgggccgcccagcaactcagtcagatcgccgtgatccgcatcgatcaacgacatgatctttttcagctcgtgaatatccgaatcgccaaggtaatccatcaagttcaaccgcccgccaacataaaaacgttcagaggcagctgactttaagacattgccaaaaatatcaaggaagccgtctgggctggtcaaatactgcattagcatggacgggacatccgtcctcagccgctgtgctacctgaaccaatggcaacccgaccagctgatcattcacaattctgatggctttttcaagttcatcggaagaaatggacggcgggacggtgaacacctgattttcgacattaccattattcgtgaccaaaatggccatgacttgatggttacctagtggtacgagtcggaacccagtgagcttaatattgttgacttccggaccgagactaatggcggtgtagctcgtcagatttgatagaatctgcgcgctttgtgccacaatttcgtccattttgctgtaacgctggccaagctcctgcttgatcgttgccaaatcatggcgagagacgcgcacgggttcaacaagatgatcaagatagtagcgatagccttgtgtcgaaggaactcgacctgaactgctatgggtcttggtgatcagaccggcatcttccagcgctgccatgtcgttgcggatcgtcgcagaactgacgtgaaccggcagctcttgcattaacgtctttgagcccaccggctggccactttcagtaaacaaccggatgatctcttttaagacgagcaattgccgtttcgtcaacattttctcacctcacctttagcactcgttttatatgagtgctaatacaatgaataatataccaagcgaggttagcaaagtcaaggtacgattgctagattgtgaacgtttctagtgaaaattatggcaagtgcattttaacaacacagccgtttcttttagcacttaaacaagcggctcatcaatcaagaaacgttgaaaaacttcgttgccaaggaacttgcctttgttggtcaggcgaatgtagccatcttggcgcacaaccaaaccttgactgaccagttccggcacagtttcaccataaatggcgtcaactgtcatgtggtagcgatcataaaaccgcgcttcactgaccccctgcatcgtccgcaagcctagaaacatttcttcttcgatctgttctgactgtggcaccaaatgatgttcaaggaccggcaagtggtcagcatgtaatggtgttaaatactgcttaacaggaccatagttgtggtagcgatcacgaccaagatacccaaacgcgccagcaccgaagccaaagtacttgtcattgcgccaataaagcaagttatgctcacactggtacccgtcttttgcaaaattactaatttcatattgatgtcggccatgtgcttccatgagatcgatcgcatcttgatacatatcggcctcgacgtcttgggtcggcaagcgcaacttgccctgtcgcatcagattatagaagatcgttttacgttccaaaattagggaatacgttgagtaatgcggcagatccagtgccaacgccttttgcaaactggtcagaaagtcatcgcggctttgatcaggtagtcgaaaaatcaaatcaatcgaaatattatcaaacccgacttgacgggcgttagcaatggcagtgtaaacatcttttgctcgatgtatccggccgattcggcgtaatacatcatcattaaacgattgcacgccaatcgacaaacggttgacaccataatcatgtagcacttgcaatttttcggtcgtgagcaagtcattggggttggcttcaaaagtaaactccccttgatcaaaatgtaggatatcatgaataccctgacacaatgtagccaattgtgtcggtgtcagcgtgctgggcgtgccaccaccgacataaaccgtctgaattttttcttcaggatgttcagccatcaccatccgcatttcttttagcagcatggccacataatcatcaactggctggccttcgatgaaaactttgttgaaatcgcagtagtaacaaatatgttcacaaaatggtatatgaagataagcacctgccatattaacccttctttgcggcaaaataatctcggacggcagtttcatcttttttcaattgatcaatcagggcatcagcaccagcaaatttcacttcaccgcgtaaatagtgataccagcgaacttgaacggtttcgccataaatcatttgattaaaatcaagtaaattaatctcaagtgtcacgtctcgatcggcgccaaacgtgacattacggccaatggaggccatgcctaaataccaagtggtgccaactttgaccttcactgcataaataccaatgcctggtaatcgctgttggccaagtgtctccaaattgattgttgggaacccaagtaaacggccacgcgcctcaccatgaaccaccttaccagcagttgtataggtataacccagaaaatcattggccgtatcaatatcactggaatcaagtgcatgccggattcgggttgaactgaccttttgaccattctcagcgagttcggggacgctgatgacatcaaaccggccacaagcatattttggcaacaaagccatatatgcaacatcccgcttgccataagtatagtcaaaacctgcaactaccgtatccgccttcagaccgaccaaatactgatcgacaaaagcttgcggcgtcagcgcagcgaaatctggggtaaagtgaaccacatacaaatagtccacgcccagtgactgcataattttgattttctcttcacgagtggataaataccgaatatcggtttcggaaaccccacgataaacgacggctggatgaatattgaacgtcatcaccgccaacggtatcttttttgctaaagcgatcttcttgccggttttaatcaccgcttgatggccgcgatggacgccgtcaaagaagcccaaggtcaagacgatgggctgtgacggggccgcggacacctgcaatggcggctgaatatcaattgttttcataaattttcacacattcttttcattagctaaaaacattaaatctggccgatactgatcgtcttctcggcgatagatagccttaagaacgcctgcaaaatgcagacgaacgcgcggagtctgctgatcgagcgataaaaagcggccatgactgattgcctcaaattgttctacggtcaaatcaacttgaggcagatcggcaaaagcaatatcaatcggttgaatcacatcggctaaagtacctgccgtggcatgcgccttcaattgctcaatgctaaccgcctgcttcaacgtaaacccgccgctttttactcgcgtcaattgactcatcaccgcagcaactcccagcgttttgccaacatccactgctagtgttctaatgtaggttcccttagaaacatggacctcaaaccgaaaacgctgggtgccatcagtggctgaaaaaaccggttcatcggtacgtgtaaactgtgacaccgtggcctgtcgttctggccgcttcacagtttcaccggcgcgcgcatattcgtaaagccggcgaccattgactttgaccgccgaaaacatcggcggaatctgtgtgatgtttcctgtccacgcagtcaatgcagcatccaactgatcagctgtaaacggctgcgttaaaggcgttttatcaacaacttccccatccaaatcctcggttgtcgtcgcaaaacctaacgtgatttctccggtgtagactttcccactggccattaattgcggcaccgctttagtgcctgcaccaatcgccagcggcagcacgccgtccacattaggatcaagggtaccggaatggccaatttttttgataccaagaatcttgcgggcatgatacaccgcatcagcactggtcatgccagtgggtttatataacggcaaaatcccgttcatggcagttcctttcatggttttgattttttatacatactatgatgatgtttttcatgctcgacatgtcgccagccggcccagatgaaaacaagcaccactaggaccgaaaaaagccagtctggcgttttcacatcaatcattggcagactgagacctagcttaatggcaatgagacctacaagaatataagctgcggtttcaagttccggaacacgatcaataaaggtggtgatgacctgcgccaccagccgcatagcaaagataccgagacaaccgccaatcaaaacaatcaccggattgctggacactgccaaggccgccaaaattgaatcaaccgaaaatacgatatcgagactctcaatttgaatgactgtcccccaaagcccgtgaggtcgtttcccatgcgtccctctctgattttttggatggcgcacttcataaaaataactcgcactcatccagacaagatacgccgcaccaatcgctttgatcggccagaattgcaataagtaagtacctagtccgatagcaatgaagcggaatatgtatgcaccacccataccgtacatcagagctttttttcgttctgattcgaccttgagctgctcggtttgtgcagcgagcacgacagcgttgtcgactgatagcatgcattctagcaagatcaagctgaaaatggtcacgaggccgctaacagaaaatgccagttgccaattatgcgctgagaagaatggtccgtataaggcacctagtaacttgatcgtgatccttcctttctcaatgattattattataccgtgcaagcttgaaaacctaaagctgttgggcggtaaagtatgggtttgaatttcttactgatatcccagttgaggtagagtcgataattggggtggcgtccgaaaaactagaattggagacatctttgaactctggcgtacaaaaccaagttcaaagtctggcttttaagttgggacttcaatcgaaactatgcgatagacaaatacactactgcagaggaagatttgctttttcgcatggataatttttatcgggatttaaagatcccagtgccaaggcggagcaatcgtaggccagatggggctcagccgtgcaaacaacacagcgaccgggctttgtcgctgatgttgttaggcgacttcgagaccgcgggctttgcgggctcgaagcgccgtctccgctctagctacgcgtcgccagccccagctggccggagattgcggagtttggcacggcaagggtcttttagcctagatccttaacccagaaaaaaagacctgaccactagcagcagtcagatccttcttttaaatggtgcttattcaagattcttccgtcgtacttcattgatcagttgatcaatgcgtgcgccgtattgaacggatttgtcttgagcaaactcgatttccggtactttgaataaccggatacgctgcccgacttcgcggcgaatgagtccactggccttgtccagaccggtttgggctgcttcgactttgtcaggtgcatcatcgagaatgctgtagaaaatggtggcatgttgcagatcaccggtcagtttgactccggtaatcgtcacgcctttaacccgcggatcgttgacatctttcaacaagatatcgtcaacttcacgttggatctgagtctcaactcgaccgatacgatgtttcatatctgcctacctccttcaaaacagtcggtatcattaaatcctgagatacgtttgggttagttacttcactggaacctgttccattgtgaaggcttcaatttgatcatcgactttaatgtcgttgtagttctcaacggtcaggccaagttcaaagccttgacggacttccttgacatcgtctttaaagcgacgcagggagccgagtttaccttcgtacttgacgatgccatcgcgaacgagacggacaccagcgtcgcgtgtaatatagccggaatcgacataaccaccgacaacggtaccaaccttagaaaccggaattgtttcgcgaacagtcactgttccgatcaccttttcttcataggttggttccagcatacccttcatcgcagcttcgacttcttcgatcgccttgtaaatgacactgtgcaaccgaatatcaacatcgtcttgttctgcttgggcttttgccagcgcagttgggcgaacgttaaagccaatgatgatcgcgttacttgcagctgcaagggtaacgtcactttcgttaatcgcgccaacggcctgatgaataatattcacccgaacacccttaacttcgattttctcaagactgccagccaaggcttcaactgagccttgcacatcggccttgatgatgacgtcaacttctttcagctgaccttccttcattgtttcaaaaagattatccaacgtgacatggttggtgttcttacgttcttcttcctgtgcccgcttggcccgttcttcaccagcagcacgcgcggtgcgttcatcggcaaagacaacaaacttgtcagccgattgtggcacatcgttgataccagtgatttcaacaggcattgatggcaaagcatccttgacccgccggccatgatcattagtcatggcacggacgcggccgaaagtattcccgacaacgattggatcacctgtatgcagcgtaccttgttgaaccagtacggtagcaacaggacccttacccttatccaaacgtgcttcgatcacagtaccaaccgctttttgatcagggttagctttgagttcgagcacatcggcttcaagtaaaatcatttccaacaattcatcgatgttcttgccaaatttagctgagattttgacgaaaatcgtgtcgccgccccagtcttcaggaatcaacccgtattccgtcaattgttccatgacgtggtctggattagcgcctggcttatcgatcttgttgactgcaacgatgatcggtgccttggctgcctgcgcatgatgaatcgcttcaatcgtctgcggcatcacaccatcatcagcggcaaccaccagcacaacaatgtcggtgatgtccgcaccacgcgcccgcatgttagtgaaggccgcatgcccaggtgtatccaagaacgtaattaaccgatcacgcagtttaacttgataagcaccgatatgctgggtaatcccgccggcttcgccttcagtcacatgtgtgtgacgcagcttatcgagcaaggttgtcttcccatgatcaacgtgacccatgatagtaacaactggcggccgtggctgtaagttgtcttggttcttgttttcttcttcgaacactttgtccaagtcggaaatatcttcgtgaaccttttcttgggcgtcaatcccgtaatcggtagccaacaattcgatggtatctttgtcgaggctttggttttggttaaccatcacacccaacatgaagagcttcttaatcaattcagctggttcgcgatgcaaaatcttaccaagatcctgcgcattcatcccaacttcataaatcagtgtttctggtaatggccgctctttacgctgcggcatttccttcttcggtgcgctttgttgacggcgcttgttcttcttgttgcgccggttgttgcggttaaacccgttacgattcccataactgttgctgcggccaaaattactgttcccgccgccacgccggctattgcgattgtcttggctgccggcacttgccggttttggtgctgccgccgctggaactggagccggtttcgtaaagcgttgattggttgttgcagctggctgctcagtgcgcggccgttccgtccgaggttgctcagaacgtttactcgctgcatttgccggtttgaccgcttcctgacgttttggctgctgacgttcagacgctggtttaacaaacttgccaccgttgcctgccacaggacggggattgccattagctgccgtgggacggccagcacgcggcattggccctgtgacgcgttggttatcgaaccgacgattacggtcattacggttacgttcgttagaccgattattgttaccggaacgattagcattgttcgcagaacggttgttattattgttgtttgagcgatttgaattccggccattagccgtattgttagcgctggctgtattgccgccacgattgtgattcgtgttggtatgcgctgtttgtgtgctgcgtggtcgcaaaattgttgacttgctcaagatgattttgccgtcagaggtcttatttgaccgcgccggcttgttttcttgcttagcagcaggttttgcgtttttttgcgaatgctcagcagcatcagcatgatcgtttgacttggcactggcagcgactggcttcttagcagcctctttgtgtgccgctgaactcgtcttggctgctttagcaggtgtctttgctgcctgtgatgacggtgctttgccagctgactgcttgcttaacatacctttgatcttagcttcctgatcttgatcgatcgaggacatgtgattttttacttcgatacccaagttcttcgcgatatcgatgacgtctttattatcgacgtgcatttctttggcaaattcataaacgcgttttttgcccatttcttcacgctccctgcaatttaggtgagcagctgttgcatcttcttagcgaagcccgcatccacaacggcaatgatcgagcgatcactgccgatggcctgcgaaagttccattttggaaaactctgtaaccaaaggaacttcataatagctgcttttatccgaaaacttcttgcgggtgttggcactagcatcattggcaacataaaccaatttagcttcacgcgagcgaatcgctcctaagaccagattatctccggtgactaagcgactggcgcggcgggccaaacccaataaattcaatacggcttgtttttgcatcgtcacttgccgaatagttcttgacgagccttttgatgatcgacatacgcgaataggtcatcataaaaggttggttcaatcgtgattccaaatgctgcgtcaatcagcttcttaccctttgctgctttcacagcggctggatcaagtgccacataggcaccgcgaccagcagctttgccggtaggatcgatggcgacaacattttctttgttcttcacgatgcgaaccagttcttttttcggcatcatctgattgcttagcaagtccttgcgcattggaatcttacgctttttcatggctcgcctccttaagcttgcgccggatgatcggttgcactcggcgttacaggcgcttgatcagctgaatctggtgcatctgaggcggttttggcgtcgtcggcatcatctgctgcagcggcatcactgtcaggcgttgtctcagcgtcagttgctgcatctgcgttgtcgttagtttcagcagccgcttcagcctctgcttcaggcaattcatcatcatcaacgaattcaacttcagattcaggcttgatgtcaatcttatagccggtcagcttggcagcaagtcgcgcattttgcccctttttaccaattgccaaggacaactggtaatccggcacaatcacagtagcggaacgatcattggcctcatcattgaattgaaccgcgataacctgagccggattcaaagcgttggcaatgtaatccgctgggtcttcctcccattgcacaacatccatgttctcacctgaaagctcgttaacgacggcttgaacgcgcgcaccacgcggaccaacagtcgtgccgacagcatcaacagcgtcattggttgatcgcacagcgattttagtccgatcgcctgcttcacgagcaatgttgacaatttctaccgtgccgtcaaaaatttctggcacttcctgttcaaacaaccgcttaaccagacccggatgtgttcgactaacgaaaacttgcggacccttgctcgtgttttcaaccttggtcacataaaccttgatgcgatcatgggcttcatacttctcattaggcatctgatcttgacggcctaagaccgcttcgattttacccaagttgacgtagatgaaccgattatctcggcgctcaacgaccccttgaagaatctcatcttcatactgtgaatattcgtcataaacaatactgcgttcagcttcacgaacccgctgcataataacctgcttagcagtttgtgcagcgatgcgcccgaagtcttttggtgtgacctcaaatttgatttggtcaccgatttcataagccttgttaatcgccagcgcttctttcaagctgacttccagccgtgaatcgaaaacttcgtcagtaacttccttcaccgcataaatgtgaatgtcaccttgcttaggatcaaattcgacgtccacattttgcgcttggttgtaattgcgcttgtaagcagaaaccaaagcggcttccaaagcttcaatcacgacctcttttttgacacccttttcttgctcaagagcgtcaagtgcttggatcatttcctttgacatgcttttcttacctccactagaactcgatcgccaaccgcgctgaagcgatcaactgccggtcaatgacctgatcgaacttgcggctcttatctttgaccgtcaatgtcaactggtcaggcaatagctcctttaaagtcccttcaaaaaccttcttgccgtccagtttcttgaataaagagacatggatatagtcgccaactgcttgttcataatcagtttcatgtttcaagggccgttctgcaccaggacttgaaacctcaaggaaatattgctgcgggattggatcgggatccatggcatctagcttttctgacaaggcttcactgaccatcacacattcgtccagtgtaatgccgcctgtcttgtcaatatacacacgcaggtaccacccgccgccttccttcacaaactcgacatccgtgaggtaaaaatgatggtcgtccaaaatcggtttgaccaaagcggtcacggtttcaacaaccgattgcgtactcaagccaccgcctcctttactttctcattcaagactaacacttctgacgtctccagatgcgaacatggtgacgttcgccaataaaaagagtgagcatcgctgctcactcactgccagaaccttacattactattgatacaataccatagattgttactacttgcaaactagcagacctttgtgctagtaagcctgtaagccaattcatcgcattttttctaaacattcatgacagtttgcatgaaaccgcattaagcctagaataaaccgtcaaatagcgataattggttttcgtctggcaagtcatccaagacatggtttgttgtcatataatcaatcaacgttttcgaaaccttaccacgattagccagatcttccttggacaggaatggtttttcttcacgagcggccacgatttgcttggcaacgttatcgcccaggcccggaacagcacggaatggtgccagaatcgtgtgatcatcctgaatcaagaaattgtgcgaatccgacttcgtgacatcaatcattttaatcttaaagccgcgttcgagacattcattggcaatttccaaaaccgtcagcaactgcttttccttggtagaggcatccatgcccttatcggtaatctccttcatggccgctttgactgcttccttgccatgactcatggcggcaagatcaaagtcttcagctcgaaccgagaaatatgccgtgtaatagatcaacgggtaatggaccttgaaccaagcaattcgtaacgccattaagatataggcggtcgcatgtgctttcggaaacatgtacttgatctttaagcaggactcgatataccaatcaggcacattctcgttttcacgcattgccttttgccaatcatctggaataccgcgacctttacgcacatgttccatgatgttaaaggccattgaatcttccatgccccagtgaatcaagtccatcataatgttgtcacgacaaccaatgacttctttaagcgtgacaatgccttgcttaatcagttcttcagcgttacctaaccaaacatcggtcccgtgagacaaaccggaaatctgtaacagttcgctgaaagttgttggcttggtttcctcaagcattccgcgaacaaaacgcgtcccaaattccggaatgcctaacgtccccattttcgagttaatctgttccggcgtgacacccagactcttggtgccagaaaaaagcgccatgacgccaggatcgtccgttggaattgattttggctcaaccccggacaaatcttgcagcatccggatcatcgtcgggtcatcatgccccagcacgtccattttcaaaatattgtcatggatggaatggaaatcaaagtgcgtggtcatccaggcagcattttgatcatcagctgggtactgaatcggtgtgaaatcataaatatccatgtcagcgggcacgatcaaaatacctgccgggtgttgcccagtggtacgtttaacccccgtgtcgccttgcgccagccgatcaatctcggcaccgcgcagttgctgtcccgtgtcacgttcatacgctttaacataaccatacgccgttttgtctgcaaccgtgccaatggtcccagcacggaaactatgatcctcaccgaacatgactttgatatagttatgtgcaattggctgatagtcacccgagaaattcagatcaatatccggcactttatcaccgtggaagcctaagaaagtttcaaacggaatatcgtggccatctttatgcaaatcagcgccgcatttagggcattgtttatctggcaaatcaaaaccggacccgatttcgccatgagtgaagaattcgctgtattgacagttaggacaacgataatgcggcggcagaggattaacctcagtaatgccggccatcgttgcggctaaactggacccaactgatcctcgagagccaaccaaatatccgtctttattggacttcaaaaccagccgttgcgcgatgttgtaaataacagagaacccgttaccgatgatactttttagttctttatcgagtcgctgcgccacaatgtctggcaaaggatcgccatacaattcatgcgccgtggtcatcacgtcatgtttcagattttcttccaccccaggtacttcaggtgtgtaaagcttatccttcaccggcgtaatatcatcgtcaacccagttggcaatcaagttagaattatcaactaccagctcgtgggccttctcttccccaagccaactaaaatcggtcagcatctcacttgtcgaacgaaaatgcacatctggcaaactgtggcgattgagtggattggctccgccttgactatgaatcagaatctgtcgataaatcgcgtcatgttgatccaaataatgggcgtcgcctgtcgctacgactggtttttccagttccgatccgattttgatgattttttgaataatatcttttagatgtgcctcgcctttgatcaaaccagcctcgatcaaaggttgatagacaggtaatggttgcacttctagataatcataaaatgacgctttggcgcgggcctccgcttcgcctttttgcatcattgctgtgaaaacttcgccgctggaacaagccgaaccgactaacaagccttcacgcagtttttgcagctggctgcgtggcacccgtggcacccgatagaagtacttaacattagacaacgatactaatttgaaaaggtttttcaatcccgcttgtgttttcgcaaaaacaatcgcatgacttggccgtgcagctttataggcatcccccgccccaacccgatcattcaactgattgagggtcgtcatgccatacatcttggccgcttctttttccaaagcataaagcagataaccagttgcctcggcatcggcattagcgcgatgatgatgttctaggctgactttgtactgcttcgccaaggtatcgagcttgtgattcttccgttctggatgcagcattcgcgacaattccaaggtatcgatgaccggattgtcaatatccgccaatccatgccgctcataaccattatccaaaaagccaacatcgaaagtcacattatgccccaccataatggcaccatcgcaaaactgctgaaacaatttgaaaatgtcgacttcagacttcgatccatgcaccatgtcatcagtgatatgtgtcaaattaatcgtcagttcagaaagtgggaaacccggatcgatcatttcttcgaattgatcaatcactttgccgtctttcattttgacggcagccaattcaatcactttgtcgtaaaccgctgataagccagtggtttcaacgtcaaaaaccacatattcagcactggctaaatcacgcggctcatctgctcgataagcaaccggcgtgccatcatcaactaagtttatctcgacgccataaagcatttttaaaccggctttgacagcggctgaatgtgcctctggataagcctgcaaacctgcatggtcagtgacagcaatcgccttatgcccccactctttagcccgcttcacatagtcgctaattggattcatagcgtccatttgactcatattggtgtgcagatgtaattcaacgcgtttctcaccttcagcatcatcggttgggtccggatgggagacagtttgaatatcctgtgcattaatcgtcagctcacgggaatagttgtcctcttgaacactgcctcgcacgcgtagccactgacctttttgaatccgcgcaaacatggcttcatcttctggaccattgctgaatttttttgcaatgaagctggagctatagtcagtcactttgaaaattagtaactgccgcttagaccgcagttcccgaacctcaacatcaaaaacatagccttcaaccgtcactgaacgttcctcttgcgtgatggtcaccatttgttgcggggcatcggtcattttcatctgccgccccatttgaactgggccgtcagtttgaacttgtttttgtttagccgcttgctgcttcactacttctgcagcagccttggccattttagcggtttcttcagctctttgagcctgaaaagccgccatcgattgggctgcttgttcctcatcaacttcggcttgcatccgtaagccagagaagccaacctgacgataagtttcttcgagcttaccgagcccttgctgaatcaagtattgccgaatttgctcattttcggttttgatcacagcacgatcattctcaagtgttggcacttgtttttcacataactcgcgaacaattcctgtcccaatttcggcatgagtcacgacgtactgccaatattgagctaataactcgtcagtaatggttggctgggttaccaccaccgataaatcagtcgcagcaatctgttgaaacactaacggcaacttggtcgcaattgcattgaaaatccgaaatggcaggatcgcgtcaaaccccaaagtgaaatcataacgccgagattgttcatgaatggtcacgttttgtaccgtgccgctggtcaacgaaggatcttgtcggacatctgccgtcaagtcgagttgatccaataatttttcaaacatctcatgttgggataaagccaaattgtgcacccctcttagatggcaggaaacgaccaaagcagctgcttcagtcgtctcctcagtctatcaattatcttgctcttgcttattcagctgacccatcagaatcttgatcgagctgatcaattcttcttttttaacttcgattgtctcgccggttttacgcagtttcagttcaacaatctcgtcaaccgcttttttaccgaccgtgacacgtaatggtacaccaatcaaatcagaatctgcgaacttaacccctgggcgttcgttacgatcatcaaccaaaacactgtaacctgcatcttctagcattgtttcaatcgaagccgtcagtgacttttgttcttcgcgcttcagattaactggaatgagatgaatatcaaacggggcaatcgtggttggccaaactagcccatgttcatctgcttgctgttccgcaattgcagaaagcagacgggaaacaccaatcccatatgaacccatgatgatcggttgactgcggccattctcgtcaagaaaattagctcccatagtttccgtgtatcgggttcctaatttgaagatgtggccaatttcaatcccgcgtgtaaacttcaggacaccttggccatccggagaaacttcaccttcagtcacaaatcgaatatcggcataggtttccggggtaacatcacgatcaaaattgacgttaagcaaatgcgtgtgcgctttattagcccctgcgacaagattagtcagatcgcttagactattgtctgcaatgatccgcacgtctttatcgacatttaccggcccaatattaccgacttctgcgtgcatcacggtctgcacttgttcaggtgtcgccatatcaagaaagtcagcattcaacaaattctttaacttagtcgggttaacttcatagtcaccacgaaccaaggccaataccggtgcgccatcagccatgaaaaggacagccttgatcaatttcttttccggtaccttcaagaattcagcgacttcagcgatcgttttggcatccttagtatcaacaggttcgagcgctgcctgttcttcgaccccttgttttggcaacgccatgctggttgccatttcaaggttcgctgcatagtcagaactatctgaataaacaatcgtatcttcaccaatatcagcaatcgcggaaaattcttttgaatccttaccacccatggcaccgccgtcaccgatgattgaccgatagcgcaagcctaaccgatcaaagatattggtataagcatgttccatctgccgataaatggtatccaaatcctggtcattactagtaaaggaataagcatcttgcatgatgaattcccgaccacgtaaaacaccataacgcggacgatcttcatcacgaaacttatcctgaatttgatacaacaccaatggcatccgcttgtaggattttaattcattacggaccaaatcggtgaaggtttcttcgtgcgtcgggcctaagatcattttccggtcctgacgattcttcaatttaaataaattaggaccgtaagtttcataacgtccggattcttcccataattcggctggcaagaggacaggcattttcattttaacagcatcgattttggtcatttcatcgtcaataatggcttcaatccgtgctaaaacgcgttccgcaagtggtaaataagcataaacgcctgcttgaatctgacgcacaaagccagaccgcaacatcatcttatgcgacttggcctccgctgagctcggtacttctttttctgtgggaataaacatccgtgattgtttcatgtcagcctccaaagctagaatattttaaaagtagcgcatgatatcgttgattgtgaccgctagcattaatagaaccatcaggcccaagccaatcatggtcacaacgccttccgtttccggttttaatggcttacggcgaataatttcgatcaggttcaaaagaattttaccaccatcaagcactggaatcggcaacaaattggtaatccctaagccgagactcaagtaacccataaagaagagtaatccttgaataccgcctttggcactttgactcgtcatggtataaataccaaccgggccagccagtttattgagtgaaaaaccgccggtcaccatggatttgagcacgtcccaagtgcggacagccaaattccaagtttgagaaaagccaaaaggaatggcatttgctggggacttatcgacgtgtgcttcaaccccgatcttgccttctttattcggcttgatcacgatgttcttgcttttaccgttttccttcacagtaaatgtcactgatttaccggcatttttactgacgatctttgaaagatccgtgaatgatgacattttttgaccgtcaatcgtttgcaccgtcgcattggacttaagaccagcttctgcggctggataacctggcacaactgttccgatttggttggtattaagcacctgaacaccaaaaaacagaccgtaaataataaaagctagaatcgcgagtaagaagttattcatcggaccggcgaagttgaccaataaccggcgccaaaccggggcgttttgaaactgaacgtcttctggcgcgatctgaacctcggttccgtcttcttcaatgatcgtcgcatcgtggtcaacctgccaagtttgcaaggctgtttcatccccgtttggataaccttcaatcaccagatccttaactaaatcgacgcgactcacttgaaccggcattccgccggccaaagtcgttttgtcactggcattgatccggacaaccttgccttgatcgttaagaatcaggctcagcatcgtcccgggcttaatctcgtcctcctcatcttgccagccagccatgcggacgtatccgccaaggggtagcaaccgcagcgtgtaggtcgtattgttcttgtgcgacgcccatagcttcggtcccataccgatcgaaaattcccggactagaatgccgctgcgttttgcaaagtaaaaatggccaaactcgtgaactaccacaagaatgcagaagataacgataaaggcgatgatagtggtcataaaatctccttaatggttagacaatgccaaacagatgcagcatcggcaaaaccagcaacaaactgtcaaaacggtcgagaatcccaccgtgccctggaagaatcttgccggaatctttgacgccatagaagcgtttcaaagcagattcgattagatccccaatctgaccgataacggacaaaaatagggcgatccccatcatcggccagaaggtatagtactgcgggaagaacatcagatagatggcggcagtgatcaacgccagtgcaatcccgccaagactgccttcgatggttttattaggactgatagccggccacaacttatgacggcccaacttacggccaatcatataagccccagtgtccgtcagccacacgatcagcaaagcaaacatcaaggtgtccaagccagcatcattacgaacactaatcagataatgaaaaccggtgccaatataaaagaaggacaatactgacacaccaatgtcgtcaaaggtagttttattcttggtcgtgacggtcaggaatagcaacagcgctaccgcaatatatattaaatcgattcgtccaagaaaagcaggcagccagcggaaaaaactgttaggcagaacaaccaccagcacaccaagagcagcgattagataatcagccgaaaccagaattcgtttccgcatgataaacacttctgacaaagcgatcaccgctaaaactgcaccggcaatatcaatccaaccgccaccagcaatcaaaatcggtataaagatagccaaggcaacgactgccgtaatgacccgttgtttcatcgtaataaatcctccattaccaaaaaatagctgttttatttttttaatccgccaaatcggcgatcccgtgcctgatattcagcaatcgctgcttctagagctgcaggcgaaaagtctggccaataatcatccacgaataccaactcactgtaagcaatctgccaaagcaagaaatttgaaattcgcagttcgccgctggtgcgaatcaataagtccggatcagctaggtcgcccagaaatccggtcatcaacgcattggcaaagtgacggtcatcaatatcatccggagataactcgccttcctgaacttgtttagcgagcttttgtgctgcatggacaagctcgtcacgtccgccataattcaatgcaaagttaagaatcatgccggtattattggcggtgtcagccatggctttttcacttgcttgacgcgtttgcggtggcaagtcgtccagttcgcccatcacctcaactttaacattctccttgatcaagtcaggcatgaagtcattgaaaaaatcaaccggcaggcgcatgaggtaattgacctctgaacccggccgcttccagttttccgttgaaaaagcatacaaggtcaaaactttaacccctaagcgactggcagctttggtgatcgttttgacattttgcatgccttgtttatgaccggcaacacgcggaaaaaagcggcgtttcgcccaccggccattgccgtccatgatgatcgcaatatgagcgggaattcgcgcgggatcaagtttaactttagaagccttggatgtggccaaaatcggtgcctcctcataacgtcgatggtgtccttgcaccaaatgtctttaacgattgtagcagaaaaagaggcagagcgcgaactagcgcgggtataagtggggatattttattagtaacacggatttggacaacaggtgccattagggtataggaaaagggtgagccataatttcctcgcaaaacttgtgaccattgaatgccgattaatcgtcggaaggttctaggcataaaatatgcttgccgtgccaaactccgcaatctccggccagctggggtggcgacgcggagctagagcggagacggcgcttcgagcccaaaaaccggtctcgaagtcgcctaacaacatcagctccacagcccgtcgctgtgctgtttgcacggctgagccccatctggcctacgattgctccgccttggcactacagtctttaaaatcgcagtaaatatttcatgagaaaccaaaaaggaacaatttttcaaatcgaaaattgttcctttttattgtctgactgagaattatgtcccagcctttttgttggccgctgaaattaaacttcagtaatttctttttctttagctgcagcgatttcatcgatgcgcttggtagcgtcatcagtagccttttgcatgtctttttctaagcgatgcaagtcgtcttcggtgatgtcgccgtctttttcttggcgcttgagtttgtcgagaccttcacggcgaatgttgcggatcgcgattttggcgctttcagagtatttgccgacttctttggcaatttctttacgccgttcgccggttaattgtggaatgaccaaacgaatgacatcgccatcgtttgctgggttgatgcctagatcactggcattaagcgcggtttcgatgttctttaatgaggacttgtcatatgggctcacttgcagaacacgcggctctggaatcgtaatggcggccatttggttgagcggtgtcggtgcaccataatattccaccgtaatctgattcaacagactggcgtttgctcggcctgctcgaatattgccgagttcgcgttgcaacgattcttcagttttgcccatatttacttttgcttgatcaatgatttgatttgccattagcttctcccttcgattgttgtgccaatcttctggccttcaaccacgcgtttgatgttgcctggctcattgaggttaaagacgaccaaatcgatgtcgttgtccatggacaaggtgctggctgttgagtccatgactttgagatccttattgataatgtccatgtgggtcagactttcgtacttcactgcatgcgtatccttattcggatcagcagagtaaaccccatcaacattgtttttcgccatcagaatgacatcagcgccaatttctgcggcgcgtaaggcagcggttgtgtccgtgctaaagtacggattcccggtaccaccagcaaaaataaccacgcgacctttttctagatgacggattgccttgcgccgaatatatggttcagcaatttgccgcatttcaatggatgtttgaacgcgagtcggaacgccttgactttccaagttgtcctgcaatgctaatgcattcatgaccgttgccaacatgcccatgtaatcggcctgcgcacgttccattcccatttcggcgcctgtttcgccgcgccagatgttgccgccgccacaaacaatggcaatttgaaccccaagttcgtgcacttctttaatttgctttgcgatcgtcgcaatgaccggtggcttgatgccgaagccagcctcacctgccagcgcttcaccgctgatttttaatacgatccggttatatttgaccatgtatcctatacctccgttggttgctggcactattttaccatagtcgcagggtttctgcggaaagaagctgatttgaaattgagaattgcggaccgttattttccctcaccacggatcagggtaccccaaaaacacgcagtcacacggtgtatagcgcggaaaagaacggacgtttttaatttttcaagataagtaaaaagggacgctgccgagttgacagtgtcccttcaagcaattaacccttaatctgatccatcacttcatcagcaaagttttcttgtttcttttcaataccttcgccgacttcataacgaacgaagcccttcaccttgccgccttttgcagcaacgtacttagcaacggtttggtcaggatccttgacgaattcttggtccacaagggaaatttcgccgagccacttgttaacacggccttcaacgatacgtggcacgatcttttctggcttgccttcgtttttggtttcttctgtaaagatatcggtttgatgcttcaattcttctgccggtaccttggtccgatccaaatattcaggattgatggcagcaacatgcatcgcgacatctttggcagtgtcgtcatctgcgccttcgataacggtcaaggctgcgatttggccaccattgtgcagatacttgccaaagtgttcgttgtctgtcttttcaacaacttggaagcgacgcaggctgatcttttcgccgataactgtggttaaggcaattgcaccttcgtcaactgtctggccatcactcatcttgtttgccttagcagcttcaaggtcagctggcttattagccgcaatcgctgcagcaacattattaacgtagtccttgaactgatcattagaagcaacaaagtctgtttcggagttaacttcgataattgcagcggtattaccgttaaccgcaatttcggctaaaccttcagcggcaatattgccgctctttttagcagccttggccaagcccttttcacgcaaaacatcaatagctttgtccatatcgccatcagccgcaaccaatgcctttttagcatccatcatgccgacttgtgtccgatcgcgtaattccttaacttgtgcagcagtaatttgagccatggatctgatcctccttgatttaaaaaaggctgcctgcagatcttgcagtatgcgaaaccctcagacagcctattgtttaattaattattttgcacttttgttgtcgccttcaacggcttccacgatatcttccatggaatcagcctttttgtcggcagctacttgttgttcctgagcgtcgtcttgatcttcaccctgattgccttctatgatagcatctgccatcttagaagtaatcagacgaacggcacggatagcatcgtcgttagaaggaatgatcacgtcaatgtcgtcagggtcggtgttagtatcaaccatcgcaacgatcggaatgttcagtttttgtgcttcctgaacagcaatcttttccttgcgtgggtcaacgatgaacaacacgtctggaatgcgaggcatgtcttcgataccgcccaagaacttctcaagcttatcttgttgcttcttaagaagagaaacttccttcttaggaagaacatcaaaggtgccatctgtggccatcttcttgatatccttgagacgcttgatccgagtctggatcgtgttccagttagtcaaagtaccacccaaccaacgatggttgacatagtattgaccggcacgagttgcttcttcagcaattgcgtcttgggcctgtttcttggtcccaacgaacaagaagacaccaccgttttgagcttcttctttaacaaaattgtaagcgtcgtcgatcatcttaacggtcttttgcagatcgatgatgtagatgccattacgttccgtaaagatatacggcttcatcttagggttccaacgacgggtctgatgaccaaaatgtacaccagcttcaagaagctgtttcatgcttaatactgccatgcgtttgttcctccattatggttttattcctcttgacgacgtctcctcgcaagtggacttcaatcgaagcaccccactcacgatcaatcatcaatgtggtttgtgcatatcgcacttagaagattatacagacttttctttactttgacaagagcgtgaaccaccccggtttctggggtggtgatcgcgtttcggatcgtgatcaggtttctgcgcctgagaacgcgtttttgaggcaaccgcaagaaggtaatctttgcttcagttctattcttggtgggtaatctccggtagtccgagctggctccgctttctattctagaacctgagcaccagttgaccattgcatcattcgttaaatcatttaattgacatcaatcctgtttatcgccattcaacctgatgatcttccaaaaagacttccttacgatgccgggtctgatgtttgaaatgccattctgccgagagtgcatcatgcttgtccgcaaaggcttggtggtacaacaagcggaccggaagtcgttgggcagtgtatttagcgcctttcccggcattatgcgtggccacacgcgctttgacatcgtcggtgaagccgccataaaaactgccatctgcgcataacaacacgtaaaagtaatacgttttagtcgccattcagcaacctcctcaccgatgacgagtatgtgccatccgcttcgtgaacgatcaatggtggcataattcgaatcccgtttggtcggccggctttgatggcttcgattaataccatatttgcttcgcgatcttcccgcggatgaatgaactgcaaccgtttcggcgccaagccgaccactgtcaaagtcgtcagcagttcggccagtcgttcaggccgatgaacataaaaagctttgccttgatatttcagtaaatcggcactgacgcgcgcaaccgttgcgaagtcagtcgttaattcgtgccgagccaaggctaaatgatcatttggattagtgatactttgcgaactcactttaaaataaggtggattgcaggtgacgatgtcgactgaatctttggcaaccatttgggtggcatcagctaaatcaccgacttgaacagtcacattttgaagttgattcagcgccacacttcgcttcgccatatcagctaggcgcggctgtaattcaaccatggtcacctgctggtccgtgtcccttgccaaaaaaagtccgacagcaccgttcccggcggccagatcgaccacccggctgtgccgcttgacctgggcgaagttggccaaaaggaccgcatccagtgagaatgaaaaaacggctgaactctgaatgattttaatgttgcgactggccagaacatcaacccgttcacctggtaataatgacatcactaacacctttttcctccgaagtgcgctatacaatggtataatttaccacaaagtttatccatgaaggaagaataagccatgttttatagttttctgcgttatatcattgccggtttaatctggctcatcaatggccacgcccaaactcagaacaaacagcagctacctgaagggccgtttgttttggttgcgccgcaccgtacgtggctcgatcccgtttttctagcactggcttcgtggccgcatcatttttcatttatggccaaaagtgaattattcaagaatcctttaatgcgctggctgttagtcaaagtgggcgcctttccagttgatcgggcccatcccggtcctagcgcgattaaagtaccggttcgtgcgttaaaagacgaacacaaagcgctcatgattttcccaactggctctcgctattcagctgatatgaagggcggcgcgattctcattgcaaagctagccaaagcccccatcgtcccagctgtttatcaaggacctggttctttttggtcattatttaaacgtaagcctgcgattgtgcgcttcggtgcacctgttgaaccgcctaaaggtaagctgaccgacgaagcccttgccgcttttagtgacaagctgcaggaaaactttaacgcgctcgattacgcgatcaatccagagtacaagtatgtgcctgacaagaagaaatatctggaagaaaaagaacacggagaagtttaaggttcgctagtcgaacctttttcctttttattcaatacagaaagtgagcttgattcatgaatctttggaaacagatgacccgaaaacctgatgttcaggccgcactcaatgctgatcatttactgacacgcagtttaacaacgcgtgacctgatcgcgttaggtattggcgccgtcataggtacgggaatctttattcttcccggaacagtagcggcgactaccagcggaccagcgatcacgattgcttttattttggctgccatcgtctgctcgctagcggctatgtgttatgccgaattcgcatcggctctgccagttgccggctcggcttatgcttacggcaatctcgtgtttggtcaagtctttggatggattattggctgggcacttattttggaatatatgctggcagttgccgcggtttcaaccagtttttctgcgtatttcgctagtcttctacaaggctttcacatcaccttgccagcagccattgccggtccgttttcgccgagtcacggcacttatgtgaatctgattgcggtcattgttgttcttatcattggtgttatgttgtcacgcggtatgcaatcctccatggcgattaatcgtttaatggtattagttaagttagtcattattgccatttttattgtcgttggctttttttacgttcagccagccaactggcatccatatttgccatttggtgcaaaaggcgtacttgccggtgctgcgatggttttctttgcctatctcggctttgacgccgtgtctgcttcagcaccagaggtcaaaaatccgcaacatacgctaccacgcggcatcatcggcactttagtcattgccaccattttgtatgtgttagtcgcgattgttttgaccggcattgtaccattcaccaaattagatgtggccgatccagttgcttttgccttgagcgccgtgcatctgcgtagcgttggcggtatcatttcggtaggcgccttggctggcatgttcaccatgatggtcaccatgatctacagctcatcaaggttgatttatgcgatcggccgtgacggactgttaccccgttggtttggtcacgttaaaggccatctgcctgaaaatgcgttgtggactgtggttttgatcattgcgatcatgggcggccttgtgccactcacgcaactagtcaacctcgtcaatatcggcaccttaattgcttttgccctcgtctcaattggcatcatccccttgcgccgacatcaagcctttaacaacgaaggtttcaaggttcctgggtatccagtgacgccgattatttcttttctgttttgtctgctattgatgacccagttaagtgtcgaaacttggattatgagtctgatctggtttgccttcggacttgtcatctacttcagctatggcatccgccacggtcatgttgccgaaaaaagaattgaatgaatctgctgaattaagaaaggaaaataagtcttgatcaatcctcaaactgcaacctgcttggtggacggtaaagtctatgcgattagcgatggccttttcttaagcgatttggagcctaagttggccaatatcatcagaaacgactatccgaaggcgactaagaacagtttcatctgcaatcctcaccttctgacttatcggctagaacgcatgcggcgccaacaacggcaagatgcgcgtgcgcatgataaaatcaatcgaaaaatgtcgcaggctttggtcaaagacaactttcagctgaccaatgtttacgacaacatggaagcgacgattacttttggcgagcgaattgccgatgccgttgctaaatatgccgggtcttggccattcattatcattttttctggttttatgattgtgtggatgatcctgaatacggtcggcattttcggggcgaaattcgatccatttcctttcattttgcttaacttatttctgagcatgatcgctgctttgcaagcaccactcattatgatgagccaaaatcgagcggccgaatatgatcgcttagaagcgaaaaatgattatcatgtcaatctaaaatcggaagaagaaatccgactgttacactcaaagttggatcacattatttcagatgacaaccccaacttatttgagagccaacgactcaccgttgaggttctgggtgaaatggtcaatcaactcactgaaacccgccagcaacttgaattgttaaaggcaacgcaggatcaggccaataaggatatagccattgatcaaaaaaacaaaaccaatgagtaatcatgtcaattcgatttatattgaaaaagatccccggtactgtatgcaagcgcaattgcctgtacatggtactggggatctttttaatgatttgcatttattcggcatgatcgccaatttgcagatgatacatttcatagtatcggccacgcttggctaacaattcgtcatgcgtgccgcgttcaacaattcgacctgcattcaaaactaaaatcaggttggcatcttgaatcgttgatagccgatgggcaattgcaattgtcgttcgcccttgccgaatccgacgcaagccttcttgaataacggactctgtttccgtatcaatgttggccgttgcttcgtccagtacgagaattttcgggtcagtcaccactgtgcgggcaaaggaaatcagttgtcgttcgccgctggaaaactcagtaccaccttcaataaccttagcatgataggtgcctggtagtttatcgataaagcgatcagcttgcacaaactcagccgcctgtttcacttgctcatcggtaatactgtcattgaacaagcgaatgttgctactgatatcgccatagaacatgaatgaatcctgcaatactaatcctaattttttccgcaattctggcatgggatagtcgcgaatgtccacgtcatcaattaaaatctggccttcaccaaactcgtagaaccgcatcataacgttgataatcgagctttttccggaaccggtgtgcccgaccaaggccacggtttcccccggattggcaacgaagctgatatcatgcaaaatatcgtgcttgccatcataagcaaaactgacatgccggaattcgattttgccttgttggatcagcgcatgagcatcaggatgctgcgctggcgcatactcttgactgtcgagaattcgaaaaatccggctacccgcaacaacgccatcctgcaaaaacgaaaggttatccatcatattaaccatcggattaaagaagtttgccgtgtaagtcgtgaacgcatagatcagtccagcttccacgtaactatgcatcgaaatcaatccaaaggcccataaaaccgcaatcaacgcaaaggaatataacaagttaatcactgacgacagcaacaaagaattgacgcgaatcatcgccttacgtgagtccaaatattcctcattcgtcgcttcgaattcttgactgatgcgattttcctgacgaaactgctgaatgatgccgatgccttcaatagattcgttcagttgggtattcaactctgacagtttttcacgcatgtgccgataaaccttggaactgtacgtgctgtaataccagaccactatgagcaaaatgggcagaaaggcagcgaccatcaaggctatctttggattggccgcaaacatgatggcaaaactgctaataactgagaataacccgacgataacagctaaaatgacgttccagaaatcggaaaatgtcattgtgtcattggtgacacgcgacacaatcgaaccagctggcgtctgatcaaaataccgcatacctaacgtgtgcagtttggcaaacagctgacggcgagcatcttctaagccgcgctctgcgcccatgttgaataaaaatgtctgaaaaaattggaaaacagctttaacgagcgtgccaaatgcatagagtgctgcaaacagcagcagaatctgaaccgttgcactttgattggccaaataacgatccatgaactgttggagaatgaatggtagcaaaacgttcatgcctgcaagcaacgcagccgccacaatggcgccaataaactgccgcttatacggtctcgtgtaccccatcagccgcttcataattttgagttgttgtcgaatcggaatacttttcgaccaagcactctcataacccttacttgccaagtgattcaccttcttccgctgcttccatttcttgttttgcccacatttcggcataccagccatgcttggtaattaattgttcatgagtcccgcgctcaatcacctgaccattttcaaggacgagaatctcatccgcatgcatcactgagctgagacgatgagcagcaatgattgtcgtcttatgggcacgatcctgcttcatgttggctaaaatttcttcttcggttttagcatccactgcagacaaggcatcatcgagaatcaagagttcaggcgcgttgatcactgctcgtgcgatagacagccgttgcttttgaccgcctgacagactgactcctttttcacccaccagcgtgtcatagccagccgcaaactttttaatgtcctcgtgaacagcactttctttagccgcttgctcaacatcctgttgtcccttttcgaacgctgaaaagcgaatgttatcggcaactgttgtcgagaataagaagttgtcctgtggcacataaccgatcgaatctaacaaggcgtccagtgaataatctttgatattatggccgccaaactcaatcacgccatcgtagttatcaaactcgcgtaaaagcaacttaaaaatagtgcttttcccggcgccgaccttgccgacaatccctagcgtgtgaccttcaggcagcgtaaaatggacacggcttaaagcgacctgttgatcatccggataactaaatttattgatttgataacgaatatcgccatgcgctggtgtcgtaatcgcgtctttggcttcaaggatagtcgacttttcctgcaacagttcatcgacccgatcataactggcattcccacgttctagaatgttaaacaatcggccaatcgcaaacatcggccacactaatgctgacacatacgtcacaaaggaaaccagttggccaatcgtgatttgtccatgaacgacctgccagccgccatagatgatcgtgatgacataggttaagcccatgatcagacttgtcgttggatcaaataaggcatcaatcatattcacgcgccgattaatttgcacggtatggtcgacaatttgattaaaatctgccgtatcttcggcttcctggccaaatgttttaatgactttaatgccgctgacactttcctgcgttttatcattcaaacgtgaaaaagccgcctgcgattcagaaaaagccgcatgcaagcgggtgccgagttttcgtgccatcaccgccaataatggcattggcaaaatggcaacaatcgtcaaccgccagtcaacgaccaacaccatcgcaatgatggtggtgccgccagtaatcatggagtcgaacaaggttaaaataccggccccggcaacgttttgcaccgcgttcaggtcattggtcgcatgcgccatcaaatccccagtacggtgtttttgataaaacgtggcgtccattttcataaagtgccaaaatagccgcgtacgtaacgttcgttcaagcttcgcagcgccaccccagatcgcattacgccagccaaaccggaataaatactgggcaaccccggaaaacagcaataaccccagcatccacgccaagtgactgctggttaaccgagatttgctcatcgcatcaacgagatccccaataacttttggcggaatcaaattcaccaaggccacgagcagcaaaaaagtaacgccgagcaaataccggcgccattcttgtttaaaataccaacctaattttctaaagattcccacgacactgctccttaacccttttgctcatggtttccccatcagcatctcaaaataattaacgttctctcatcatagcacaaacgcactgggacacgaaagcgcgatgacaaagtgattcctgtcatcgcgctttcttagcaattacttagcgttacgttgggcttgtttcatttgcgccatcatctggttcagtttcttagcagatggtttttgacccatctgcatcatcatcgtgcgcagcatttcttcgttcacaggcggattatcctgaaaatacttcttcatgtaagcccgtgccccgaagaaaccgcctgccaagccgaccagtaaggcaatgatccccacaagtactgtgattaacaatgtgcggcctccttcaagtttcattcttcattgtactaaagcaggttgacgttgaaaagactaatcttttcgccaaccgtgttcacgttgaatcttttgaacttttttgctagtgagctccttgccttttttatcaaagacctgagtatgctcgatttgatctcgcaatccggcacgaaagtcctttaaataagcctcgcgcaattgttgacgctcgattttctcttcgggcgtcaaaccaacactgcgatcttttttagctaattcattgatacgatccagtcgttcttttggttgttctgccatcatgctacctcctacaatttcagtggcgtgcatcagttgagttgcactgcggcgtaacaataattcgccgcctcatgcttaggataaggcgcattctttaacatcgcaacatattctgcggctcgtcgttctgacgagaaggctttcaacaactcagtcggtgccgactgatccgcatagtagacgatgtagacaagctgatcatccatcagccttcacctcgagtctgtgggtgcttcttttttgcgtgtacgagttttccatcctactcatgcttcgctataacgcgcttgccagcccaaaaacctgcatgtaaggacatcagttgcagtgaccaaaagccggccatcacgaccgaggccacttacacactggtttctaagcgggctggctcacgctcaaaaaaaaagaccgtttgccggcctttttccagtattaacgacgcttttcgcggatacgagctgctttcccacgtaatgcgcgcaggtagtagagctttgcccgacgcacttggccgtgacgggtaacttcgatcttttcaacacgtggtgaatgtaacgggaatgtccgttccacaccaacgccatttgagatcttacgtactgtataagtagcggaaatgccaacgccgtgacgcttgataacaacgccttcgaagagctggatacgttcgcgttcgccttcaacgatcttggcatggacacggacgttatcaccaggacggaagtctggaatgtcatcgcgtaactgtttcttggtaatttcttgaatcaatgggttcatgggtatttctcctttgccgacattcataatcatcccgaccagcggaatgtcgttgatgtgtgacgtatcacagtcaataagtttaccatgactggttggacgtgtaaaggtgaaaatctttacggtatgctaacgttcaggattgattcttcaatcttgcttctgccgccttagtagcttcttctgttttaacttctcgcaagagtttttgagcagtttgatcgagcgtaatggttttcaagagatctggacggcgaagataggtgcggcgaaggctttccttttggcgccagcgagcgatgagttggtgattgccattttggaggacttcgggcactttcatcccccggtattctggaggccgggtgtattgcggatactcgaggagaccgttctcgaagctatcggtgtgggcactttcatcattgccgagaacgcctggcaggagacggacaatagcgtcaatcatgaccatagcagggagttcaccaccagtgagaacgtaatcgcctaatgaatattcatcggtgacaagcgtgcggatgcgttcatcgtagccttcgtagtggccacagatgaagacgagatgatcttcttgcgataacgctcgagcggcttgatggttgaacttcttaccagccgggtccattaaaatgactcgctttggaccggggtgacgctcgttgacaccatccatcgcctcaaatagcggttctggtttcagcaacatgcctgcaccgccaccatatggcgtgtcatcaacatgatgatgcttgtcatgactatagctgcgataatccaccacatcaaaattaagtagctcgcgttcaatcgccttgccgatcatgctttcgcgcaacggctcaaacatattcggaaaaagacttaaaacatcaatctgcatcgtcaatcaacccttccggcacgatcacatgcgccactttctgatctaagtcgatggactggacaacggattttaggaaaggcagtaaaatatcgcttttaccgctacgaggaataacccatacgtcattgggacccgggcttaagatttcattgactttgccgagcgtctgaccttgttcatcaataaccgttaagccgataatgtctttgtaatagtaacttccctcgtccagcggttgtaacgctgtctcggtaacttgcagtttcttgcctttaaatggcaggacttgattaatatcggtgtaatccttaaaggtcagcaaggtgagccccttgtgttctcgcacggattgaatcgtcaaggcagttttgggtgatgttgccacataaacagtgttaccaaccttaaaacgatcggccgggaaatctgtcgtgacaaggacgcgtacttcgccacgaataccgtgcgtgttcacaatggtgccgatgtcataataatctggcatgttcttcctcctctaaacgcgttcgctggcccagaaacctccacattaggaccttgaacctaaatggccacttatgctccggtttctaaccaggccagcgaacgctctttcaaaataaaaagaccgacgcggtatgcgtcagtctttttattctgcatgcgatgcatccaaaatattgagccgcacccgcttgttgtacgggcttttgacactatatacaatggttcggatcgcttgcgcaacccgaccttgtttgccgatcacgcggccgacatcttcaggtgccacagccaaatcaaaggccatgtaatcacctgtttcatgcgcagtcaccttgacggcttctggttgtgtaaccaacggggtgacgattgcttgaatcaagctgccgatatccaccattgataaccgcctttatttcttggcaaagcgcgcttcgtgatacttctgcatgatgcccttgctaccaagcaagttacgtacagtatctgaaggttgtgcgcctttttgaagccagttcaaaatatcttcttcatttaatttcaaatcgactggattagtcaacgggttgtaatagcccacggcttcgatgaaacgaccgtcacgcggggagcgtgagtctgctacaacgatccggtagaaaggcttacgctttgaacccatccgctttaaacgaattttaactgccactaagtccacctcctgctcatttatcaaccttgatagcatagcaaaaatattttaagctgtaaagccttttttctttacacaggtaaaatgtgtcgtttggcaacggtcttgttcctaattggttggtcaggaaaaaattaatttttaggaatggaaacgcttggcatttttcagccgacgtttcttgttcttcttttgtttgcggaccattgagttcatcgccattttgccaagtttgccagaaacgccgccgcccatgagaccgtcgaggcccttcatgttacctttgctcatctggttcatcatttgcttgctttgattaaactgcttaatcatccgattgacttcaaccactggccggccagaacctgcagccaaccgccgccgtcgacttggattgagaagatctggatcttcgcgttcttgcggtgtcatcgagtaaactatcgccttcatgtgggcaatgtctttcggatccattttgacattggccaaggctttgttgtttgccattcctgggatcattttcatgatatcttccagcggacccattttgctaatctgatccatttgatccagaaaatcattgaagtcaaaagaattctcgcgaattttttcagccatttccatggcttgtttttcgtcgtaattcttctgtgccttgtcaatcaaggtgagcatgtcgcccatgcccaaaattcggttggccatgcgatcaggatagaagacatccagcgcatccatcttttcaccttgaccaatgaacttgatcggcttgccagtgacggcacgaatggacagtgcggcaccgccacgagtatccccgtccagtttggtcaggacaacaccggtgatatctagctgctcattgaagcctttagcaacatcaaccgcggcttgcccagtcatggcatcaacgacaagcaaaatgtcgttaggatgggctagttccttgatgtttttcagctcgttcatgagcttttcgtcaatctgcagtcggccggcagtatcgatcagtacataatcattcttattttctttggcagtcgccaacccttggcgaacaatttcgaccggatcaacgtcggttcccatttcgaaaactggcacgttgagctgtttgccgatagtctgcaactgatcaatcgctgctggccggtaaacgtcagcagcgatcaataatggccgcgcactgtcattgtccatcagatacttggacaacttaccgacagttgtggtttttccggccccttgcaaaccagccatcatgatgacagtcggaatatgtggtgccttgttcagtggcactgccgcctcgcccatcgtcttgaccaactcgtcattgacgattttaatgatctgctgtgatggggttaaactttcaagcacttcagcgccaagcgccttggtgcggacgtttttaataaatgttttgacaacatcaaaattgacgtcggcttccaacaaagccaagcgaatttcgcgcattgcatcgcgaatatcactttcactgaccttacccttacgccgcagtccgctgaaagccttctgcagtcgttctgataatccttcaaatgccataatttccccctgctatttcgcggtttgatccgcgactcgttctaataaggtacttaatgccttgtcgtctggataatgtgtacgcgcataactcactaacgtatctacagcttcattttgcgcttgatagttggcgaaaagatgcaacttcttttcatattcttccaagctggcctcagtgcgtcgaatattgtcatacacggcctgacgcgagacattaaactcggttgcaatctcgccgagtgagtaatcatcaccgtaatataatgccagataggcgtgctgtttgtccgtcaataacggcccgtaaaactcaaacagcgagttcatgcgataatttttttcgatttccatcatgtcattcctttaatcccatgattgccggcaactcagtttccccggccgcttgaacatggtccttgtataaggataccggtatcgctgaaaatggtcaattacttaaaaaattaggttgatggccacggagctaaatgctagcgtagaaagccagcttcgactatcggtggataacagccaagaaatagggtcggagaaaagatcgctttcttgcaattgcttcaaaaacacatttgcatccgtagaaacctgcacataaggaccttgaacgaggttggcacatcgttttcagacaggaaaaggcttccataaaatattgtttgttttagtcttctcgtggagtatttactgcaatttttaaagactgtggtgccaaggcggagcattcgtaggccagatggggcacagccgtgcaaacaacacagcgaccgggctttggagctgatgttattaggcgacttcgagaccgggctttgggctcgaagcgccgcctccgctctagcttcgcgtcgccaccccatctggccggagattgcggagtttggcacggcaagaaggttttagcctagcccttcctacgattgttcggaatttaatgactcacaagtcctacgaggaaaattatggttcatcctctcggaggttccgaaacgcgcgaacaggcgcagaaacctgcacataaggaccttgaagctaaatggccaaaacccagccatttagcttcaaggccacttatgctccggtttctaaccgcgcctgttcgcgctcttccagtttcccctagtttcgtggtacactgaacatgtgaaaaattggagggaagaatatggtctcaacctttatttactgggccgtgtttgccgctctcgctgcttggggactgtggagtttggtcttctcatgtgtttacctgagcaaccatgaaaacggcaatttgtggttctttgctatcattaatgcgattcttggccttctaggctggttattcgcttggatcatgagtaatacggcatggcaacaatactggtttgcaagtaaggtgcagccatctgcatggttcacctacctgctcatcggttaccttgtcttgattgtcctacaggtcatccttggccgggagaagaaagtgcaagcagcttaatgtcataaaaaaagcgtcgtactggtttttcgccagcacggcgctttttcgttattcttcattttaattaagcttcgacctgaatcaaacccttaaatagtccggccacaaatttggttggatcaaaagcttgtaagtcgtccatcttttcaccaaggccgacaagtttgaccggtacatgcagttcattgcggattgccaacacaattccgcctttccctgaaccgtcaagttttgtcaaaacaattccagtgattttagttgtttgattaaactccttagcctgattaagtgcattttgaccggttgtcgcatccagaaccagcaagacttcctggggtgcatccggcaattcgcggacaatgacccgcttgattttgttaagctcattcatcaagttgaccttattttgcaatcggccagctgtatcaacaagcacaacatcaaattgctcatccttggcgcgtttgacaccatcaaaaaccaccgcggccggatcgccgccttctttcgtggcaacgacaggtacatcaacccggcgaccccattcctgcaattgctggatggcgccagcacggaatgtatcggcagcaactagcagaacccgcttaccttcttcctttagctggtgggcaagcttgccgaccgttgttgtcttaccagcaccgttgacgccgacaaacaggaacacacttggccctgattcagcaaaatgtagggcattgtcttcatccttaccagcatcgccatacatatccaccagcttctccacaatcacacgggaaacggccttagggtctttggcatttttaagcttaacttcttcacgcaggtcgtcactaagcttaactgccgtttcaaagccgacatcagactcaatcagcatctcttcaagattgtcaaaaaagtcttcgtcgacactacgaaaattagcaaacagtgcattgagtttttcaccaaaactgctgcggcttttttctaggccctcatcatatttattttcttcaggcgtttccggttcatcaccggtaaacgcctttttgatcgcatcaaaaagtcccattaattgatcgcttctttctgtgattgatccagactaacagccataattcggctaacacctgattcttgcatcgtgacaccatacaatacattcgccgcaaccatcgtgccatgccggtgagtgatgacaataaattgtgtggcgctagcataatgccgtaagaattcaccaaatcgattgacattaacatcatctaacgaagcttcaacttcatcgaggatggagaatggtaccggacgcacttttaaaattgcaaataacagaacaatcgccgttagcgcccgttcgccaccggatagaagggaaagccgagtcagttttttgccaggcggctgagcggaaatctcgatccctgttgcgagcaaatcatccggattcgtaaggctcaaatgtgcatgaccgccaccaaacatttgcgggaaaattgcttcaaaagcactattggtctgatcaaacatatccttaaatcttgttttgaccgtttcatccaattcgtgcatcgtttcttctaactgctgcttagcctctagaagatcatcttgctgcttggtgagaaattcgtagcgttcattgacttccttaaactgatcaattgcgttgaggttcaccggtcccaactcatcaatgccacgctttaaaagcttgagtttacttttcaattcaggaattggcgcgtgatcggctgtcactgcttccttagcggcctcgtaagtcaactgataatcctcggctaaagtattcaaccgagcatccaaacctagtttaactcgattcaaagcaaccgcttgctgctcagaagttgccatagcttggtgttgctgctcataagtggtcgtaatacgcgccgatatttgactcagcttaccacgattttccgccttttgttgtgttaatttggtttgatccgccttgagctgctttaattcagtttgcaaattcgcgatcgtagcggtacgactggccttttttgcagcagtttcttcggccgtcgcagtaatgtgctcaattcgttgttgcaaatcggtcgcttgggcttgcgcatcgcgtgcttgcgtctgccattgccgttgctggtcattcaaggtctgcaaatcattggttgtgactgctagcttggtcttcaacgcattaaccgttgctgcatgctgggtgctggatgccgttgccgccgcaacagccgccttagcattttcaatagttgcttgtgcttcagcaatatcttgaaccaattttttaccttggtgctgcaactcagttaatttggcactaagatctgcttgcgccgtatctgcttgttgcgccgctgccagctgacgttgcgcctgacgcaaggtttccgcttgggctgtgtgctgactcgtaattgttgtcaactttgcggttaatgcctgtgcctgttgggaagccgtttgccaagctgcctgggccacgttttcttttttcgtcaaagcagtcagatcagcttgctttgcctttaatgtttcaacaagcgtttgcagttggacctttaaatgccgggcctcttgactgcgagcaagcggcgatgcttggcgtccctgcttgacttggcccccagtcaacgaaccccccggatttaaaatgtcgccagctgttgtgacaattcgataacgatggtgggtggtattggcaatcgcgatggcatgtggcaaggtatccaccatcaaaacgctgccgagtaagttcgccatgacgtgtgccaaatctgcaggatattgggctaattgcaacccagtgcctaaaaagccttcagcaccttcaaccaactgtagaaccgcactgggcagctctcttggccgcataacggcagccggcaggaaagtcgccctacctgctcgttgttgcttgagcaggctaatggcgcgttgtgcagccgcttcgtcacgggtcacaatggcctgtaagttgctacccaaggctaagtcaaacgcctgttgataggcagttggaacctcaagtaattctgcgaccgcaccaatcactccgggaagttgatccttatgctttaaaaccacccgaaccccattgtaaaagccagcataatcatcattcaattcggataacgtttcatatcgcgcccgactgcgctgataggtggccagctcgtcttgataagcttgctgttgggccgcccgttgttgctgcaatagatcacgatcagttttggcctgctcaacggctgtttgctgttcatcaacctctgcttgcaactgttgctgctgcgtcaataatgcagtgaccttggcttcctgatcctgtgcatgtttactcagttcgtaaatccgacgatcatgcgcagcattttggctggcggctaactgttgatctttttgtaaagcagcctgagcatttttgttatcggcctgtgactttaacagatcaatataatgattctgggctacttccacttgttgattcagtttggctggatcctggtttgcctgtttctgctgggccaattcttgcttaattgcttgctctttttcggcggcagcagttgtttttgtcttaagttccttcaatcgctgatttgcttctgttaacgcttgttgagcacgcgccagtcgttcctttaaatcggccaacgtggtttcagcattagcagaacgttcactagataggttggcttctccgctaagattctcaagcttcatcgaccggctcaagacctggtcattcaactgattaagctggttctcaaactgtcgatctacggcacttaaccgctccgactgatcttccaaatctttaaccttcgccgtcaaagcggcgatggtttccttggtgaccttagcctcaccttgggttttctcctgttcagtcgctagttgttcgatctctaaggctaataaggtttgatgaatctgatgatactcgccggattgttgttgatagtccttagccaacgaagcctgctcacgtaatggttccacctgatgcttcaattccacgataatatcgttgatccgcgccagattatcatcgttattggcgagttctcgttctgccttggttttctgttgtttatatttataaacgccagcggcttcttcaataatgccccggcgttcttctggtttactattaaatatggcttcaacccgcccttgggaaatgaacgaaaagctttcacgccctaagccggaatccatgaacaaatccacgatatctttcagccgaacatcttgaccatttaataaaaattcagatgtcccatctcgataaagtcgccgagtgacagaaacttcatcaggttgatttttcagataaccatcatgattgtcaaaagtcatcgtgacagatgcacgattaagcgctggtcgcgtatcagtgcctgcaaaaatcacatcgcccatccgttcgccgcgcaagcttttagcactttgttcgcctaaggcccagcggatggcctcagtgatattacttttgccactgccattaggtccgacaatcccagttaaacccgacacaaaatcaatctcagttttgtctgcaaatgatttgaagccattaatgattaaacgctttaattgcatgatgaccccaattctacttaccgtttcaagctggctaatgcagcttttgcagcagcttgctcagccgctttcttattcttgccaaaaccggtacccaaaacccggccatcgacttcgacatcaacgtggaactgccgctcatgggctggtccctgctcatctaataagtgataaacaatcgccacatcaccattttgctgcaaaacttcctgtaaagccgttttgtggtcttgatcggctgaaaactctcccgcgtcaattttcgggaaaataatctgctgagcaaaccgaatgttggcatcgcgtccttgatcaaggtataaggcgccattgaaggcctcaaataaatcttctagcaacgttaagcgtttccgcgccccagctttttcctcacctttgccaagtttaatataccggtcaaagtgcgcttcttttgaaaaagccgagaaggccgctgtctgaacagccgctgcccgaattcgggtgagatcgccttcgggtttgtcgggaaacttgcgatacaaataatctgaaactgtcaattccaagacagcatcgcctaaaaattccaatcgttcattgtcttttaaacctaattctttatgttcattcacatatgaggaatgcgtaaacgcctcatccaatagactgaggtcatgaaattcgatcccataacgttgacgcaattcactcacaaactctgaggcaaccattaaaaatcctcctcgaaaatgcacgcatgagctcgtgaacagcttgggtcataagtttagaagtacctatcagaggctggctatcacttctaagcagctgacacgccattgctaaaccggacgcattcacgcgctctttttttattaccttctaattatacaagagcgcacaaaaaaagacacctgcgattgcaggtgccctgtaagatctaacttttacttagaagcacggctgctgcttgtaacagtcatcttagcccaattcaagttagcggttgatgcatagtcaacactcgcgttcttgacgcgcttgttaaccggatagatttcttgacggtacagagtcgggatgacaaatgcttcgtcattcgcatacttctgccaatctttcaaagccttggcacgatagctagcacttaatgccttctggccatcaatgtcgttcaacaattcggtgttctttgcggaaacaaaccgactgtagttgaatggtgctttttgagagtacagatccattggtgaaggatccgaagaaagactccaagccgctgcgtaaacatcaacgtccttgtcatccttttgaactttgtcgtagaaagagttaaattcgatcggacgacctgttgtcaacttgacgcgcagaccaatcttcttccattgctggatgtagttttgtgccattggttgagcggttgagccaccagccatagttgcaaagttgattgtcaacttcttgccatcaggatcggttcgataaccatccttgcccttcttataacctgccttatcaagcaaactgttggccttcttgatattcaagttataaccatcaatatcggcatgaacatctttaccaaagactggcggaatcaaggttgttgcgcgagaacgcgtgccgttatagaacttagcagccacttgatcgttgttcattgcgtaacccattgcctgacgcaaactcttgttagccatcttagccttaggattatagatgttttcgctcttgctatggtcccatttacctaacttaaagccaatatagttataggccaagctctgtcgtccaagattgtcataaccgccgatactcttccaatcattgtagctatcagctggcatgttataaacaacatcgtacttatgattcttcaatgctgatgtaatagaggcagttgaaacattttcaaaagtgatcttgtccaatgttggcttgcctttccaatagtactggttaggcgtatattcaatactttgaccggcaacaatcttgctcatcttataaggaccaaagaagagcggctgtttacgaactttgtcgcttgactctagcttgtcaaaagcaacgtcatgtagatagtgatatggagccgcgttttcaaggaaatagccgttccctgaagtaccaaacgaaggcttcatctgcttgaagtgaatgaccattgtatcgccattatcacccttgggcatggtcaatccagaaattgaatcagctttaccatcatggtattcggtcaagccttcgatgttctgaagggattcagtataccgttggctcttagtagctttgttagccatgatttcatacgcataaaccaaatcacgggcaacgactggttgaccatcagaccatttaacatttggtttcacagtcacggtaatcgtcttggcactattgtcctgcttcaaggtcgcagctccggtgttgttgaacttaaatttgctgttgtaagcaaataaagactctgctgccgggctcatatattgattgtcataattgtcggtgtacagctcttcgttaaagacccccttaaatggtgaatcattaaccaccgccacattgacattaccgcctttgatcgcctttgcggagttgttgtaagaaaccgggaacttcacagctttattagctgtacttgagctggagttcgagctcttactgccacaggctaccaaggtgatcgataaagcggtagcgagcgtgatcattccgaacacagaacgcttcttcatactttttcccccttccgcgtcgtcatcgcaatatgtaaacgaagcaacgcttcatgtgagttaaatgatagcataattagaacagaaaaaccaacttttgggcacattttttactttttttcttcaaaaaaggagagacacttcgatttctctaagtgtctctccagtgattttcagaaaatgaaagtcaacctcatccgcgacgctggcgtgaatccgctgcacgacgcagtgcttgacccacaaagttgatcgacagggatagtgtcagcaagaccaacacggctgggaaccaaacccaccaacgatcaaagatcaggtcggggttggaggcatagccgatcagcgtccctaaactaggcgtctccattggcaacccaaagcctaagaatgacagagcggtttcaatcccaatggaactggcgatggttaaggtcaaatcagtgatgattaaggaactgatgttaggcaagacgccggtgaacatgatcttgaaattagaggttcccgacgttttcgacgccatgacatactcactgcgcgcttcagagagcaccagcgagcgcatcagtcgagtggtcgtcatccaatagaacgccgccataattaagataatggtgatgacgttgtactgcggaataatcgtgaccaagacaatgatcaccagcaatgatggaatgatcatccagaaatcgaccagtcgcatgatcacggcatcaatcaagccgccgaagtagcctgagattgtacccagtacgacacctacaaattcaatgatcaacgcaacggaaatcccaatggtaatcgaatttcgggctgcaaaaaacagatacttgaacatgtcacggccaccctcatctgtaccaaggatatagccgccggttccgggcgccatatagcgatccaaaatattaacttgcgtcgcaccgccgacattgaacatcagtgaaccgatgaacgcagcgaggataatgaacacagccaagaataagaacacaacagcaactttatctttgcgaaattcattcaaaatcaccttgaagttagaaggtgattgttcaactttggtggttgccgccacctcatttgcattattttgcataagttttccccaccttctactcgatccggatccgcggatccacgatactcatgatgatatctgacagcaaattccctaacaacgtcaagaaaccaaatagcaacaccagcgagatgacaactggatagtcacgactggtcatagaagaaacaaacagttggcccattccgggataactgaacactgtttccagaataaccgatccacccagtaacatggtaatttggttccccataaacgccgcaatcggcaataaggaattacgcaaaatatgtttgttgaagatgacacgatccggcaccccttttgaacgggcagtccggacaaaatcttgtctcgtattatcaataacgccagttcgcaaatactgaatcgtgcttggtgtggtgataatcccagcaaccaaggctggcagaatcatgtgataaatacggtcccagacataccctaacgtgcccggattataagtggatgacacactaccaccggttgggaaccactgcagaaagaacccgaagaaaattaaacccaatagataaaagacgaatggcggtaccgccatcaaaatgaaagagccaacagagatagctgaatcccgcttggtgccttcgtaacggccggcaataacaccggctggaatagcgataacgtacagaataaccgttgacatcaaggccaaccagaaggtgttcacggcgcgttcgccaatcagaccggtaacagaacgtttataaacgaagctttgtcctaaatcaccgtggaacatattgccaacccatttgaagtactgaatataccaaggatcattcaaaccatattgctggcgtaatgctgccatctgcgcagcactttgaccttgcgagaaattaccagtcaatggatccccgggcatcatctttgatagcatgaaaaccaggacgcttaacaagatcaattgcgggatcatgattaagacccgtcgcagaattgttttccacattaatcatgcactcccttcatcgttgaatctggcagcgcaacaaaatgtgtgtcggaaatcttctggagatccaaaacgcggccttctttagaataatattttgattcttcttctttaaaaacacgttcgacttcacgacgatgctctttattcttcttccgatcatcagggttgatgtcaggaatcgcagaaagcagtcgttgcgtgtagatgtgctgtggatggttgtagatatcttcacgcgagccgatttcaacaaagcggccgcgatgcatgatcgccatgttcttacacatgtgcttcacaacacctaagtcatgggaaataaacagataagaaatattgtattcctcttgaatccgcttcatgaagttcagcacctgcgcctgaactgacaagtccaacgcagagaccggttcgtcagcgataatgagcttcgggttcgttgccatagcacgggcaaccccaattcgctgacgctggccgccggaaaactcatgcggatacttgtacaaagcatcgcttggcataccaacaatatcgagcaattcttggacgcgccgacgttcttcatccccagtaagattctgaaaattgcgaattggttcagcaataatatcctcaattcgctttcgtggattcaaactagataaagagtcctgaaaaatcatttgaacgtctttgttgtactgcatatgtttccgaacgctgcgtttggtaatatcctgcccttgatacataatcgagccggacgtgaccggttccaaacccacgattgctttgcctgcggtggattttcctgaaccggattcgccaattaacccatatgtttcgccttgttcaatatcaaagtcgatcccatcgactgccaaaacatgatccgtcacccgattaaaaaaccccgagcgaatcggataatgaatttttagatttctaacctcaatcattgccataatttactcacctttttcagctgcttgttcgtcatccgggaaatagaagtccttgtagcaggtacactgaacaaagtgatcagggccaacttcgtgcatgatcggatgctcttcatgggctgatgcaggaatccaaggaatccgagccgcaaaccgacaaccttctatctgcatattcttcaatgatggcacaacgccttgaatgacatgtaattcgtcgtcatctgaatctgtctgtggcatggagcgaagtaaactgcgcgtgtatgggtgcgttggatgcttgaaaacatccattaccgaaccactttcaacaatttggcccgcatacataactgccacacgatcggccgtttcagcaacaacaccaagatcatgcgtaattaaaataatgccagaatgcatttcccgttggatgtcttccaacagatccaggatttgggcctgaatcgtcacatccaaagcagttgttggttcgtcagcgatgataatcggtggtttgcaggcaatcgcaatggcaatcacaatccgctgccgcataccgcctgacaattcgtgcggatatgaacgtgccgttcgctcagggttgggaataccaacttggttcagtaattccaagacgcgactttcacgctcttctttgttcatcttagtgtgatagaccagtgtttcttcaatctgctcaccaatccgcatcaatgggttcaaagcagccaatggatcttgaaagatcatgccaatatctttgccacgaattcggtcaaaaagggcctcattcaagccaacaagattaagattgttgtacaaaatatcgccagtgaccttcgtattgcgcggatcatgaaggccgataatactggttgccaaagtacttttaccagaacccgattcgccaacaatagctaagatctcatcttttcgtaacgtgatgctgacatcatcgaccgcatcataatagtcgtctccgagtctgaatcccgtgtgcagatgttgcacatccagcagcaaatcttcaggtttatccaagcgaactcctcctttgcgtcctcgacgcaagattaaaacaagatgagatttttgaaataattgtctctaagtataaagaaattatagcggttatgcaagcgaaaaatgcgttctaaagctgttttgccatgtcaaaagcgaaaatttgatggcatcattttgggccctggtcgccgaaatttagcgaactgtgggcgctcaatgagttcgtagcagcgaatatttcgaaaagaataatcttttgatgtgtcgaacgttgcaacttcttatctgtggccaacatcttcggttcgctgaaagacaaacgccatccccaaggccttatccgtcagcgtctcagggacagtgcccaagtgcgctcatcacgctccagatcaaggtctattacacgatggtttctagccaagcaaactcttaaaaaaagccgtccatctctggtcggctttttgtcacttctgatgggcgttgatgtaatcaacggcatcttgaactgttttgatgttttcggcgtcgtcatcggggatttctgctccgaaggcatcttctaactctaaaacaaattcaacgatgtcaattgaatccgtatcaagatccttttgaaagttaagtgtcgggctgattttatcgggactcagttgaaaatggtcctgaattaggccggcaattttttgataaatttcgtcttcactcatgttgctcctccattcatctgccaatttagtgtacttgtttgccactggaatgtctacgctttctcagcggttttcgcttcggcaacttctggatgggcatcaaaataatcggcaactttcgtaacggtgccattttgaaccattttggcggtttgcagcaaagtataataaacggtctctgcatctgccgcaccatgagccttgattaaaggtgctttgagccccagcaagaccgcgccgccgtatgacgaaatatcaaaggttgaggccatcgacttgagattacccttcaggaacaaaccgcctaatttgccggaaaggcccccttcatagatggctcccttcagcatgtgcatgaccgtacgcacagtgccttcaattgccttgagcgttgcgttaccggtgaaaccgtccgtcaccacaacatcggcaggaccgtttaggatatcactagactcaacgttaccaacaaaattaatccccggagccgcggctaataaatcatgagcctcttgatgcattttgtcgcctttgttggcttcagtgccattgttcagcaaaccaactcgtggattttcaacgttgcgaacatctttagcatagtaactgcccatgatggcatattgtaacagatgatacggacgattttcagcgttggcaccgacgtccagcatcacaaagcctttgccgtcaactgtcggcaaggttggtaacaaaccggggcgttcaatggcacgaatgcggccgataataaacaagcctgccgccaacaaagctccagttgagccgagtgaaaccatcgcgtctgcctcgccttgtttaacggcttgagcggctaagaccatggaagcctgttttttgcggcggatagcacgaacgggttcatcgtcgctgttaattttttccggagtatgaatgattgttaaccgttcatcatgatgaataagcggtttaatttttgcttcatccccgtacaaaagaaatgtcaattctttgttggcatctctagctttttcgaccccggcaatgacaacttctggggcgttgtcgccacccatggcatcaatcgcaattttcattcaattcgttcctttcaagttttaatccaaactaccgagcatctgccggctttccgccaagtaagcggcaagcggctgatggtcagactgcagcaaatgtggatcggttttaaaaatctgggccacaatcttttgcgcagcttctagggttggaaaatcgcccactggatcagcgactttgaactctggtaaaccagattgcttatctccaaaaatatcacctgaaccccgcatttccaaatctttttgggcaagtaagaacccgtcgttggtcttggtcataatttccatgcgggcaattccttgctcatttttgggatcagcgataagcagacactgtgctgccttttgcccacgtccgacacgcccgcgcaactgatgcaattgagaaagtccaaagcgatcagcatcaaaaattgccatgacagtggcattaggtatgtccactccaacttcaacgacggtggtcgaaaccagaaccgcgatcttcccatcgctaaaagcacgcataatctgatctttctcgtccggcttcatctgtccatgcaataacgcaacagggccaagattgccgaccgctttttgcatatcaacaaaaagctgctcggcattttgcaaatcaattttttcggattcggcaatcaaaggggtgatcgcaaacacctgactgcctgactgcacctgctcacgaatgattcgataaacttggtcaatctgatttttgcgcagccacatggtcgcgatcggcttgcggcccgcaggtaattcatcaatcgtggagacatccatttccccataggctgtaatggccagtgttcggggaataggcgtcgctgtcattgacaaaaaatccggcttttgtcctttttcttgaaggatcttgcgctgattaaccccaaatcgatgctgttcatcaataacaaccagaccgagcgcatgaaagtcgacccctttttgaatcaacgcgtgcgtgccgatgatgagattcaggcggccatcacgcaactcacttaggagctcgcgacgctttttggttgacgtcgagccagtcaacaaccctaatttgactggaaaatctttgaataactttgtcaatttggcaaaatgttgctcagctaacacttcagtcggcaccattaaagccgcctgaaaaccagcggtcaccgccgcatacagaacaatggcggcaacaaccgttttaccgctcccaacatcgccttgtagcagtcgattcatatgatttggccgccgcatatcggcacaaatttcgtttaccacgcgtttttgagcattcgtgagcgcaaacggcaatgtcgctattagcgcgcgcaaggcctgattgtcataaggaatcgccaacccgttgctgctgttggcattcagttgttttaacgcctgaacttgcaattggaaaaggaaaaactcccggaaaaccccagtacggcgagccgcctttgcttctgctggcgtatcaggaaaatgcatgccatgaaccaactgagcatcactcattaagcgataatgctcgcgaatgctggcaggtaccaaatcgttgatattttgctgatcgcgttcccaggcagctttgatcaagtcgagtaatgtccccatgcggacatttttgttgacggtgtaaatcgccgccatcgacggttgatcctgcgactgtgtcgcgagaattttcatgccggtcagactacgacgcttggcatcccattttccaaagattgctgcttcatcacccatctgaaaacgatcttttaaccatggttgattaaaaaacgtcaccagaatcacgctacgttcaatttggagcttcacgttaacgcgactacgatgcggcccaaatcgactaataaccggatcggtcacaacgatccccttgaccgtcaatttttcctgatcggctgcctcggcaagatccttcactttcaaatcatcgtagcggtaaggaaaataaaataggagatctctaatggtgtgaataccaaggcttgccagcccagcttcacgtttcggaccaacaccaggtagaacagtaacgggatcagtcaaagccatcaaggcacctcctttttcaaaatatagcaaaccactaatgagtgtgttactgaccatctggcctaatgacgccaatcgcacgcttttatataaatttcgcaaaaaggtgccccgcatgcgggacacctgtacgcgatagctgtttaagcctactcaactgagacgaaataaggataaaccggttgatcaccttgatggatttcaaattccaaatccggatattgcttaccgacagcatcggcaatcgcctttgcttccgtttgattagcatccgcacccacgatgatggtcacaatttcactatcgtcattgatcattttatcaatcatcgcaatccctgctgcttcgcgatccttatcagtcactgtgatcgtaccgtcgataatccccatccagtcgtgatctctgatcgccaatccgttgatcgtcgtatcacggatggctcgggtgattgacccgctgatcacattcggtagttgggcagtcatttcactttgattagtggctagatctgcatcaggactgtaccctagcatcgcggtcattccttggttgatcgtcttacttttgaccactgcaacttcaacgtcagtcgccgcttttgccgctgcttccgcggccatgaagatattgccattgttaggcaagacgatcacgtgcttggcatgcgctgctttaaccgcatccaaaatatcgtttgtgcttggattcatggtctgaccgccattgagcacatgcgtcacgccaaggctcttgaagagttctccgagtccttgaccagccgcaatcgcaacgacacccatttcagctaacggcttttgggccacttgttgatccaatgcgccttcacgttcaataatgctctcctgttgcaagcgcatgttatcaactttgattttcatcaatgaaccaaattgctgaccataacggaaaacagtccccggatgctcagtatgaacgtgcaccttgaccacttcttcatcagaaataaccaaggtcgagtcaccgagtgtattcaaatagttacggaacggttcgtagtcaaaatgtttgaggttttggccatcaccaagttcgaccatcatttcggtacagtagccgtatacgatatcggctggatcaagctgtacttgcgcactttgatgatgcacagcattaatcatttcgttcatttcttcgtcagtgacgtcatgaacatctgaactaattttaccggacaagccttcttggaaaccctcgtaaataaaaacaagtccttgtccaccagaatcaaccacgccgacttctttcaagacggccaaaagatcaggcgttttggctaaggcacgtttagcacctttcacaactgcctgcataacaactaaagcatcatcagagccattagccgcttttaagccagctttagccgcttcacgggcgactgtcaggatcgtgccttcaaccggcttcatgacggctttataggccgtctcgacgccatgtgcaaacgcatcggctaggtcctgagccgtcagacttttcttatgcgccacgctttttgcaaagccacggaaaagttgcgagctaatgacgccagaattgcctcgcgcgcccatcagcaaacctttgccaagatgcttggctaagtcaccaactgactcatcattagactccaacaccgcttttgcgccagtttgaaaagtcaggttcatattagtgccagtatcaccatccggaactggaaaaacgtttaatgaattcacaaaatcagcatttttattgatgcgatgtgcggctacccggatcatatcctggaatttagtcgcggtaatttcggttactgccacggaacatcctcctcgaagaacttcaatatgtcacaccgttaacaaccggtgcgtgtacgtcagtcgcctaataccttgacgccttggacgatgacggtcacttcatcagtcgtgacccccaacatcgtttcgaggttgtattttactttgtcttggacatttcggcaaacttctgaaattttagtgccataactgacgataatgttgacttcgattttcacgccattatctgtctgacgaacgacaacaccgcgcgaataattttcgcgtttcaaaatgtcattgagattatcgcgaatctgattacggctagccatgccgacgataccatagatggacgtcgccgcaccgccaaccaccgtcgcaatgacactgttggaaatgtcgatgattccgtatttggttttgattttgaccgccatgctgtttcctcctaagccattcgcgatgattttcacatcgcgtacaattctaccagctagtttagcatagctaagcgatgactgcgagcagagcgtgaatcagcccgattagaaaccgaagtgtaagcggccttggttgtgatggccggtttttggccattgcatccaaggtccttacacgtaggtttctgggcctgttcacgcgtttccgaacctccaagctcacaaatacctaaattttgatcacttaaacctgaggtgcctatgtgtcagtttctggtcttgtcgctacctttatgagacaatcgttaacagtaacatttttcaaagaatatcggactatttgtacttacccacccaattttcttagagtctgatcacgcgtttattttgacctgtcaagtaattttactttgcaaaaattcttgcattaaccgcgggcctatgataagttagttgagtgaaaaattcgagggtgaccttgaaaaaaaggaggtcatattgtggctaaagatattattactggtcgtcataccacgtttggcaacaagcgttctcacgctttgaattcaagccggcgccaatggaaagccaacctgcacaaggttcgtatccttgtcgatggtaaaccaaagcgggtatgggtttctgcacgtgcccttaaatcaggtaaactgacccgggtttgatcccataacatttaaaaaggtcctgacaatgaatgtgatgcatccttcattgtcaggacctttttttgttgagcgcgagcaggagcgattagaaaccggagcgtaagtggccttgggtgtggtgaccgacttttggccattacgcccaaggtccttacgagtaagtttctgcgactgcgagcgcgttatgacaaaacgcgagcaggagtgcctagaaaccggaacgtacgcggattttaagcggttggcctaatatccctcatacaatcggtgattcgttggacgccaactaatttgggaaaaccttgggctaaaatttccttgccatgccaaacgccgcaatctccggccagttgggactggtacgcactttttcaggatcttgatatgctgacttctcagatcggtagttcattaaagcaaatcaggaagaaaacaatgcctaattatccaatttttgcccgcgccgatcacgactataaataattgccacctgaccagtcgtccaactcacggtgaagggctgcttgccaagaaactcattggaagcccacgcataaggatagcccgctcgccatggttttaatggatatttcgctccgacaatggtcaaatcggcaactggggtgagattgacaactgcaacgtaccgataacctggcagcggtttaatttcatgctcaccggggctgtaataatcaacccaattttgcacatcaaataaatgaaggcgttcaacatctgctaaaaagcgcggttgaagcggtaagaaaagattagacaaaaaatgatctagtcgtccaccagtcccgccaaccaaggtgacatcgccggatgaagatgcctgaagtgccgctttaacagccaactctgtatccgtgtcatctttttcagaaggcacctgttgtagcttctggacatgcccacgaactagccgcaattcttcaagcgttaaggaatcaaagtcgcccactgccagttcaggatgaatccctgcacgtacgagtcgcaatgtgccgcgatcaacgccgatccatacaccgggcaattgttcccaagcggctggcaagcatgcctgtggaccacctgccatgatgttgacgtgcgtcatttaacagcctcacgcaagctattcatcgcgtcaccgacatttttggacccaaaaacatacgaacctgcaacaaaaatatctgtcccggcatcagctgccgccttcacggtttgattgttgataccgccatcgacttcaatgtcaaaatgcagtttccgagctttacgcagctgatataatcgatcaaccttgtccaccatcggcgtcaaaaatttttgaccaccaaaaccgggattaaccgtcataaccagcacttgatcaaccaacgggagaacttcttcaagactgctcaatggtgtgcccggattgatcacaaccccagcgcgaacgcctttctcgatcacatgctgcaaaacgccataaagatgatccgtggcttcttcgtgaaccaaaatcgtatccgccccagcttcagcaaaatctgccacccaagccgctgggtcactgaccatcaagtgaacctccaatggcagactggtaaccggacgtaacgcttggacgaccagcggaccaaaagtcagatttgatacaaaatgaccgtccataacatcaacatgcagtaaatcagcacgggctttttcaactttttcgacatcccgcgcaagatgagcaaaatcagcacttaaaatcgatggggcaattttcataacgatctcctccatatattgcgttcatccggccattaatcagcttgacgtccgcattttgtctaatctaagttacttcttcttgtaaactgggcgcttgccgcttaactcttcacgaaactgtaagtagttatcataacggctttgcatgatatcgccagccgccagtgccgccttaacggcacaatgtggctcgctaacgtgctgacagccgcggaatttgcaattgggtgctaacgccacaaactcaggaaaacggtcacgcaaatcatctaaggtgacgtccagtaaaccaagcgatgaaaaaccaggtgtatcagcaactaagccaccgtgaatcggataaagatcagtggtgcgggtcgtgtgccggccacgatttaacgcatgactaatggccgctgttgccaagtccaatcctggcacaagatgattcaacaaagtagacttaccagcaccggtttgtccagtgaaaatggtcaatttatcggcaaagctcgcttgtacttgcgcgaggattgtcggatcaaagggcttgtcaggtgcaaaaaccggatagcctatttttgtatagccggctaaatcttgacgaatcttcgttaatcgctgaggctttgttaagtcggtcttggtcagataaatctccgcgtgaatatcgtggccctcaagataaaccagaaaacgatccaataggttcttagaaaagtccggctccacggctgaagtgatcaaaacggcttgatcaacgttggcaaccggtgggcgcaccaacgcattatgacgcggtaataccttcagcaaatagccttcatcatccccttctcccggttgaaaagcagcaaagtcgcccaccagcggcgtaattttgtcgttgcgcaaactgccgcgcccgcgagttcggtaagttgtcccattcacagcgatgtcgtaatacccgctgatctgtttaataattcttccagttaagtcttcactcattgagtaatgttatcctcctgcgcaatcacggtaccgtcccggacaatccgatagctgcctgggtatttcgtgctaacttgcaacgtgatggtgatttgatcatcagccgtgatgttaaaggaccgattaatggtactaatgttatgtgtcttatctgcgatgaagacctgaataccgttgggtgcgggcgcagcactactactgctactagtgctgccactgctattgctggcacttgcggtactcgaactggccggtgcttgatagggaattgaaattgttttcgaccaagttttggtctcttcaggatctgggccttgagagaccgaaacattgactgtgtcgcctggtttaacctgtgtcccagcagctggcgtttgactgattaccatgcctgtatcgacggtatcagagtgcgcttgagaaatcacaatcttaagtccgacttcattggcgtaatctcgcaaacttttttcggtataacccgtcaaatcacgaagcgcaaaagtatttggcttgattgcaacggaaacaccaaatgtgatcgtcgttttgtccgcaatgacctttttgcctgctttaatgctttgtgacacgatcttgcctgacggttcgtcattggtgctgacctgtttttctttgacggttacgccgcgtttttgcaagtctgacttcacgtctgtgtaatcttgcccaacataattctctagcgtaaattgcggctgaccgcggcttaaaatcagcttgaccgttgatccttccttaacactcacctgccgtttcggatctgaatcgatcactaaatccttgctaactttcgtggaataagtgtacttgtatgacccaacttttaagcctgcgctggtcaaggcagtttttgcctgggttgtggtcatgccccgtagatcggggacgtccacatcccttttctgattggcaaaaactgcgccgataccaatcatcagcaacatggcgacaagtatcccgatgccaataatccaccaacggcgactttttttcttaggtcgtgctttcgaacttggctgactcgcttgactgtcagcatctcctccttcgtcatgcggcggtttgggaccgttggggatgactggcatgattcgtgtctcatccagatcatctttaggaaccacatactttgcttcatgtgctcgtgccggactcaacgctgacttgaggtcgctagccatggcatccgcactggtatagcgattagccggatttttggctgtagccttaaaaacaacattctccagtgcctgcgggatatgcggatcaaacgcgcgcaccgacggaatttcttcttgaaaatgctttaacgcaatcgtaactgccgaatcaccttcgaaaggtacagaaccagtcagcatttcaaaaagaataatgcctaacgcataaatatcactttgacgggttggcatactgccgcgcgcctgttctggtgatagatagtgcaccgaccccaataatgagttggtcatcgtcatcgaattctccgataacgcgactgcaatcccaaaatcggtgatcttagcattgccatccggatcaatcaaaatattctgcggtttcaaatcacggtgaatgatattgtgatcatgcgccgtctgaacggcagaaaggatctgttccatcatgtcgaccacgcgctgatatggaatggggaaatgctcgacaatgtagtgctttaaatcagagcctttgacatactccatgaccagaaattgctgaccttgactttcaccaacgtcataaatcgacacaatatttggatgaaccagctcactggtcgccatggcttctcgttgaaagcggcgaactgtatcggggtcattttgcaaatcaagccggagaaccttaaccgccacatcgcgatcaagaatcaggtcgcgtgccaaatagacgttggccataccgccttcgcctaatgttttgataagcttgtagcgctcatttaaaatcgtccccggctcaatcattgcggctccctccgatcctgatgaatgatcaaggcactgatgttgtcaggtccgccagcagcatttgctttgaggatcaattcttgagccttgctgccaatcggcatgtcctgacgcaacactgccgcgatatcttcattgtcaaccatgttggtgaggccatcagaacacaacaacaaatagtcgtcatattccatatcgtaaatcgtcacatcagcatcaacatcactgctgacaccaagcgagcgcgtgatcacgttacgctgcggaaagcgtttggcttcctcaggggttagttccccatgtttgaccaactcattgaccaaactatgatcctcagtaatttgaactaaatggccattgcgatagaggtagccacgtgaatcaccaatatttgccaccacgaatcgtgtaccgctgataatcacagccacaactgttgtgcccatcccagaaagatctgtatattgtttcgctttttgcaaaatcacatcattttcctgctgcaactcaaaaatgagccaacggacgatggactcgatctcggcagtatctgttttctcaaaagcataacctaaatgcgatactgccatttcactagcaacatcaccaccacgatggccgcccatgccatccgccaccaaggccaacgtcgcttcggattgatttttaaaaataccgacatagtcttgattatttggtcgccgacgaccaatatcagtgcgataagcgaactccatacatacccctcatttgcgacgaatcaaactggcaatgaaaaatccgtctgtatcataatcatctggaaacagttgcagcgctggtgcgttatgcgccttgtgcaatggcttcaaggttggtactgaaacttgctcgaactcaggatgagccgccaaaaattgtgcaaccacatcttgattctcttctttcaccattgtacatgtactatacgtcaggcggccaccgatttttaaggttggtgccacactatttaagattgctagctgaatttgttgtaaatgcgccggatcttcaggcgtttttgtgtacttgatttccggtttacgtcgaattaaacctaatccggaacaaggggcatccaccaaaattttgtcaaaagaattggcaggaaatgttgtcgcaaccttacgtgcatccagcacctgcgcatggatgcgatccgtcaagcccaggcgtttagcatttttattgatcaaacgcactttgttggcgtgcagatcaagcgccgtcacttgtccgccttgttttggatcaagatactgagcaatgtgggtggttttaccgccaggagctgcacaagcatccaaaacaacatccccaggctggatgtctagacttggggccaccagcatcgaactttcatcttgcatcgtatactcacctttgacaaatgcggatgtccctgctaagtggccactaggtgcaatgaggccaattggggtcaaaggactttccttcaaatcggggaattccggctttaaagaagcaagcaaggcagctggggtgattttcgtcgtgttgacgcgcagtgaagcatgcgctgggacattgatgacattcaaaatggcacgggttttcggttcacccagttgtgccgtcaatttttcaacaagccacaccggcgtactgctttcgattgacaatcgcttcacaggatcagcgattgcggctgggtcaggaaaaccagttcgctgagcatttcgcaaaaccccagtcacaaatttggcgattccttgatgtccaagtttcttggcaatttctgtactatcaaaaaaaaccgcgcgtgctggtactttatcaagatactgcagttgataaacggctgtatcaagcaaacaccgaatccaattgtcgagtttccggcctttgatgaaaggtgccagataaaaatccaacgtcagctgatgctggatcacaccataaacgatgtttgtcagcaagccagcatcacgcggcgtcaacttgtgactattaatcacgtgatccaatgtcagatttgaatagccaccttgcccagtgactcgcgacagggtttcaacagctaataaacgcggattattcggggtcatcagtaatcacctgctgtcctgagaccaattgttggcccggtccattcaaaaagtcggcaattgattgtttagccttgccagccggctgtagttcatccacttggaaagtggtttgttggccggcaaccatcaccaaacgatgcttatcccgttcaacaatactgccagcaggaagcgttgatcctgctgatagcggcgtaatcgcccacaacttcgtccgttgaccatttaaataaacatacccgccgacatcgggacgcaacgcccgaatccattgatcaagggccttggctggcagatgaatattaagatgctcttgctctttggtaatagtcggcgaaaaggtcactttatctggatcttgaggggtccgggtagccgtgccagcaatgatcttcggcaacgtttctagtaacaaatcgcgaccgagcaatgacaatttggcaaaaacggttcccgtatcatcagcacgcgtcaatggcagttttgcctgcgcaaacatatcaccagcatccattttcttcaccatttcgataatcgtgacgccagtttctgaatcgccattcataatgctgtactgaatcggtgcgccaccgcgatattttggcaacagcgaaccgtgcacattcacagcgataattttggctgcttctaaaaattttgttggtaaaaattggccatatgccgccgtgacaatcaagtctggtgccatggcgatggcttgcgccagctctgggctgccactcaatttttccggttgcaaaaccgggatatcatgtttctgcgccgcctgtttaactgggctagccgccagccgctgcttgcggccaactttacgatcgggttgcgtcatcacggcaagaatgtcgtaatgctgggcaatcagtccttcaagaatcgggacagcaaattcgggtgtacctaaaaaaattactgaagtcattttttcctccaaacgatgagttgctggtaggttggtgcctattttgccatggaacaggttaagacgtttaaacaaatgccaacggttctggatcaatcgcgactaaaaagccgtgacgactgctttgctgggtctcttccaaaatatgctgcagggttgccgctaacgccggctcgtgtttatattttagaacgatttggtaaatatagcgatttttcaaacgagcaatcggtcctggtgtcgggccaagcatgatgacctgatcggatagatgctcacgtaattcttttgccaaagaaaagatagccttagccgcctgtgtttcatcaacatggctcacagcgattttcgttgaataaaaatatggtggataattgccgcgatgccgaatggccatctcttgccggaaaaagccttcgtagtcctgccgtttggcgtattgaatggcataatgatctggattgaaggtctgaacgaagacttcaccgggtttgtccgcccgaccagcccggccactcacctgtgtgagcaactgaaaggtcttctcactcgcccgaaaatccggcaggccgagcgctgtgtccgcattaatgacaccaactaaagtcacatcgggaaaatccagtccctttgcgatcatttgcgtacccagtaagatatcggcctgatggtcaccaaacgcatctaagatccgcgcatggccacctttgcgccgagtggtatcaacatccatccgcaagattcgggcatctggcagcaactgctgcaacttcgcctcgaccttttgggtgccagtaccgtaatagcgaattttatcagaaccgcagtttgggcaacgatgtggaatcggttcctcatggccgcaataatgacatttcaaggtgtgtgtgtccatgtgcagcgtcagactaatgtcacagttcggacattttgccacatagccgcaatcgcgacacatcacaaaacttgaataaccgcgccgattcaagagcaacacactttgttcctgtcgctgtagtcgaattctcaaggcgtcaagcagcgggcccgaaaagtcctcttgcgcgccgtgcgcaaaggcttcccgcatatcaacaatatgcactggcggtaatggttgatcgttaatccgatgcggcagccgcagcagtgtataaacgcccttttccgctcgagcgcgcgactccaatgaaggtgttgctgagcccaacacaaccggtgcatggtgaatctgtgcccgttttaacaaaacgtcacgggcgtgatagcgtggcgccgaatcttgtttgtagctggtctcgtgctcttcatccatgatgaaaacgccgatgttttttaacggcgcaaatgctgccgatcgtgcgccgacaacgacctgagcctcgccgcgcgcaattcggcgccattcatcatacttttcgccatcagacaagccagagtgcatcacggcaacatgcgtcccaaaacggccttttacgcgattgaccatttgcggcgtcaacgcaatttccggcacaagcatcaaagctgtctgtcccgcggctaaaacttgtgcaatcacctgcaaatagacttctgttttgccagagccggtgaccccttctaacaaaaatgttttaggatccctttcggcaacggcagcgttaatttgcgtcacaatcgtctgttgttctggcgtgagcggcaacggcttcgtcaacggttgatgctgcagttccggataaggatcgcggtaagtctcgtggccttcaagcttcagccagcctttttcgactgcctgattaatcaccggctttgtcaggccatattgatgttcaacggtcatcaaagcaggatgctgattgttagcagcccattcaccaattaaagttaacagtttaagttgcttggcggcgtttttacgcacgtgttcacgctcggcagccgcttgctccagtgataattgcgggatcaagtaaaagatttttttaacccgagcacgatccttttttaaatatgaaatagcaactttacctgcttgcgccaatttcatcactgcaacttgctgttcagcgttcaagctaccgatcgccagactgtcagccgttccaaaatatttttgttgttcatcagccgtcagcttaaccggttcagcaacttttaccgcatcgattttcaacatagttggcaacattgtctgcatgcacgcaatccaaaaagaatacgttgtttgcgccaaccacttcgatagctttaataattcgtgatccaaaaccggggccggatcaaggacatctaacaatggtttcaattgaccgtcatagtcgctttggtcggagactgacacgaccatgccgctcacttttcgcgcacctttgccaaactggacccagacccgcattcccgcctgcaaagcgccttctaagcgcgcaggtacaagataatcaaacggtcgatctgtttgcatcgtgggcacatccacgatcaccttggcaacaattgccaagcgctcaccccttttgttttgctaacatcgttgcaagttgctcaatcaaagcagcagcgacttttggcttgggcatttccggcaaggtcactggtgcctgttctggccgcaataacgtcacagcattcgtatcagtgttgaatccgtgagtcgcatcaacgtgattggccacaatcatatcagcatttttcttagttaatttaagttgcgcatttttcaaaagatcattggtctcagccgcaaacccaatcaatatctgatgcgtttttttacggccaagtgatgccaaaatgtccggattctgaatcaaattcagcgtcagtccagaagtcgcatcagtcttctttaacttgtgatcactgacggttggcaaccgataatcagcaactgccgctgccatgataaccgcgtctgcttcggtaaattcggcatcaattgtgtctgccatggattgggcactttcgacttgtttgactgtcacaccgggaacaactggtaactgtcgcgttgtgaccagcgtcacttcggcaccagctccggccgcggcattggcaatcgccgtgcccatcttacctgaagagtcgtttgtaaggtagcggacaggatcaagtcgttctttggttccgccggcagaaacgatgatacggcgaccacgtaaccgcgggtcatctaaactttcgatgaataaggcaatccgttctggctcaggcattctcccgataccggcatagccttccgctaacaagccagtttcaggtggaagcacgagataattttgttcagtcatcaaactagcaatattcttttgcgtctgcggattttgccacatctggtcgttcatggccgggaccaacaactttggtgcctgcattgccagcagtgtcgtcgtcacaacattatcagcaaggccgttcgccagtttagccaacgtattggccgttgccggtaccacaacaccaagatccgcccaatgtgccaatgccacatgggcaacatgttcaggatgatcaaattcatgcccgtctgtcaatacagccgccttgctgacgatagccaacgtctccggcgtgacaaatcgttccgcacttttggtcatcgcaacccgtacatcatggcctgctttgattaaggctcggaccagtaatggcactttataagcggcaatcccgccagtgacaaacaaggcaatatgttgcttcttcatgtcgactcctttcgcacttcaagctaggaccattataccaaacacacactaaaaagaggcaggagcacttttaagcgccactgcctcctgtattgccagccgtctttaaacgccattgtcatcagacagccagaacgatcgatcgcttattcctgatccttgcgatccaatttttctgcatcacgctcaagcattttagacttaggatcaatgatgacatcgccagccgcaatttcttcaagcgctttgccaacacttttatcagacttataatctgacaacatcttcaaatcaccagattctaattcatgggcacgttttgccgccaatacggctagcgaataacgggacggcaccttttccaatagtttatcaatcgaaggataaataatcatgagatgaaactcctttttctaatagatgggcatgaaccccgcgctatgcgagccagccacagacaactatcttgccaaatctgcacttgctaacatgcccttgtaacgatcaatgacgcgtggcacccgcaagtgctcgctttcaataatacgttcgatgcgcttaactgctaaatcaactttatcattcaccacggcataatcataattttccatcatggtgatttccgaagctgctttgcgaatccgtttatcaatggtcacatcatcatccgtgccgcgtcctttcaaccggtggcgcaactcgctaagatctggtggtgtcaagaagatgaagacaccgtttggacattttttgcgaacctgcatggcaccgttaacctcgatctccagtagaacatcgcggccggcatccaaagtttcgttcacatattttaacggtgtgccgtagtaattctcaacatatttcgcatactccagcataccacctgtcgcaatttcgtgctcaaactgggctttcgtcctaaagtaataatcgacaccatcaacctcaccaggccgcatttgccgtgtcgtcattgaaattgaatattgaaaatctcgataattaccatccagcattgcttgccgaaccgttcccttaccgacaccactgggcccggacaaaacaattagcattccccgctcgtgcatgtgtgaacctctttcgttaagtattactgaacattttgcactttttcgaggctgatttcaactgcatcaccggtgaaatggtgaaaagtgcgcccgtttgagggcaatctgagcatcacggcgccccaaagcaatcatattagcgatggcttcaggccgaaaattaaacagtccaggcagccgctcactgggtttaagatagagatcgccatgatcagagccaatgcggccaattccttcgccgctaatcgcgatgacataatcagcaccaatttgccgcgcaatgtcaacaggcaagtcattaacaaccccgccatcaacataactcaccccggcccgctcaactggcgaaaaaacgcctggcatggcgcttgaagcaagcaaccactcccgcgcctcaggtgcagtcaacacatccagtcgggtcacatgtgcttgaaaatccgggacactggttgtcactgctaacaccgcccgcgaatcgagtttgggggcttgcagcattcgatctaatactggcacaaaatgacgccgcaaaaagatcggtccattcacttttgcttcggaaaaatgctgccaccattgtggtacttgctcgggcagcatacgggcggttccggcagcattgatggcgccaattgacgacccaatcacaaatgtcggacgtaatcgcggccccaacacggcccacacgccggcttggtatgcgccgtgagcagcaccgccgccaaaaacaactgctattgttgccatcgcttgttccccccaaacggcgtgatccactgatttaaaaaaactagttgcaactttgaacacttgttcgtataatgaaattacaaacaaatgttcggaggcttgatcatggaaaacaaatcatctgcactgcaaaccgttacccgtcatctcgtcgcatcttatcgtgaattcttcgatttggcggcaccaactgcaaaaatgccttcccatcagcttgatcttttccttgatcaggccatgcatcgccagtatcaagtggcgctgttctttgatcaagatcggccaccatttatcggtcgcattactcggccattgggtgagaaacggtatctggtcaaagcataccatagtaacgtctatcggatcatcaccgaagcggaggtatcctacattaaacgatttaaatgatcggtgttggccggttgcgcagtgtcgcgcgctaccatcatgccattcatcgcaggctgctgatcatcgaatccgaatttttgggcttgcatgaatggcatttaattcagatgggattcatcaccaccaactaaaacgacgttaaggtttctttctagctgctatataaagacgcctgattttcctaaatatggaaaatcaggcgtctttcgtttggcatagatcacttattggaaactaaaactgataccgtcaaagcaaagaaatcattgaccagatgtactgtcgtagacaattcagtcacttaacccatgcgtccatgtttgaattcgtctgccattttcaacaattcttccgcatgttcaactgtcagcttagtgattttctccccagctagcattcgcgcaatctcatcaacgcgggcctgatcggttaatttcagaacttgcgtcgtagtgcggccattatgaaccgccttactgatgacatattcatgatcagccatcgccgccacctgaggcaaatgggtgatgcacaacacctgcgaagacttagcaatcaagctaatcttattggcaatcgcctgcgcgactcgaccggaaacgccggtatcgacctcatcaaaaatgatagccgtcacaccttctgttttcgcaaaaatcgtcttcatcgctaacatcaaccgcgacaattcaccgccagaggcaattttagctaacggtttagctgactcaccaggatttgtttgaatataaaattcaacctcatccagtccatcagcccgaaaatcctttgccttagcaaaatgtaccgaaaaaactgttttttccatatacaatgatgctaactgctcgtgaatcgctttcgtcaattgcttagcggcggcatggcggcgttttgacaaagccgttcccagcttctgcaactgattctgggatgccttcaatgtcgtatcaagatcttcaaccgaagtttctgcttgttccatttggttcaattcagtcgcggcccgcttgccataggcgatcacttcatcaagcgattccccatatttgcgctttaactgattaaataaatcaagccgcttttcgacttcatccagccgaccttcgtcaaattcctgatcatccaattccttcgacaagtcattttggacatcttgcaagctgtaataggcgctttgcaaattgtcagcaatggcagcaaaattcggatcaagatcagcaatactttgcatactcgacatggcctgaccgatttgatcaagcgcattcacttcttcatcactcaataaagcatagctctcctgcaatgctgaattaatcttttgaaaattggcaagcctttcacgttctgcagtaagatccgtatcttcatgcggctgcagattggcactttgaatctcacccacctgaaatttcaacatatccaagcgttgtgcccattcctgctcgttcgcctgtttttgcttcacggcgcgcaaagtccgctggtaatcgtgataaacatcggcgtattgttgccgcaatttcagcaagtcatcgccggcaaacgaatccaataaccctagatgcgtttctggatgcatgagctgttggtgttcattttgcccgtgaatatcaaccagcgtttcgccgatcgccttcaaggtcgttgtattgaccagatgcccgttcacacgacaaacattacggccagtgcgaaaaatctcgcgctgcaacagtacggtgtcattttgatctggatccatgaccccatatgcttgcagcttagcctctgttgccggattttcttgcgcatcaaagagaccttctaaactggccttagtggtgccggtacgaataaaatcgactgagccgcggccacctgccaacaagccaactgcatcgataatgatcgacttaccggcacctgtttcacctgtcaaagcggtcataccgggctgaaaactcagcgccagatgatcaatgatggcgaaatcatgaatcgctaactcttgtaacatcgcttcaccccaccattgcttcaagttcagccaacactgccgttgcatattttgcagaccggcagatgatcaaaatagacgcatccccgctgatggtcgcaaaaatacgctgatcatccagttgttcaattaaagtctcaactgctgccgctgtcccaggcaataaggccaaatgaataaaattatccatggcctcaccccacttcatcgcggtgatgagcgttcgccgcaatttatcagtggctggcaattgtttttctgccggcatactgtaacgataatggccttcaccagcaggcactttgatcaactgcatgtccttaatatcacgcgaaatggttgcttgcgtgaccggaatttgcagttcattcaatcgcgcaaccaagtcttcctgacgttcgattggttcatcttgaatcaatcgttgaatggttgcctgtcgttcgcgcttgcgcatgtgctcacctctgtcatagatggctttgttcgatcaaaactagtcaaacaaaagctttaccaatagcatagcgcacgaactagacagataccaagtttttgcataaatattcattatggccgatgtaaatcaccataagcggtagtcaaagtttcttcaatatcgacatcaggcgccattttcccaggcgtttgcgcactattttgcagatgaattaaaaattcaatattaccttcgccgcctttgatcggactgtaatccaatcccaagacatcgtatccagcctcaagtgcgaaatcaacgatcattttcagcacgtctcggtggacctgcggatcgcgaacaatcccgtgcttgccaacattagcaggccccgcctcaaattgcggcttaatgagggcaaccgcatgaccaccgggaatcagaattgcttttaacggcggcaaaataagctttaatgaaataaagctgacatccgtcattgcaaactcaactggaccatcagtgaagtcttccggcttactataccgaaagttaacccgctccattactttgacccgaggatcttcacgcagtttccacgccaattgattatagccaacgtctaacgcataactcatcttggcgccgttttgtaaggcaacgtctgtgaagccgccggtcgaggccccgatatccaaaacggttttgtccttcaagtcaatattgaagactttcaaggctttcgctaacttcaacccaccgcgactgacataaggcatttttttgcctttcacatgcaaaatagcatcgccagcaatttttacgcctggtttgtcgagtcgctgattgttctgatcatagacttcgccagccatcactgatcgctttgcttgctcgcgagattcaaataaaccttgttcaactagcaaaacatcaacgcgttcttttttgatttttgtcatgcttttaacaccgccaaaatctcagccaatggcgccgcgtcaactgtcaattcatttaacgctgtctctgcttttgcaatttctacctgcaaagcttggatagcaccgtccaaccccaataactcgggaaaagtgttcttatgctcaatgacatctttgtcagccgtttttcctagttcagccgttgttttggtcacatcgttaatatcatctttaatttgaaatcctaagccaaaagcggccgaaaaatcagccagtgctgtttggtcagtctccggaatggtcacaaacagcccgcccatcgcgattgcagcttggatcaaggcgccagtcttagcttcatgcatgcgtttcaaagtttcgagatggtattgctcgttttcaccgtccatatcgagcacttggccaccaaccataccattgctgccagcggcttcggccagaatctgcacacatgcggcgcctttttcagggtactggcggcttaaaatagcaaacgcatcggtcagcaaggcatcgccagccaaaatcgctaaggcttcgccaaactgcttatgattggtcggcttcccacgacgcagatcatcgtcgtccattgccggcagatcatcgtgaatcaatgaataagtatgcacatattccaaagcagcagcagccggcagtgcatcagcaatcacaccgtcatacatcgccacgacactcaacaacaacaatggtcgcaggcgcttgccacctgcctctacggaataaaccattgccgctcgcaaatgcgggttagcaacagcagctaattgctcgtccaacgtctgttcaacggctgtgcgccatcctgctaacatagggctcattgctgatcatcctttggcgaaaatggttgcgtcgtcccatcgtcactgaccatttcggtaacggttttttctgcagtttttaatgttttctcaaggtcctgactcaatttaacaccggctttaaattgatccaatgccttttccagcggtacatcgccttgctcaagctgattcacgatgttttccaattgtgcaagtttctcttcaaaagtaggttcagccatgtgttttctcctttgtggtgacgtgtgcgccgacttgtccatcagccacgtgaatatgaatatcttgatctagctcgtagtcacttagacttttcagcatctgaccttgttcgtcggtcacgtaagcaaatccgcggcccaagatttttaacggacttaggtgatcaaggccactcacggcactagcaaatgcctgacgcttagttttcaccaaaccgcgcatcgcttgatccaagcgatgacgatccccagtcacttgccgctgcaaattgaccaatcggataaacagttgccggccatccaattgggaagctgccattgccaaacgatgatcagcctcgcgcaggcgattatgcatactctgttgtagccgttgttgaaattgatcgactcgctgaacgtattgatcataaagtcgatccggttgcgtcaacacaacactttgtgcagaacgctgcactcgaatcgcggcatttttgagccgattatgcatggcattgaccagtcgcacccgatcttcagaaattcgattaagcgcatcaatcaatgtcacaggcgttacaatttccgccgccgcagttggcgttgccgcccgtcgatcggcaataaaatcggtaatggttgtatcggtttcatgccccactgagctgacaaccggcatcggcatgtcgaccaatgcgcgcgcaactttttcctcgttaaaaggccaaagatcttcaattgaaccaccaccgcggccaatgatcacagcatcgaatccacctattgttttaatctggtttaatcgtttcaccagtgaatcggcggcttgatcgccttggacaactgctgggaacagcgttaattgcaaaatcggatagcgccgtgcgaccgtcgtcatgatatcttgaatgacggcaccacttgggctggtcacaactgccacccgtttgggaaagagtggcagtggtcgttggttgcggtcaaatagcccttcagccgccaactttttcttcagttgctcaaaagcttgataaagcgcacccacaccatctggttcgagatgttcgacaattaaacgatattcgccgctaggttcatataaactgacccgcccaacaactaggactttcataccttcctcaaggtcaaattgaaccttgctgaaggcattacgaaacatcagcgcaccgattttggcgtgatcgtctttgagtgagaaatactgattacctacacgtttgcgataattggaaatttcacccgtcagatagactttggcaaggtaagggtccgcatcaaatttgcgtttgagatattgagtgagtgccgtgacgcttaaatattgactggcatcaaccatttgcccgcctcttagccaaggtcactgtctgggccatgagcgaagcaattgtcattggccccacaccacctggtactggcgtgatggcgctggcaatcggcgccaccgcagcttcgtcaacatccccaagcagcttaccgtcagctccacgcgaaataccaacgtcaatgaccactgcacctggtttcaccgcatcggcaccaataaaatgcggcaccccaacagcaaccaccaaaatatcagcttcttttgccagctgtttaagatcacgggttttactatgcgcaattgtgacggtggcatcgtgattgaccattaaaccagccagcggccgaccgacaatgtttgaacggccaatgatcacaacccgtttgcccgcaacatcaatatcataagcatccaacaacgccatgatgccataaggcgtggacgccacaacagttggttcattggcccataaccgtcctacactaaccggactaaacccgtcaacatctttatcaggatcgatagcatcaatcaccgcctgttcatcaagtcctgctggtaacggcaactgaaccaaaatagcatcaatatccggatcatgattcaactcggcaaccttcgccagcaagtccgcctgcgttgtcgcttcaggcatccgaaacattaaagaacgcacgccaatatcttctgcacggcgctgtttattacgtacataaacctcactggccggatttgatcccaccaaaacaactgccaatgtcggcgtcacatcgtgttgtgccaattcagtaatggtttgcttaaggtctgccagtattttctttgaaactgctctgccatctagtcgggttgccaagagcttcactcctcattttatcggcgcttgttgcgcgcaatcgtcacttatcaatatgcgaacatagtacgaccaaagcaagataaatcaaaaccggtcaaagcaaatgcctttgaccggttgacttatgcttgcggcgttgcttggatgaagttcgccaaaatgccattcacaaacttggctgattgatcatcgctgtaacgctttgccaaattgatggcctcattaatcgccgcagcttccggcatcgcttcttcataacgaatttcgtatagacctaatcgcaggatgattaaatccggcttcgtcaagcgactaagggaccagcctttttttaattgcggcgtcaaggcagcatccaaatcagcctgtttactcaaaacaccctcaaccagcgtggttaaataagccggtacctcggtatcttgaggtaaaacttcggcatacaccgcatctttatcagcttccggattggttgccaaggcaaacagcgcctgaaaagcagcctcacggatcgcatgtcgtgattccatcttattcgtcatccttgccgctagcgctttctgcatcgtcagtgtcggtatcatcgtcgttgaacagattatcagggtcaactttttcagctttttctggaatgatgccaacaacgtggacattaacctcgctgagcgtcaaatctgtcatgaacaaaagctgttcccgtaaccgttcctgcatcgtcagtgccactttaggaaccgagacgccatagtctagatacacataaacgtcagcggcaatctgatcatccgtcaccgtcacactgacgcctttgccatgattagcccggccgaaccaggcgttaattgaagcacccagtgagccgcgcatttgataaacaccatctacttgactagccgcgatgcccaagatgacttccaaaacttcaggaacaatctcaatagtcccctgtgcatcggtgcgattcgctaatatgatatttgtttcttcagccatcgtgagaacctcctaagccctagttgttggcgcgtgaaatgtaggtgccatcatcagtattgatcgttaaaacatcgtcaacattgatgaaaaacggtacctgcacgaccaaccctgtttccatcgttgctggtttagaaccaccgctacttgtgttgccacgaatgccaggttctgtttctttaaccactaaatcaacagtctttggcaactcaattccaagcgtttcattaccatgcatgataattttgacattcatattttctttcaaataattcaattgatcgcggatctcgtcgccgggaagcgtcaattggtcataagtatcggtatccatgaagacataattgtccccatcggcatacaagtattgcatgttcttgctgtcaatttgcgccttttcaactttttcagttgagcggaacgttttttcttgaacagcacctgtacgcaggttcttaagggttgaacgcacgaaagcagaacccttacctggcttaacatgctgaaactcgacaattcgccaaaggtcaccgtcgacctcaatcgtcaaaccatttttaaaatcattaacagatatcatgaacttcctccatacattcagtcgtaaactaaacctattctagcaagcactgcgaatgcttgcaacagcagagcgtgagcaggcgcgtttagaaaccggaacataagtggcctcacgcctaattggctgggctttggtcaattaggcttgaggtccttatgtgcaggtttctgcgcctgcgaacgcgtttcagcaaaaattagcgagcttgccaatggtaatccagacgtaagcggccctgaacgtgatgaccgggccttggtcattgcgctcagggtccttacatgcaggtttctgggctgacgaacgcgtttcaatcagagcgtgagcaggcgcgtttagaaaccgcaacataagtggcctcacgcctaaatggtcgggttttggccatttaggcttcaggtccttatgtgtaggtttctgcacctgcgaacgcgttttagccaaaaatcaataagctaaccggtttgactcacaagtcagcttctggcacgtaacttacagcaccaacaactcactaggtgctggttgactcaagctttgactacccgcagcagtcactaataaatcgtcctcaatccgaacgccgccaagatccggtacataaataccaggctcatccgtgacaacattgcccttagcagccggcacgtctagatacggtccccaagcgccgggtccttcatgaattgacaaaccgatgccatggcctgttccgtggccaaagtacttcccataaccagcatcattgattgtgttgtgagctaagtcattgatgactcggccaagaacacctggttttaaagctttttgcactttttgattcgtttgatagacaatttgataaatggtcttcaacctaggatctggttcgcccaccgcaaacgtgcgggttaaatcagacatgtatccgtggtagatacacccccagtcaagcgtgacaatatcgcctttttcaattttcttctctgttgccgcaccatggggcatcgctgagcgcgtcccggaagcgacaatcgtttcaaaagaaacattgctggcgccaagtccgcgcatgaagaaatctaagtcattggcgacatcaatttcacgcatgcctggtttgatcgtagcaatgacatgttgatagcccttttcggcaatagcgatagcttgtgtgattaacgccaattcattggcatccttgatctcgcgttgcgtttcgacaaagtcacgggttggtactaaagttccttgtgtgagcaaatcaaatgcttcataatcggcataatttaagtgaactgcttcaaaaccgattctagtcagttgtaagcgattggccagcttgccaacggccttaaacatgctgtcctgatgcaaaatcatttcggcattatgtacttgctgcttaaactgttcggtaaatcgcgaatcagtcacaaaataagccttttgcggggttacaagcaaggtgctttcttcacctgtaaagccggtcaaataagtcacgttcttcgtatcggtaacaaaaaagccatccagttttttatcctgaattcgcgcctgcaatgctgtcattcgatccatccaaatcgctcctttactgactcatgctttgttttctctgaaaaaaagacgccccgttaccgggacgtctagtctttattcagcagctgctgccggataaactgaaaccttcttcttgtcacggccgaagcgttcaaattttacaacgccgtcagcagtcgcgaacaaggtatcatcgccgccgcgaccaacgttttcgccagggtgaatcttggtaccgcgctgacgatacaagatattgcctgccttaacgaattggccatcggcacgcttgctgcccaaacgccggccagcagaattacgaccgttggatgttgagccgccacctttatggtgagagaagaattgcagattcatctttaacataacgtacacctccgaggattaattttgttcaagttgtttagtagtaatcgtcaaacgatcaggatattggtcttggatgctctgtagttcgagcaataaattttccaacagaatctgactgatgtgtagctgttcgccggtaatggcggttttaattgccatctggagatgcccaccatggacttcatccgcaatgacatcaggttcaaaccctgctaagctttcaatgccgttaacggcaccaatgctcaccgcagaaacagcggcacatacaatatccttaccggttttaccggcatcggcatgacccgtcaacgagaagctgacgatatcaccatgttcatctcgatgaaaaattgccttgatcataactatgctgacctcttaagcgttgatcgcgtcaataacgaccttcgtgtatggttgacggtgacccttcttttgatgagagtgcttcttaggcttgtacttgtaagtaacaacctttttctcgcgcccttgtttttcgaccttgccagttacggtcgcgcctttgacggttggtgtgccaatcttggcgtcaccttcgcctgcaaccatgatgacttcatcaaaagtaacttgtttgccttcgtcagcgtcgagtttttcgacatagatggcttcgccaacctctgccttgtattgcttgccgccggttttgataattgcgtacactgtgtgcacctcctgttttgcctttcggcttttcccctgaagactcgccaagttgggtgcttacgcttaaaaacccaacattgtgcggttgcataggaggggtgccaaatacaacggactaatattaccagagacgacgtcaagttgcaagacaaacaacaagcgcgtagattcgtgcgtttagaaaccggtatgtcacaaaccgtgctgctttttaaacatgccaccttcaagactctcatatgtgtgcttctgggctagcgaacgcgtttcaatcaaaagttgaaagccacggcaccgccttcagtaatcacgttttaatctagaaaccatcaactgtgcctttttcgaaaaagccagacaccagcaatgactgccagcatgtaaaggatgtatatcatcgtaaagatggtcatccaaccaccaagtgcggcattaattaacagtaaactaatgactagaatagcatccacaatccaattgaccggttgagccaattgtgtggtcacaacgatcagcaaagcaccggtcacgagaagaattaaaaggttaagtaatataatgataagctgtcacctccttgaagaattatatacgagccatcttctttcaacaagaaatcgtttaattgagcagaacggcaaaagaaaaaggctcagaaaagatctccgagcctgcccctgccaaggacctttaatataccatagatgcccgcaattattttactgaatttttgaattttggcggccgcattgtagccaacaaccccttacgctatcacttaaaacacgattgctgaaaagaaatggtttgttgtaggaaaagcttccaaatattttgactcgtaagcctttgaaacgacggcacaaaaaaaagccgctgattgttcagttcagcagcctttagttacttcttcaattgttgtaacgctttttcgatcgtgttgccttttccaatgtgtttagcattgcttgagtcaatagcgataaattcttgcgtcttcatgttgagttggattcgatatgacatcgtaatccctccattctttaaaaaatagtttgaatggtctcaggtagcgatgaaggctatactactcactttttgttagtatgtcaagcattaaaaaacacaacgattgctaactgacttgcttttgacgggataaatcaagatagcaacgctcaaaccggctttaactaatctgatttaaaagcaatttagccttggtcatggcctcgtcgtacgtgccatcggtcttggccggtaactttctgatttgatcaagcaattcgcggccttgaatgactaacgcttcaatatcagcatttgtatcactcaaaaaagaaacaattaagtagatgtttaagactttggtggcatcctgatcgcctgcgattacctctgcacctaactttttaatggccgttttcaaatttcggacttttctctgttcttttttacgcttgtgataataaggcaacacaaacggtaagaaattcagataaacccgcaccccactctgaaactggacccatttccatcaataaacaccttcattgtcgtgactcatgtcaacatttcgaactaacaactcgtagatacaaaaaaagcctgatgcattgtcctcctgcttagtcacggatagcccgtcgtcacagcaatgcttcatggcatttgtaagttttatgtaccagccgggattcgaacccgggacaaacggtttagaagaccgttgctctatccaactgagctactggtacaaatcgttattaagtatacgagaagcgcgacaggccgtcaacgggttctatgaggaagatcatccgatacgcaagttagacggatatagttgaaagcagtcaatgagaccgctacactgaatttatcacaattttctcataaaggaagacaatgctgatgaaattaaatcaatttgcccgtttgacacctgacttcaaggtgcaagtagcggagcttaagcagattggcctgcaagccgatcctgatgacgcttttagtcaaagtgcgaccgaccttttcaatgccttttttccagaggcttatactttagccgcaaaggaagataagctcgcccaagtagcagtcaacatggaccaaacactagcagcatggttggcgaaaaaaccatccaaaatgacgcgccgtgacttttataatgtggcgctacaactacttggcttcgaagctttcactgactttgacctgaatgatccctttaaaatgatgactgcaaccaagttaccaagcctcgatcacgatctaacgagcaccgctgatttgctcaaggctgtttatctattgttaaatacgcgaaccaagcatctggttagttatttggatgatctagctaatcgcggttttttaaaggacttccagaaaaaacagaaaaaaccgacccaccttctttttaacggcaaagtccaacaagtttttgatgcgcggcaggcggttcgtgaagttgtttggatcgaatcggatatggataccgatcacgatggccaacgcgacttgctcgaagcgactatttaccgcccgaaagccacagatcaagggcttaaagtgcccgtgttatttactgcaaatccgtattttcatggaaccaacgatgtgactgcagtgacgcacgtgccggaaacgaccttagctgttaaaacacacggagcctcgaaagctgaagttacggcaaatcctgaagagcctgccaacttgcctcatcatccagttaatggcgaggcgacacaggccgaagcttatgccgaagaaaacagtatgtatgcctttaacgattattttctcgcccgtggctttgctgtggtttattcggcaggtgttggcactcgctattccgacggcttccggacaaccggtggcccagaagaaaccgatggtgctgttgctgtcatcgagtggctgaccggtaaacgccgcgcttttacgaaccggacagatggtattaccatcaaagcttggtggtcaaccggtcttgtcgctatgaccggcaaatcctacctggctacattagccatggcggcggccaccactggggttgacggtctcaagacaattgtagccgacgctggcatttccagctggtatgactactaccgtgaaaatggtctcgtagtggcccctggtggtttccagggtgaagatgcggatgttctggctgtggataccttctcccggcaaaagtccggcggcgacctgatcaacatcaaacaagcttgggaaaagcatcttgctacgatcactcacgatcaggatcgaacaactggcgcttacaacacatggtgggatgcgcgcaactaccggaaaaacgctaacaaggtcaaggcagatgtggtgttgatccatggtcttaatgattggaacgtaaaacctacaaacgccatcaagttttgggaggccatcgcagacctgccaattcaaaagaaactggttttgcatcaaggccagcacgtttacgtccacaatgttcgctcattagattttctagatatgatgaatttgtggctcacacatgaattgcttggtgaggcgaatggcgccgaagatgtattaccaaatgttgttgtgcaagataatgttgctgttcagacttggtcggcctatcagaattttgccagcccagcagcagagcatgtgaccaacactcgcaatctaaaaacggatttcgaggcggccacggatcaatttaccgatcacgcaacagcaacttttaatgcccagcatgataccagtgccagtttcgagactgccatcatcacccctaacagtgcttatgccaatagccgcttgtggctcacgcagccgccacttgagcgcgaccaaacactggaaggcattccgcacttagagctgacgctggccattgatgccccaacaggtattctcagtgttcgcctcattgatttaggaatggccaagcgattcggtgaaaccgcggcaacggtggccttaaacggtcttcaacttggttttgattataaaacaacagacattctcgaattcaaaccaacggctaaaccgacaccaagcaagttgatctcgcttggccatatcaacctgcaaaatccaaaaaatgcttacgaagtgcaaaggattacgcccggccaaccgttccatatcagtttggatctccaacccacccactatcatctgccagctggtcgtcaactcgctttggtcattcatggggcagatatggcccaaaccattcgcccgatcaaaacaactcattatcaaattgatttggctaatagcagcatcacgctcccttaccgcatttaacttaataggatgctcaccagttttttcatgcatgatgcatcaaaaaaggagatatcaagcgccgagtcggcctgacatctccttttttcttacttaactgttcaatcaacttgcttcaacggtgacagcaacagcttttgggttgtctggtttagtaaagctccagatattgttgccgttcccattcagaaacctgctgacgataagcggaccattcgaggttctttgagtccatgaaactttgatacaaatgtttacccagggcagccttgaccacatcatcagccgctaatgccttcaaagcattgtgcaaagttgatgggaggtcttgaatatgatttgctttccgttcatcgtcttgcatccgataaatgttgcgatcaacggcttcttccggcttcaatttcttagtcacaccatctaaaccggcttggagaatcccggcgatggctaagtatggattagcggttggatcaactgaccgcagttccagtcgcgtggacaatccacgagattgtggcacacgaatcaacggtgaccggttcttgcctgaccaagcaacataaactggcgcttcaaaaccaggaaccaaacgcttgtaggagttcacagttgggttattaatagcggttaaagcataagcgtgacgcagaaccccggcgagaaaatgcatggcagtttcgctcaactggtcatccgtattggcatcgaagaaagcattgcccttgtcatggaaaagactcatgttgatatgcatcccactaccgttaataccgtggagtggttttggcatgaaggttgcataaagcccatgcttgcgggcaatcgttttaaccacaagtttaaaggtttgaatgttgtcagcagcttctaaggcatcagcatacttgaagtcaatttcatgctggcctggcgcaacttcatggtgagaagcttcgacttcaaagcccattttttcgagttcaaggacgatatcacgccgacagttttcgcctaaatctaatggtgcaaaatcaaagtaggagcccttgtcgttcaactgagtcgtcggattgccattttcatccatcttaaacaggaagaattctggttctggtccaatattaaatgaagtaaaaccagcctccttcatttcgttcacgacccgaatcaagttattccgtggatcaccagcaaaaggactgccatcaggacgatgaacggagcagatcaaacgcgcaatcttaccgtgatcgttttcccaagggaacaataaccatgtgtcgagatccggaaacagtagcatatcactttcttcgatccggacaaagccatcaatcgaggagccatcaaaggtgatcttgttattgaggaccttctccaattgagaaattgggacctcaacgttcttaacgattccgttaatgtcagtgaacatcaggcgcaggaacaaaacattttcatccttaacagtctgacgaatctcatcagcggtaattgtttttcttgccatatacgtgaactcctatctttagtgtgattggcggaaacctatggctggaccgggatcgggactctggttcagtcgactctggtttaacaactcgtctcgcagtacttgccgcacttcggcatcgctgtcttcatgatgtcggggatgcttgagtcgctttacgtcggcaagcgtgaaaccgtctgccatttgactgcgaatctcaagcaattcattaacattattcagcgagtatgtccgatgattaccagcgtttcgtgcaggttgaaccaacccttgcgcttcataataacgaatctggcgcgcggttaaatcagtcaataacatgactgtaccaatcggcagaaccgatcgcgttctcagatcagcgatctcagccataggcatcctcctttacaacaatgtcaggttatcaaaccatataaggcgtgtcaacggcagatgtaagcttttctgacattcaaataaaaagataccctttttttgttttcaaaatgaagatgccatagaccaataattaaaaagacggtcatcatctctggtaaagcgcaaccgtttccaaccgctatgtcgctatcatcccaccaccaatcacatcatcacactgccggctcagactgttggcacgaatagaaggcatcgaagacacagtctttgaagtcactctaaaaattttccgtttaacattatgttaaaatcaactgaatctattttgaaaggaactcgcaggcatgcacttatatatcggctactcagaaaaagtagcagcaaggatactgcccaccaattggcgttgtttaactgcggcaccgttagctgcctttggcgcagcaatcatcgatgcttctgacactgcaacgctcactcagcttgtggccagccaattacccttaccaacttttatcatcggccagataccaatcagtcacactggtcagctgacagtcaccaacatcgatacacttaataccgcaacaatggctcagattactgctgctgcacaagcttatgagcaaaccatggtaccagcattcattcgcgacttactggactatgcgaaggcggacccaaccagctttgcgactcctggccaccacagcggtcactacgacgacttagcaccagcaggttacttacttcatcaggcttacggcccaactttcttcgctagcgataccagcgatgtcgtcacttctttgggcgatatgttaacacatgggggcaccccgctagctgccgaagaagcgaccgcgcagttatatcatgccgatgaaacttattttgtgaccaacggcacgactggatcgaataacattgtggccagtgcattgctcacgccaggcgatttggttttattcgatcggaataaccacaaatctttttataacgcggcacttgtccaaaatgatgcccgcccggtttatttggatacacttcgaacgaaacgtgggttgattggtccgatcgatttacagaatctaacccatgaaagtttgcgacaaatggcggtagcggtggctcccgaaaaggcacatcaatcgcggccatttcgactgacaattcttgaactagaaacctttgatggcattgtgccaaatgtccgtcagttaatcgatctttttgggcctttaaccgactacattgctttcgatgctgcttggggtggttatgagccgtttattccagcaatgacgcccatggatcccctgcaggtatcgcttgcgccgactgaccctggtatcatcgtcacccaaagtgtccacaaacagcaatccgggtttggccaggcatcacagattcataaaaaagatgcccatattaagggacaagcgcgatatgtcggtcacgaacagttcaaccacgcgtacttaaaacatgttacgaccagctacaattatccgctttacgcgtcattagtcgccaacactgccattaatcaaggtgctcgcggacaaaaaatctggcaagatgccattcgagcagcactcggctttcgccgctcgctcaacgattcgcgactcttttctgcttacgaaccgcctgagttgacaactttgcctgctgatcaggccattcagactgctgaggcttggtccatgacgccacaagctgcatggcatcaactcgcaggccttcaacctgatcaagcatttcttgatccaggtaaagtgaccgtgctattacctgacacagccgcatttggcatcagcggttggttagtagatcgttatttacttgaccacggcattattccggaaaaagccgacctaaatagcctgctttttttagtgacgccgggaaccgctcgaacagactggcaacgattgcgccaagtgttagcccagtttgaaaccgattattttgcaaataaaaccgttgctgaaagtttgccaaaattagtcgctgaaactggcgaggcgtatgcacatcaaacattacgcgaactaagtcagaccatgtcggactttttccgagaagcgcacctaactgagcaacaacgtgacttgtttaccaacaccaacgccatccccactgccatgaccccgcaagccgccgatcgttattttgttcgcggtcaaattgacaccatccctctggagcaagccacgggccgtatcgcagtcgacggcgcgctgccctatccgcccggaatctttgtggttgtccctggcgaacgctggcgaccggaagcgatcagttactttcaaacactttttgaaggtatacggcacttccccggctttaccccagaaatccaaggcgttatcgctcgtgcaggtggtcagccatatgttcatgttgtgcatgaacaactttcatagccgtcaaaaaacgcgatcaattagcttgatcgcgtttttttgcttagcctattctagttatcaaagaaagtggactgcgcggctcccatggtcgccaatttaatatgcgcataggttagcccgccttgcaggtataacgtatatggcgggcgcaacgggccatcaccggaaaattcaatcgttgagccagcaacgaatgtgccgcctgccataatgacttgatcctcataaccggccattttttccggaatcggcgtcacaaagctgtcaactggcgagtttgcttgaacagccttagcaaatttcaccatgtcatcggcattgccgaagttgactgtttgaatcaaatcggttcgcggtgcatcccaagcaggtgagacgtccagacccagtttagcaaataaggctgcttcgaaaatggcgcctttaatggcattccctgtggtttgcggcgaaatgaagaagccttgatacatgtcagccaacgcaccgactgtggccccttcagccccgccaagacccggtaccgtgaaccgataactgatgcggtcaatcagatcctttttaccgacaatataaccgccagttttggccatgccaccgcctgcgtttttaaacaacgagccggccatgacatcagcaccgacttccaatggttccttggtttccgagaactcgccataggcattatcgacaaagatccagacattcggcaaaacactgcgaacaaccttgatcatcgcagcgatctgatcgacggtgaaagaatcgcgggttgcataaccgcgagatcgctgaatggcaaccactttggtcttatcgttcaaccgcgctttgacagcatcatcgtctaccgccccgtttggcagcaggtcaacataatcaacaccaatgccatattcttgcggcgcgccaatcccgttgccagctaagcctagtacttcctgcagggtatcgtacggcttaccggtgatgtacacaatatcgtcacctggccgaaccaagcctaataaggcaacgccaattgcatgcgtaccagaaacaaattgcggccgcaccagtgcatcttcgccgcccaaaacatcggcgtagatggcctccaagacatcgcggccttcatcattatgaccataaccggttgatccggttagataactttctgccacatgatggttttgaaaacttgttaaaaccttattctgattctccaagatgcgcgcatcaatttttgccagttgtggcgcgatctgtgcgtcaacttctttaaccattgtctgtaattttggatcaaacttatccatccaactcatgatacttttctcctttaagtgagcgcgaacaggcgcgtttagaaatcggcgcatagatgggcgtcaaccagatttgctcgaaactgaacctagccaatctggttgacggccttcatatccaaattgatacgactgtattcgcgttaacgttgtttaagccactgttgcaccaacgtaacaatggcatttttgtcttccggatgcgcgaccagatcaaaccaatgggtcggcatctgattgcgaaaataggtcagctgccgtttagcaaaatgccgggaatgttgcttaatcagtgcaacacaattcgccaattcagcctgaccgtgaagatatggcactagctctttgtagccgatagcctgcatggcctgtgcatctgctggcacggtttttaatagctgctcaacttcagcgagtaacccggcctgcatcatcgcatccacccgtgcattaattcgatcatacaaaacggttcggtccgtggttaagccaatgaccaaggtcgagaacaacggctctggttgtggctggtcagaaaagcgccgtccggttaattcaccgacttctaaggcacgaatcacccgccgcgtattggccggcgcaatttgttgcgcagcatctgggtcgcgctgtgccaattgctgccacaaccatgattgaccgtttgttgctagcgccacctgccagcgctgccgaatagctgtcggcggcgccttcccgcctaaaggcagatttaagcgcaaactattaagataaaaaccggtaccgcctaccagaatcggtaattgttgccgatcagccaccgtatcaatcatggccgtcgctgcctttttaaacttggcgaccgagtatgcgacggtagggtcagcgatatccaataaatggtgtggcaccccttgcatctcttttggcgtgattttcgccgttccaatgtccatgtggcgataaatctgataggcgtcgccgttaatcacttcaccgtgtagctgctgggctaaataaacgccgaggtcactttttccaacagctgtcggtccgacaatcatgacaatccgtttggctggtttatccatttcattaagctccgatagtatagtataataaaaacagtatcatagatcattaatcaggggggattttcatgaaacataaatttgctcgtggcttttttgttggcacgctaatgacccttggcgcaattgccggtagcgtttttgcctttaagaaaaactatatcgaacctgtggaaactaaggtcgatgaaattaacgataaccggcgtaaagctaaccgtaagcgtttctcagctcatcaaggttaagcaacaccagctgttaatagcggtatgttcataatgagcgccgctatcagcaaaaaagcaatcgacaagttcgattgcttttttcttgcgcttatgtagcggctaatagttagtcgggctcttttttgttttgcctgaccagttatcatagccgccttttagccaactgattttttcgaaaccattcttgcgtaaacgccgagcagcacgcaaggagagcacaccagttttgtcatagagataaaccggcagatcttgacgcatttcacccatccgttcacgcaactgcgtataaggaatatcgcgggcaccgagaatatggcccgctttgaattcgttacgctcgcgtaagtcaataatctgtgctttacgcatggtatgttcaaagtcatccggcgtgatctcgccgccgatagccttaaaccgtgatttttgatagtaactccacaaccagttgaaaccccaataaatcagaaacaatccaacaaaaattaacagataagttaacacgtgtatgactccttcttccgcttacttaagtgcaaggctggcagctccgataacgccagcagtgttacctagcgttgccagacgcagacttgttgtttcccgaacattcgggaacgtattttccttgaaatacttctcaactcgcttcagcaaaaagtcgcctgctgctgaaacgccgccaccaatgacgatgaatttcggattcagcagattgccgacatttgccaatgccaagccaagaaagtagctaacccggtcaacaatcatcaacgcaagtttgtcgccggttttggcaagatcaaaaacaattttgctagaaatctcatcgccatcatctaacgtctgcttcaatttggagtcgccagcgaattcttcagccatatcccgggccacccggacaacgccagtcgcactggctacagtttcgagacaaccgcgtttgccgcaagtacagagataaccattcaccggatcaacagtcacgtgtccgagttcgcctgctgagcctgcaacaccatgcaataagttaccatcggcaataatgccgccgccaacgcctgtgccaagcgttacgaaagttacattggcgtcattttcgccagcgcctttccaacgttcgcccaaggcagccacattggcgtcgttatcaatactaaagggaatcccagtaccagcctcaatatccttcttagcctgctgcaaggttttccaattcaagttgtaagcgccaattaccgtgcctgcttcaatatcaactgaaccaggtgagcccataccgataccgacaaaatcattcggtgtcatgttgtagagtttgagatgttcgttgatcgaatcaatgatatccggcaagatgtgactgccttcatccaaaatattagtatcgatactccagcgctgttgaatctcaccatcagtggttaagatcgcgaatttaaccgttgtgccgcccaaatcgacaccaattaattttttgtcattcatttttgtcattcctccgtttttcggcgggcagtggcagctcatgatttaaaggatgtgcctcttcttgcgcgtgtgcatgccgcagcacgacttttgcattcaggtaaaccttgtcatcaatgagctgcgctttgtgcagccgatctaattcaagtgcagccagttcgatatcccactcacgcttgccaacatgaatgaacgtaccaaacccctttaataattgcagaacatcatagtaagttttcatactagcctgcgttaaatcctaagaaaagcaacgcgcccagtccgaagagcaaggtgacagctgaagcaatccgccgcggtgtccccatgcgaccaagtgccggagcacccaacatgcctgctgcaagaaagccaccaagcaaaccgccaatgtgaccaaaaatatcaatgccgctggaaaacagattaaacagtaagttcaagccaaccaacagtaagaattggcgcgccaactgacgaatcactggattttctttgaagctgtcgccgagcatcaagcaagcaccgagcaaaccgaaaattgctgtgctggcacctgccgcaagtgtgttgggactaaaggcaaaactcgcgacattaccggcaaaacccgaaataaagtacaacagaaagaatcgccaatggccaaatagttgttccgtcatttgtcccaaataatacaatgagaaaccgttaaccagaatgtgcattaagccgatgtggacaaatactggtgtcatcaatcgccaccactgaccatacaaaatcaaaggattcagccgcgcgccgtagaaaaccaacacgctattattggtactgccaccagagaaagtctccaaaaggaagaccaaaatggtaaccgctaaaatagcattggtcacataagctgaattttgcagccgagagcgccagtttgaataattcatagtttcctttctaacccatctgccaagcagacaggaactgcttgccgtatgccgagcctgccgcaccaatccgctaaaaaaacaacaggtccgcctgttgtttttcgcaccgtcagaagcgttggccaaacacttggcggccatgttcttgtagtagtttagcattttttgcacacgctgccaacactatcagccgttaactgtcttctgatgaatcgaataatccttatcttctttgatgttgttcatctgatagaagtcagtaaacatttctttggcaatctgcagttgataaggcgtggtggtttcagccttcagattcgggataatcactgcaatcgcaatctttggatccttcgctggtgcatacccaacgaaactttccgtgatggtttcagtgagcgctgaatctttggactcacgagcaaacccttgagcagtcccggttttcccggcaacgcccggattcaaggtattcagcgaagtcgctgtagtccaaccgtttgtgccatgcacaacctgccacattccttgcttaactaggttaatctgatcttgcgtattgtcgatttttgaagtaacggaaggctgagttgaggttaacaccggaccgctactgccatcgctcagtgtttggctaatactgttcactaagaatggtttcatccgataaccgttgttggcaatggcgctgatatactgcagcatctgaataagtgtgtagttatcatagttcccgtaagacaaatccaacgccgaaccgacaagcaaattgcctgatgaatcatgcgtattgccttctaaccctgcaatctcaccgggcaagtcaatcccggttttgagacctaatccgaattggttaaagtagccgcgcattttgctaaaaatatccgaattcaatttcagataattatttggcgagtatgcatagtggccttctttcatggccagccacatcatgtaaatgttactggaaacttccagcgcagaggctgcatccaatgaactgaaggtaccgaccgggtaaacagatttcttgactggtgtaccaggcaagtaaatcggtgtatcagcttgagtattagaattgacggtaatcacgccgtcttgcaaggcgcctagcaccgtggcacccttaaccgctgacccaacaacaaatgcgcggttgataacgccaagtgcatcatcttcaaccttatgtgtctgaacatcctgatgctgacccgccatggcgaggatacgacccgtatttggatccatcgcaaccgcgtaagcaccgtctgacaagctgcccgcaccagcagatcgaatcgaactgaaggtgtcactcaaagacttttcgactttcttctgataatccgaatcgatcgtcagattcaaattggcgccttgttgccccttgaacttggaaacagattgaataatctggttgttattcccgatttcaacctgcgtttgactcttggaacccttcagaacattttcatatgccttttcaaggtaactggtgccgacccggtcattccgagcatagccatttgccaaatatgcctgtagttggtcagctggcaaccctgacttttcgttggaaacttgtccaatgattgacgtcatagagtcaccgttcggataagatcgctcccagtcagtcccaaggttcaccccaggcatctgcgtcaagcgctcaccgacaaccgcgacttcatgtgccgtcacgtcctgattcttaaggtagacagtcgatagctgagtggcgccattcataattttgtaaaggccggctgcttctttttgagtcgccgtaaaggttggcatgtgttgacgcacgtaagcgacctcatacttgtacaattcgtcagctttgtctgtcggcagatcttgaattttctttggcagtttggaaacaatctgttttgaaactttcgttggtgccaaatagtagtcaatataatcgcgcttggtaagattgtcttcaggcttgtcaataagcttggcaagctgattagcaatgtcatacatctgctgcgatttagccccaacactcttagtgtaagtgatggcattattcgccttattcgtcactagagcacggcccttgctatcaaaaataagcccacgaggcacattgccggtgaccactgttttgttggtgcgatcgacttcagcagccaaccgcgggccatttaaaatctgcaaataagccagctgtgcaactaaggctgccagcaggagaaacgcaatgaaaaataataaatttaagcgaaacggaatttgactcttgttccgtttgggttgcggtgtacgaatgtacttcacctaaaattgctccttcagaatttctatcttataaagtgtagcaaagaaccagtcaaaacgccatgacacgtgtcttatgatatgcttgaaatacggaagacgacacctaaaatgccggaattaatcttattttagaagttggtggacacttgtgcgacaacgttggttgaaaaattatccgctgatcctcagttttcttttaccgggactgctcgtcggcctttattttgcaatccgtggcacctttccatttggatcaagcagtgtgttgacagtggatttgggacagcaatatatcgatttcttcgcttacttgcggcaaaccttgctcggccatcctggccaacttttttatgccttcaataaagcacttggcggtgacatgtacggggtctttgcctactatttgcttagcccattcaactggctagttgtgttgtttccagcagatatgctggatgtcgctgccttcttaatcacggtgttgaaaatcagcaccatcggcttcaccatgggttggtacgctaaacgtcacgccatccacggcatgatgattccggcgtttgggttagcctatgctttgagtggctggctgttggccaacagctttaatttgatgtggctggatgctgcaatgctactgccgctcattattgacagtgttgaaatactattcaaaggcggccgcgttatggcctatattggctggctcgccgcggctctcatcattaatttttataccggctatatgattgccttgtttttaatcctgtatgccatttactggctcattgcccatacctcaacatggcagcatttttggcgatctggactgcggtttatcggcgccagcgggttagctgggatgatcagtgcggttgtgctattgcccacctggtttcaactgtcccagtcaaaaggcacttacaccgtggcgatgatacgttggcgctttgaatatgcgccaacaaggtttttgagtaaaatgctgccaggcagttttaactttgaccaaatgccatccggttatcccaactattacattggtgctttaggatttgtactggttgtcctctttttcctatccaaaagtcatccttggcgccaaaaattggtagcggctggcgtgacaattgtgttaatcctatcgtgcatgctagaaccgcttgacttactgtggcacggctttcagtttccggtttggtatccataccggtttacatttgtattgtgcttctggtttttgattctgggtatcgctgtcctgccgcatttacaaattggcattcctttgcaatggttaggcgttctgctgcttgtgttcggcgctatttacattgatgtcgctgccaacctcaaacacttcagctttctgaccgtgggccacttgctttttggcgcaggctgtctgctgctgacttttgtctggtttagtttggacaatcgccggccagtctggttcggttttgcgatcgtgttaattgacttaagtggcagtttaatcctgacgcttaatcaactagcctatttgaatcacagtgattaccacgattataccgccgccttgattcgcgggacacagaccatccagcaacatgatcccggcttgtttcgagttggaaaaaccaccattcgtacccgtaatgaccccatgacggccaattatctcggcgcagaccaatttaactccatgttagagccggctgtccccaaattcttcggtcagttaggacaacctgaagacgatggttcggtggcctacacaaatggcactttaattacggacagtctactaggtatgaaatattatctgacgccaaccaaacgtgcggcaaaaaaactgccagatgccggtcaacgaccagatctaaagtggtatcggccaatcaaaacgacgcctacttggcaaatcctgcgatcaccttttgcccaaagtctgggctttgtagccgatactgatttgctcaaacaaccactctatagtgaaaccccgcttgccaatcagtccttaatcctgcaatcagccctcggcaagtcgggcaatccttattttacgccaacagcattagaggcaccgcaactcaccggtgtgcgccgagtctcaactggcagcgcacccacttatgctaaggttggtcacggtccccacgatgtcacttatcgatttaagccaataccaggtaaaatctatgtgttaaccctcggcagccagttcgctgaccatttagtgacactcaatcaaaatgggcaaactgtcaccttgccagatagttttaacgataccattacggtcaatgtcaccccccgtaatcctaaagctgaacaagttttgcggtttcgcctgaataaaaaagacgcctggtttgaaaattttgacttatatcaagctgacgccaagcaagttatccacgatcttaaaaaactgcaaacaggatcttggcatgtgatacaacacacggctaccaccgttgaagcgacgatcaacgttttgcacgaccaccaaatgctgcaaaccacgatcccgaccgcccctggttggcacgtgaaaattgacaatcgacctgtcaccgtcaaaaaaagtttaggcattttcatggccgtgccgctaaaacctgggcaacacgtgattaccatgcgttacgtcccgccattattagggtggggtgctgtgataacggtgactggcctatgcttaacggcttgttggtatgtcgttgataagcggcgcttctcgcgacaccttgtttcgcgacggtgagatatccgaagttatttgaccgaccattgcaacccaaaagccagtatccgcacgtctttgatcgtagccaattgattggccgttacaatcaaaaacgcaggtatactggctttttaaatgcgctaattcatgcttgcctacaacactttctcagcatgcctaatgccactatagccgagccataaaagacgcgctgggcattaaagcttgccgaaagcacgcttattcttctttaaattcatacttcggctcatctaagtgcgcatcatagtcgactgtcatggcaagattttcaaagaaccatgcatcggttggatcaacaaaataagtgacgccgtctttttctactgccatgattggctggtcaggatgatcatcacgtgtcatgccaacactaaagccatcatgaacctgagtcttaccatatgccttcccaaaaaaacggataccagcacccttgtctggcaaacttaattcacggtgaaaccaacgacttgcttcatcagtgatcgcgagttgcaaccccatcatctccttgatcattttttacgagtccatgtttaagtgcataaatagctgcctgcgttcggtcctccacatccagtttcgccaaaatgttggacacatgcgtcttaacggtttttagcgtgataaaaagttctgtcgcaatttcttgattcgacttaccttgcgcgatcaattgcaatacctcacgttcacgattcgttaactcatcatactgtggttgcggatgattcatgcgattcatcattttagtcgtgacttgcggctccaaaactcgctcacctttagctgtttgccgaatcgccttggcaatttcctcggctgtggctgtcttgagaatgtaactggccgcccccgcctccatggctggatacaccttggcatcatcaataaaactcgtcaaaataataattcgtgcttgcggccatgccttcagaatctccttggttgccgtgatcccgtctttcaccggcatcacgagatccatcaaaataatatcaggccgatctttaagtgccatatcgacaccctcttgaccgttttcggcctgatcaaccacttccaaatcaggttggacccctatgtaagttgccaaccccaaccgaaccatttcgtgatcatcaacaatcaatactttaatcatgcgcaacatcctttgataatggcaccctgacttcaacactggttccctgtccgaccacgctcaccactttcgcagttccgcccatggctgcggcacgttccttgatatttgcaagcccataattaccattactgctggcttgtttcgcatcaaatccgacaccgtcatcgaccatccgcaacaccaccatatcctgcagctgtttcagataaacttcaaggctcgatgccttggcgtgtcgtaacgtgttacttaaaagttcttgaacaattctaaaaagattatcttcggccgctggattcaatttaatatcatccaactgccacgtgatctcgattgtaatcttggtttgcaattctttcaacaattgaataatcccttgtttcaaagatttgccttcaagattagtcggccgcaaatgcagcagcaatgcgcgcatttccgcctgtgcctcattgatcaccttttggatcgtatccagttgtttgctcagttcagcctgcgcagggtcacgatcagccacactacgcagtgcagataacatcatcatcgcagcaaacaactgttgtgagacagagtcgtgcagttcacgagcaagccgatgccgttcaccggttaaaatggcttcttttgtttcaccggaaaatcgaaccggcgtgttgctataccgttcaatctcacgttgtaagcgtatcattttttgccgcaactcttcaagcaaggctgccggttgcttacccaaagcgccgactgcctgctgcgagcgactaaaaataggtgcctgatattgtccagcatttaattgtgccaatcggctgtccaactgactgtgcatgactcgctgccgccacatgacaataaccgtcgcaccggtactgatcaacaaagcgccgattaccagataaaccaaaactggtgcggacaggacggtggtcaataacacctgcaaaaaatcatgttcggttactttagctagcatgaaaaccaaacaggcctcgaccaaaagcgcccagaccagtaatgccataaaaaagccaaccagcatccgtcttctcatacagccagcacctccaaatcgccgacacccacactcgtaatgatgtgaatgcggcgcggtgcatcatcatagtcctttgaatatgccgtgacactttggctatgcagcatcgaatctttattttcaaaatgcaaggtaccataaaaggcagcgtgttcaaccgcaacaccaacgccaatcggcaccagaattcgcgttttgccaaaacctttgcgaatcatgatcacactatcgcctttaggtagaaacgtatcccctaaatcaataatggtatcgccagctggcacaaccatattaatgtcatcccaatcataggttggcgaaatcgtatgccgatcagtccacgagttaatcgtgcgcttaccggctttttcactgggctcctgagtcactggcgctacatactgtttgcgatcccaagccgaaaaccccatacctggtttcgtaacgaccatgattatgaacacacccgcgatcattagaatgagccaaatggccggattgataaaaattcccaagactaacaaaatcccaccaaaagccacattgaacgagcgcaaccgatgccatcgcgcaccgaggaaaagaaaaaacacgcccactaggatcgttgtcagtgccataggattcgtgatgatctggaaaaacagccacagggttaaagctaactcgatgcctaaaaataattgccagcggcgcacgacgatccctccttgtctactttttagcgtatacattgactcgatgtcgattcatttcaattaattataacgaatttcgttgcctttgacttagggcgtaaggctgaatttgcaacccaagatgtggctcaatcgccttttcacttttttaaagccacaaaaaacgacaaacgtcttctccttgatgaccggaaaagacatttgccgttgattgcttttggcgcaagttgacaaagcgttatgtgctgatcagccttcaactttggtgatcttgatcttcatctcaccaccaggggtactgatcgtgaccttatcgcccactttacggccaatcagaccttgagcgatcgggctttcgttgctaattttaccgttgaaggcgtctgcctcagcagcgccgacgatttcatatgtttcttcatcaccgtcttcttcaaatgtgactttcttaccaagtgatacttcgttcttagcaaccgcttttgaatcaataatttcagcgtaacgaagcattgtttgaatggtcacgatccgattttccaaggtggattgttcatccttagctgcttcatattcagagttctctgaaagatcaccaaaaccgcgagcaaccttgatccggtcgataacttctggacgcttctttgtcttcagttcctccaactcgtcttcgagtttctttttgccttccgctgtcattggatagcttttgtctgccataaaattcttacctcacttcttattttccttagtcactgtattaagaccagccgcatttgtcaatgattactcttgcaaaccgcgttcggccagaatggctttgatcttagtaaccagtaaatcaatggcgacttgattttggccaccttcaggcacaatcaagtcagcgtaacgcttcgatggttcgacaaactgatgatacatcggttttaccgtttttaaatattgattaataatcgaatccagtgaacgcccacgcgataccatgtcccgcttgatgcggcgaatgacccgaatatcatcatcagtatcgacaaacaccttaatatccatcatgtcgcgtaattctgcgtcatcaagaatcagaataccttcaagaataatcacatcttttggcgccagatgaacggttcggtcagagcgattatgaatcgtgtaatcatacaccggttgatcgacagcttgccgatggatcaaccgatttaagtgatcctttaacaatggtgtatcaaatgccagaggatggtcatagttaatcttttttcgttctgaaaacggcatgtcacttttcttgtaataagcatcttgcgctaataaaagcaatgagtgccccgaaaaatgatcaaaaatcgctcgactcacacttgtcttgccgctggcagaaccacctgtcacgccaatcacaatcggttttttctgctgcaccttgaaagccctcctcaaaactcatccttcagcccagaaacaaccgcataaggaccctggtcacaatgaccaaggtccttatgcggccaaagtccaattaggttacttatctgccgctgcattatcgctggcaaacttagctgtattggcatcatgttgttcccgtgttgtcgcgtaaagtacttcaccagttttaaggttagcaacaaagtacaagtagtccttgtcacgtgcatcagggctgagaaccgctgtgatactttgctcacttggcgagtcaaacggtcccggtccatagccggtgtggacgtataagttgtacggtgaatcaacgctagtatccttgttagtcagatgcgttttatgcgtgttcaatgcatacataacagagatatccgattgtagtggcatcctcgcatcaattcggttcaagaagacgccagctattttgcgacgatcatcttgggtgaccccttcacgctcaactaacgatgcaagcgtcatgacttcttgaacggtgtattgctgcttcttaatgctcttgtagtaactctgcatcacactgtctgtcttggcaaccatcgcatccacaaggtccttgactgtttcaccagcgccaacgttataagtcgcagggaaaagatagccttccaatcgatagcgaactccttttgcattggccgctgaactcagcaattgcggatatttcttagccaattgattaaagaaggtttgatctttcatcaatgccagaaatttctttccggtcagatttttgttacttttcgttaacttatccatcgacgtcgcgatttgttcgatcgttgtgccttctttaactagcaattggcccgcagcagtggtggcactgccacccgcgcgcaaggcttgaatcaccgtgctcatattggcgcgttgtgtcaacttgtactggcccgcctgaaagtcggcgatattgtggaatttcacatagtaactaaaaacagtggcgctcttaatgacatgtttggcttccagctgcacggcaatctgtttcgttgacgaacccgctggcaccgtcacactaatcgacgtcttgccatttggatcaaccggctcaagcgctgaacggacatagcggtagcccatcaaaccaacgatcactaggaccgccaatacaattccaataacccaagcaacgatcttgttggctgctttcttttcactagaacgctggcgccgcttgtcttgtcgatctgatgaccgtctatccaaaaatgttgcctcctctaaggttaacacggtcactggcacagaaatctgcacttaaggaccttgtccacaatggccaaagtaccggccaccgtgcccaaggctgcctatgtgacggtttctaaacgtgcctgtgcccgctctacttaactattctgaacaataaatctgaatcagcaaatattatacccaaccagcgacaaaaatgcgactgcatctagcgaatggcagccccgattcctgtctgtaacgccgctttcactttatcaaacgcctgcgtcacttcgtcttcagtcaacgtctgatcgtctcgacgataagttagcgtatacgccaaactcttctgacccgcggcaatgtgatcgcctgcataaacatcaaacaacgtcacatcctgcaagaaggcaccgccgtgttcatggaaaatagccatgacttgatcgttcgttacttgctcgtcaacttgcaaagcaatatcacgggttactgccgggaacttcggtgcgggttgcgcgattttttcctgtcgtggcgcggcaaatagcgcatccaaatctaattcaaaaacaaaggtggctggcaggtgctctgcatgttcaaaggcaggatgcaagcgccccaaaatgccaacaagttgatcgccgacaaaaatgtttgcggcctgaccaggatggagttcagcaacagcttgcgttgcttcaaagcgaatcggatcggccagcgaataatcacccagcaaatgtgtcacaatgcccttagcgtaaaagaaatcaacggctttcgcagattgatgccaatcttttgcgacaacattgccagtgatggcaccacccaaatattcaatttcggttggccgcacctgatcgcctgttttggtaaagatccgaccttgttcataaatcgcaacatcggtttccttccgcgcttgattatacttgatgacatttagcaaaccactaatcatgttcatccgcaaaacagcatgatcggtcgtcatcggtgaatcgactttggttgggagcccaggttgcagcttgaattgctcggcagcctcggcacttgtcaacgcataggtgatgacttgggtcagacccaatccttctaatagatgacgtgtacgtcggatccgtttttgttgcgaggtgtactcgccaatagtcatggttgtcgttggtaacgtacttggcaaattgtcaaacccatagattcgcgcaacttcttccaccaagtccgctttgatatgaatatcccaccggcgcggcggtacagcgacggcaaacaagccatcagattcggtcacatcaaaaccgagttgttcaaaaatctgcgtcacttgttgctgcgttaaatcggtacctaaaacatggttgatatgatcaagcgaaatatcgacgacaacatcttctgcagaaactgaagtcgggctaaccgttccctttgcaacctggccctcgcttaattcagccatccaagcaactgcagcatctaaagcacgattgatatcagccaagttcgtccctttttcaaatcgggaagaggcttcagaccgtaaattgtacttaagggctgttttacggacattgactggattaaaactagcagactcaatcacaacggtagtcgtttctggcgtaatttcagaattcaagccgcccatgacgccagccaaagcaactggtacctgcccattcgtaatcacaatatcttgatcatctaattcatgttcattgccatccagcgtggtcaaaggttcgccatttttagcgcgccgcaccacaatctgctggctgcctaacttggcatagtcaaaagcgtgcagcggttgcccataagccagcataataagattggtcacatcaacaatattattaattggacgaatacctgctaaccacaggcgtttttgcaaccacaaaggactttcttgaaccttcacatgatcaatgacacgcagttgataactcggagcgtctttggcatccttgacctcggcactcaaaaagtcgccgaccggacgatcaccttcagttaatggcttttcttcaaaatggggtttttctgcataagtagcgccaacttcccaggctacgccccgcatgccaagtgcatcagcgcgattaggcgtgatctcaaagtccaaaacggcgtcatgcatgcctaacgcagctaaggcatcactgccgggctctaatggctcgttaaagacatagataccattcaaatatggtttcggcacgacgttttcactaaaaccaatttcctgtaaggcacaaatcatgccaaggctttcttcaccgcgcattttgccttttttaatttttacgttatccgcaatgcgcgcgcctggcagcgccacaatgacagtctgaccggcagcaacatttggcgcaccgcagacaatttggcgcggcgtttcttcaccgacatcaacttgacaaagatgtaaatgatcagagttcggatgtggcgtagcacttaccactttaccgacgacaatctttttcaagccggcgtctggatgcttcacgccatcaacttcaatccctgttcgtgacactttatcggccagttcttctggtgaaaccggcacgtcaactaattcttttaaccattcatatgagacgtccatcttaaccctcctggctgaattgcgttaagaagcgcaagtcgtctgtgtagaaactgcgaatgtcgtcaatcccgtatttcagcatcgcgaaccgatcaggaccaaggccaaaagcaaaaccgccgtaaacgtcagcatcaatgttcgctgcccgtaacacattgggatgcaccatgccggcacctaacacttcaatccaaccggtatatttgcaaaccgggcaacctttaccgccgcaacgaaaacaggaaacatcaacttcaacggatggctccgtaaatggaaaataacttggccgcaagcgaattgtccgatctttaccaaaaacgtgttggcacatggccaacaaggttccctttagatcagccatggttatatgcttgtcaatgacgagtccttccatctggtgaaactgatggctatgagtagcatcgtcgtcatcacgtcgataaaccaccccagggctaatcattttcagcggtcctttggtaaagtcgtgcttttccattgtccgcgcctgcattggacttgtctgcgagcgcatgagtaactcattggtaatgtaaaaagtctcttgcatatcacgagcaggatgatccttagggatgttcatcatctcaaagttatagtgatcttcttcaacttctggaccggtcaaaacttggtaacccatgcccataaaaaagccttcaagatcgtccataatttgcgtgataatatgtggtgtgccagcctcaaccggatcaccaggcaaggtcacatcaacggtctctgatgctaatttcgcattgatcaccgcctgttcgagctgggctttgcgggcttcgatcactgcactgagatcgtcgcgaattttgttggcgaacgcgccgacttttggccgttcttcagcggacaaatctttcatgccgcgcaaaacaccggtaatcgggcccttcttgcccaataattggacgcgaatctgatttaattcatctaacgacttaacctttttaatggtgtcgttgttttgttggaacaattgttcaagtttggtttgaagatccatgttcttcctccttggttgctgacgtgagggttgatacaactttctgatgcatttgaaggcataaaaaaagtccctctcgaaaaagggacgaagcatcgcggtaccacccttgttcatggtcacgaaataaccatgcactcaacaaggtaacggctaggccggagctttctaagtgttgccacttcaaaagtcaactcagaaagtgaagacaaacactttgacgatagacgtcttgcagtcgtatgaacgtcattccctatctcgtcagcctgtttgggctttcgtcatcgtttttacgtctttttagataaactaagcttagcaaattcagcgccaacgtcaagtggtgattcgcgctagttaataaaaaatgtggtgtcatcacgctccctatgacttgtcgtttgctagactccgagtaagctttgaaaggaactagacgatgcagtccctaaccttggccgtgccaaactccgcaatctccggccagacggggctggaacgctgtgacggcgcttcgagcccgcaaagcccgcggtctcgaagtcgcctaacaacatcagcgacaagaccggtcgctgtgttgtttgcacggctgagccccatctggcctacgattgctccgccttagcactgaaattttgaaatcctgtatcaaattgtctatgagaaacgaaagacgaataattttccgcatttggaaaaccattcgtctgcatttgatacttttggattatgctgaatccctacttctcgttagcgtggcattcagcatctgtgacccatgcatcgccccatgcgtgtgcagcggccataactgaattgaggccgcggcctttgtcagttaacgcgtattcaatcaaagctgagtctttgtgggtcaagcgatccacaaggccttcgccttcgagttcctttaagcgttcgaccaagacccgatcggaacaccgcgggattaattgcgcaatgtccttaaaacgggaattgccattgtttaataaaacttccaaaatcagtccgttccatttctttcctaagatctcaaacgtatgttgaaattttggacaaagagcgacctgctggctttgacaatcggctgtactggttactgttgcatccactctactcacctcataattcccattcacttacatttatatagtgctagaataccacaatgtgaaaatattacaagccagtcctcgagaaacgttgaaaaatatggcaaaactttccagaaaaagaaccacggcattcatccgtggttccaatcgtccttcacagccaaatagctgctaaaactttgcgatcctaatttaaagcctttaagtgagtgtggatcggatgccggagcttgtgcatccatggtacaacgacttcatccatggcggcataatcatcgacaagtgaaacaacgaaactttccttatactttggtaagccaaccgttgcgccccacatgtgtttgacgataatgtctttttccatcggtgacaattcagtcagcttttcagcattccgcaaagcaatccgtggatggatgaaggcatgagtccccaagtcaaacttggttttacgccaatcgtagtaaaacaggtcgtgcaacaagcctgcccgggcgatcgcacgaacattcaagtgcagccgtttcccaatcagataactctgataagaaacactgatcgagtgttccaatcggttagaataatgatgttgcgggtgttctgccagtcgctggacttcgggtttggctaaaagatccgccacatacccaacgtactcagcatccgattgccaatcgcgttttttgctcaagacatctgctccttttgtggtttgatgaacacacttatagtataacaggttctaaccagaaaggtcacgtttgtaagggattcttaatccccgactaaatgaaacatcatgactgctgcagcaaccgccacattcaatgattcagctttgccccggatcggaatgtaaaggttcgtatcggtattttgtaacaaaactggatccatgccattgccttcattgcccacaattaaggcaaatcgttcgctcggttgaatgctatgataacttttagctttttcatttaattctgagccataaactgggatgccgccacggtgtaaggctttgataattggcattaatttagcggagacaatgcgcacatggaattgactgccttgcatcgcacgtaatacttttggaccgaacgcatccgctgtcccattaccgaagaccaccgtttgaatcccagctgcatctgcagttcgcaccaaggtcccaacgttacccgggtcctgaatcgcatccaacaataagaactgaccactcaatggctctggcaattgttctgcgcggcgcggcatcacagcaaaaatgccttgcggggtctgagtgtcgcttaaatgctcagaaacggattcagaaatctgtgtgattttgtcataaaatggcttgagcgcacgatcttcaacatacttttcggtcgcataaatatcataaggggtctggccactggcaagtgcttcttggaccaagtgacggccttctaataagtagcggccagcatccttttgatgttttttaaccgtgagtttcttggctgttttgattctgtcattcttaggtgatgaaatatattccatgaagttctccttatttttaaatggtactttgtttgcttgatgccgtttggcgggttttcttcttgcaagacaaaatccaacttaagtctgttgtcgtttctactataagccttatgctacactagtatggactgtggagaaagctaagatgagcaaatgctgcttgacagcatctccaattaagaaaggaagtgtctttttggtcaaacttgctaaacaaatcgtcgtccgcggacgggtgcaaggcgtcggtttccgctgggccacgaagatgatcgccgacaatcttgatattagcggcacgattgagaatcggtctgatggctctgtctttattcaggctgcaggtgaaccgttaaaccttgccaaatttgtggcgaaggttaaggccggtccaaacccatatgcaaacgtgtcgacctacgaagaacagccgcttgaagacgtgccaaacttccgcggttttcaagttaccggttgaatccaaccagtccatacagtatagttaaacccgattacattttgaagggaaaacattcatgcacaagtcgaaaaaatttgtcacacttgggttggtgagcttgctgccgttgattttagcagcatgcgcgcaaaccactaaaaaaggcacaaccatgaagccgccgacggatccgttttttggcactttttataaagtgatcggactgccactgcaacatttgatggagtggatcgccagtctggttggcactgccagcagttatgggatcgccatcatcgtgatcaccctgctagttcgtctgattgtcctgccactgatgctgcggcaacaacgaacgatgacggcttatcaagagaagcagaagatcatccagccacaactaaagatcgttcaagaggctactaagcgcgccaagacacctgaacagcagatggcaatgaacggttacatgcggaaaatatactcagccaatggcacaagcatgattccttccatgggctgcctaccaatgctgattcaactgccaattttctctggtttgtatcaagccatcgcttactccccagaaatttctgaagccactttttttggcattcagttggggcattccaattttattgtcacgattttagcaactctgccatacattgtcgtcagcttgatcatgctgcaaggcgtaccgccagaacaacgtaaagccatgcagacaactgcctttctgaatccgatcatgacatttgtcttttgtatgatgtacaacgccggattaggcctctacttcggtgctggcgggatcattctgattattcaacaagcgatcgtaacctatgttgttacgccgaacatccggaagcgaatggatgctgaaatggaagaaaatccaccggttatcgttgttgacgaacatacttttgataactgggatacggcaactgctggtgccactggtgcagctggtacaacaggtagcagcaaacctgctgatccagacgccattgatcatggcaaattacgtcggcgtaacgccggtaagcaacaacgtccccggaaataatcatcaagtcatgaaatagccctgatcgcaaaattagcgatcagggctatttgtgtacgcgacaggatctgaagccaaaagtatttgatgtccccctgtttgttcgcctcatacagtgtgggttgcttgatgacacgctcatatgaactcaccctgcgcttgaaaacaaaaaacctcagacaaatagctcgtctgaggtataaaacgattaaagattactcttgatatgggtatcagttttgcctgcttctgcgcgcttagtggtttcctgtgcagccagtgcttgggctttagcttccgtgatggttggcaaatcaattcggaaaatggatccatgacctaaagcggagtcaacttcaatttgaccgtgataactctcaactaactgttgcgcgattgataaacctagtccgttgccgcctttttcacgactacgagccttatcaactcgataaaaacgattaaagacgcgtcgacgatccgcttcggcaataccttcaccaaagtcttgcaccgcaacggcgacaccggaaacgctgttttcagccattgatacgtgaatctccttgcgatcagtggaatacttgaccgcattgtccaataaaataatcatgacctgttccaaatgattgcgatacatacgcacaaacgttttctgttccaagtcgtcatctaatgtaaacgtgaattccggatgaatcatccgaaaatcaccaacgacttgttgcacagtctggtgcacatcaacaaccgcatttggaaattggatatccacttgatcagcgcgagtaagatctagcatttcttgaatcagactcttcatgcgagtcacttcctgcaatgaggccgttaaagattccgccaaaacttccggatcatcttttccccagcgatttaaaagctgcaaatgcccttcgagaatcgccacaggggtgcgcaattcgtgggaaacatcctgaacaaactcaccttgctgatcaatgtagcgttgaatccgatccaacataccattaaattccagcactaaatcgccaagctcgtcgttgcgcttcaaggctggtattcgaaccgtactctgcggttcctcattgacaacatcaatagcattcgtaataagcttaatcggcttgagaaagcgcgtcgccaaagcatagccaatgagaatagaaataagaatagccgcaaatgacagtcccataatgagtaacgtaatctcatgcatggtcgcatgaaatgccgtcagtttatccgtaacctgcacatagccgatcaaatccgaactagttgcagaataaatcggtgccgtaccgaccaagccatgaaaatcatcaatattggcttcttgaacttccacgccatgaaccttgcctaatgtaatcggcgtatcgcgcgattgaaaaatatttgtccgatcaggtgaaaaaacagagacgctcacatccgcttgcgctagtttttgaatcacggaatcggagaaaatacgattttgcgattcacttggcactggaatagaggtttgtccactcggcattgcaccttccaatcgcggcacgacctgcgccatcgttaagtcaccactgactggggaaagtcgttggacgacggtgttaagggtgtccgtcacggttcggcgttcctgattcactaaaatctgccgcatcgcgccataaaggatcattgaaaaggtcacaaaggtcacaaaaatcccgacacctactgttaaggcccatttaacctttaacgagatgcggggactttttctagtttgctcaagcgtttgtttcttcggaatcattacgaacgcataacatagccggttccccgaaccgtttgaatataactcggttcacccggtcgatcgattttattacgaatataacggacatagacgtcaacaacattcgtttccacgtcagagttgtaaccccaaacctttgagagcaaaacgtcacgagccaaaacaacattgacattttccataagcgtcagcaataattcgtactcacgtttggttaattcaataatgtcgtcgccgcgccgaacaacgcgattttctttttcaatcactaaatcacgatatttgatggttgtctgcttagcggtgttgttttcgccttcaatactgattcggcgcaacaaagcacgcaagcgcgcgagtaattcttcaatggcaaatggcttcacaatgtagtcatcagcgccatgatccaagccactgacgcgatcaatgacagaatcccgcgcggtcatcataatgatcggtgtattcttcacctgacgaacgcgccggcaaacttcaaggccgtttaattctggcaacatcaagtcaagcaagatggcatcccagtcctctgccaaagccgcttccaacccggttcgaccgttaaaatgcacttcggtctcatagccctcgtgttttaattccagttcgacaaaccgcgctaaatttttttcatcttcaataattaatattttactcatcaatggtctccttatacttattcgtctctgacgcactcacagactgaacccatttgttttttctcataaaaacatatgctacgacagtttagcacagttttctcattttgactatcagccgcgcaacgatggggctcgacaaacacaagaaatctttgttcggagactttctcatttttcaaaactggtaaattctcataaaaagaccaatccttcaaacaataaatatgtttgtgagattggtcttcatttttataaatatgaagttattaagcttcggtataccatgaatagtggtagatgccgtcgcgatcggttcgttcgtaagtgtgcgcaccgaagtaatcacgttgtgcctgcgtgaggttagcaggcaagacggctgaacggtaggaatcgtaataactgatagcggctgagaagcctggaactggtacaccagccttgacagcaacaccaactaagtcgcggacactttcctgataattcttggcgatattcaagaagtagtcatccagcaataagttctgcaaatcgggcttcttattatacgcatcagtgatgttttgcaggaaacgagcgcggatgatgcagccagcgcgccagatcttggccaagtccccatattgcagcttccaatcgtacttctctgaagcaaagcgcaattgttcgaacccttgggcatacgacatgagcttactgaagtacagagccttgcgaatcatttcaatggcttcttttttgtcaacagaaacattggcaaccggcttcggcaataccttgctggcctcaacccgttcttgtttcatggcactgatataacgagcgtagactgattcagtaatgacactctgcggtacccctaattcaagtgctgactgggaggaccacttgcctgtgcctttattgccggcacgatcaaggatcatgtcaacaatcggtttgtcactgccgagatcatccttgcgagtcaaaatgtcagcagtgatgtcaatcaggtaagaatccagttcgcctttgttccattcactgaaaatatcagccatttctttgacatcaaggccaagaagattgcgcattaagttgtagctttcagcgatcagttccatatcgccgtattcaatgccattatgcaccatcttgacatagtggcctgctccgtttggtccgatatacgtgacacaaggtgcgccgtcttcagccttagcggagatggcttccagaattggtgcgaccaggtcataggcttctttttggccacctggcatcaatgaagggccatgcaaagcgcctaactcgccaccggaaacacccatgccgataaagttaatgcctgacttgtcgagctcagcactgcgacgcatggtatcttcaaagaaagtattaccgccatcaatcagcacatcgcctttatctaataacgggagtagttccttaataacagcatctgtaccagcgccagccttaaccatcatgataattcggcgtggtttctcaagtgatgcgacaaaatcttcaattttgtaacttggtaccaactttttatccggatgctcttcaacaaccgcctttgttttgctgccagtgcgattgaagatagcaacggtattgccgcggctttcaatattcagggcaagattcttgcccataactgccatgccgacaacaccaatttgtggtttatccatgaacatggacctcctcattcatttcgtcatttactccttttatgttagcagaaacagcttgggtttaacagtcaacagctagtttagaagcggtcaatttttcttcgcttattttctttgaaaaagaagacgccgcctcaggcaaacagacagaatcagctttgtttcaactattttaaaatgctatccctctgtgtgagctgttatcacggtgaaactgttagcattaattgtcacgatgatgtgatcaatcttgacgtaccaatttttaccctttcgattcatgattgcttcaggattcagaattttctctttgcaaaatgcaatgacgtcccgattagtaagtaaaagattgtgttcaatccggatgcgccctagttttgtagtgtgcaatttgtctaagtttctcagtaactgattatcagaaatcatttttatattcaccgcagcgagctttattttttgagtccgctcccttatcaactgtttttgagtcatgaacccaacaagactttctcataaaaaccgttttcgctactacaaaagaaaatggcatcctcgcaatacaattacgaaggtgccatttgtcaatagatcaaatcgccttaccgtgagcctgaagaccttattgatcacgattgatcgtcatcagggaacattccctttaatttcgtaaagggattgtccgcctgtttttcttttttaacagctttatcaaaatcctcttcagctaaaacttcccagtcatcgcctgagggcatatcaccgcttgcgacttcttctggtgtcaggacctgcattggaatgctcaacaacagatggtcctcaattgctggcaacagatccagttcagcatcttcgagcggcataagaatttcgccgtcctcatattggtcagcatgaccagcgtccgttaaataaatttcgctgaacgtaaaatcttgcggcagtgtgaccggcgtcaaactgcgcgttgacggcacaaccaaattaccctttagattaacactgaccaaaaagtcaccacgatcatagacaatatcgccgcttacctgaatgggactcacgtcaagaacctcgggatcgcgatcctgtaaatccgttttaacatctaacgtggtgctaaaatgcaacggctcctgatcgtgttttattaactcctgaacggtccatttcaacatgtggtttacctcctttaaacgcgttcgtaggcgcagaaacctgcacataagagcctcaagcctcaatggccaaggaccagccattgaggcttgaggccacttatgttccggtttctaaacgcgcctactcacgctctgctcataaacgcgctcactggcgcagaaacctgcgtgtaaggacctcaggcgcaatgatccaagttcggtcatcacacgtgaggccgcttatgctccggttactaagcgcgccagttcgcgctcttcacatcagtggtcgtcggccatagttctgctcaacgccaccaatcgttgtgattaatcgatccgcgcgatgggtcatcgcgaggacgccatccggtgcaagcatatcagcactgacctttgtgagcaagggccagtcaagatcatgcttgacactattgagatactgccgcccagttggcgtgaaccctaaaacatgcaactgcgggtgttgccgtgcctgattaaccgccgtagccgtcatattcaaagtaatggccaacgctagccgtcgcaaccgcgcataggtatagcgtttcgattttacctgcttcaaaaaagcagtcatgtcttgcgcgtcatcaattttttgggtgaagcgatactctaacccttctgccatggttgcgaccagccgcagttcattgagctcggctgtttgcacgcgatatttcaaccacgggaaaaattgtgcccagctatactgttgttgcttagcataaaaatcgacaagctcagtaggcacgatggcttcaaccgattgatcagcacgtaaatactcacgcactgtcgaggcgctggcgatgttggcttgaatgcctacttcatcatgaccaatcccacgacgcgcaaatggtaacaatgtcatcggcctcttcaacgctaaattagccttggcataactcaagcccagcataaaattaggatcagtttggatgatcccagccgcttttgcataaacagcgttgagttgcgtggcgtatgtctgcgtataatcgcgaaatccatcctcagttaacgctgctgtcgccagtttttcagctaaatccgcataagcaacttcaggatgctcagtaccaaaggctaaagtgttgacacccatggcggccaacgcggtcacaccggcttcagcaaactggtcagcggcctgaacggctccggtcaccggcaactcaacgacaatgtctgcaccatgctgcaaagccgcctgcgcccgaacccatttatcaaaaatagccggctccccgcgttgtacatagttaccagacatcacgacaacgacaacatctgcttgcgccagctttcgcgcttgtgccaaggcatatgcatgacccgtatgaaatggattaaattcagcaatcatcccaactgtctgcatggccgcctcctaaactgcaagatcatcatggtcattcattttttcttcgcatggaaaaaccagcgtgtgctgtccgcctgaattggctgacggccaaaatcagctgtcacttcaattttttcaaacccacttgcggttaaggcatcgagatagtcgttaatcggataagttcgttctttatgggtttccgtaagcggtttataggcatccaggccttcatcataaagaaagaacgttaaatcatgctcaacactatgcggcacctcacctacgaaactgtgccataaaaaggcaaaatcatcggtctgataattgtacatataaccaggaaaaatctgatccatttgatatagcgagtgcgcatcgaaaagaaagtccccgcccggcggcaacaaagatgctacctgagtgaagacttgctgaacttcttcaagattcgccatataacaaatggaatcgtcaaaacatgtcacgaccggaaacggtggtaaatcactcaaatcacgcatgtcgccttgaataagagccagttgggcatcggcttcctcagccttttctgccgccagcgacaacatttcgtccgataaatcaaagtcggtcacctgatagccggcttgcgccaacaacacagccaagaaacccgaaccgcctgccaactccaagataggctgaccagctggtgcaacccgcttcgtgacataatcccgccactgcgaatagagtgattgatccatcagtttgtcgtaaacttcggcaaacgtttgataaatcatgcttcaacccactgatctacttcaaccagcggtgcttcctgccataacttttcaaggttgtagaattggcgttcttctggcatgaagacgtgcacgacaacatcgttcatgtcaatcagcatccatttcgatcctttttggccttcaatacgacgaatcgtaacgccggcttcttcttctttatcctcaatttcatcgacaatcgcttgcacttgtcgatctgaagtaccgctcataatgacaaagtagtcagctaataaactgacaccgcgcatatctagcgccacaatgtcttcagcacgcttagaatcacctgctttgacagcaacttccaacatcgtttttgaatcaatcataaattactcctttgttaagaatgcgttataagttaatagtgtctttggaaaaacgagtttgcgcgcaccaatgagataagtcaaggtattctccaattcaattcgactagcttcttccaagttcgtttccgctgccttacgcgcctttgcttcaaccggcaaagatcgcgccggttcgataaaatcaccaacaaaaatgatttcatcaagcttggtcatttccggatcacctgtcgtgtgccgcgcaatggcagtcaatacttgcttatcagtaatgccgacctctgtttgaatgaaatgaacgccgacaacaccatgccaaacgccgcggccatattgcaacaaatccggatcgaaaccatcttcaataatcacgcgtttataggtctcaactggaatctctttaccataatcgtgcagtaaacctgctaagcctgcgcgatcaacgtcttgatcaaaacgcttggccaattcaatggcagtcgcttcgacccgcaaacaatgctcataacgcggttcatcgagccgattgtgcagccgatttaaaatttcctcacgacttaagccatgtgtcagacttgccggatattgatgttcactcacgatataatccctctttttgaatataatcaattactgaatcaggtaccagatacttcaaacttcggccattttcgacccgatcacgcacatcagttgagctgatatcaatcaaaggcgcatccacccacagaattggataacgactagctggcgtatacccacgccgtttaacaccgacaaatgtcaccaatttgacaagttcgtcaatgtgcgaccactttggcagataatccaccatatcggctccaataatgaaataataatcggtgtctggatgtaaccggtgcagctccaacatcgtctcataagtgtagctgacaccgcctcgtcggatttcaatcccttccaatccaaaaagcggattgtccgcgatagctagttgcaccatattcacacgatgccgcgctgaaatggcagttttagtgtcgacatgcggtggttgattatcgggcataaaataaactttttctaatcccaactccgtgccagctgcttcggccatgattaaatgaccgttgtgaatcggattaaaagtcccaccaaataggccaatctgttttcgccgatgctggccaagaatctgctcgcgcatttcaacggagatcacgggctgggtcaatgtgacactctgcgtcttctccatagtgatcctcttagcgtgcgttaacttccaggctaatttttcgatgatctttcttctcagcctgcttatagacaacaaccgtgtgaccaatgatttgggcgatctccacaccttgaatggccgcctgtaaggtatcggctacctcttgcggtgtatcatcggcagccggcagtaaactgattttaactagttcccgcgcttcgagggcatctttcaccccagccacaaacgtgtcacctaaaccgttcttaccaacattgattaacggcttcgtggtcatcgccaaactgcgtaaatatcgtttctgtttccctgttaacatcaataacgctcctctaaccgtgtcggcaggcatagctctttaaacacaactggctgagtgcctcgttgtggtcatggatacttaccgccgtacacgttttacttcgacatgattaattatgatacgaaagatagtttttctaaatgaacgcacgccgtaacaaaacatccacaccttttggcgcatagccggcaaccgtaacaccagcaggcacagtgatccagcctaacccggcgaaaactaagtcggctttttcctttggggtgaattcaaaccgaaccaatggcggaaagtctggcacttcatccgcctgtggtggtgacagtaaaccgcccacatgcttctgatagaaatcatccgcattttctaacttggtgcgatgcagtgtcaactgattatcagtgtaaataacgaaactgttgcgacctccgcgaaggtaatcaaatcgcgctaaaccgccaagaaaaatagtttggccttcattcaattgataggttgctggcttgatgacggaagtcggtgagactaattttaagtctttagggccgacaaagtgtgccatctgatgccgatgaatgatccctggtgtatcaatcaatgattggccatcatccagcgggatcataatgcgatccaacgtcgttcccggaaaacgcgacgtggtaatcaaatcctcaacgccagtcaattcttttataattcgattgatcaaagtagatttaccagtattcgtcacgcctaccacataaacgtctcgatgatcacgatatttttcaatggcatccaacagctcatcaacgccaaaaccttttttagcgctggccagcatcgtgactaccggacgcaacccttgtgcctttgcctgctgctgtaaccaattcttcaatcgattcgggttaagcgacttcggcaacacatcggctttgttcccgacaagaatgactgggttgtcacccacaaaacgatgcagtccagggatgacactgccattgaaatcaaaaatatcgatgacgttgacaatcaacgcattactttcaccgatggcattcaacaagcgtaaaaaatcatcgtccgtcaacgtcaccggcgcaatttcgttgtagtgccgcaaccgaaaacagcgctggcaataaatctcgtcatcaggatcggccttgcttaaagtggcttttggcaagtatcccggctttttgggatcagttgtctgcaaaatagcgccgcagcctatgcaacggcgctctgtttcagtgttcgtggtatccatgaatatcctcctgataatccaaatgccgtttcttagcgagtgctttaaaaacgtaaccttcaaagtaacgattaattctggtgttccacgcatcactttgaacaagtggctgggttaaaacggttcgcacaccagcaagattgcctgcccaaatatcggtcagcaattggtcgccaaccatcaccacttcagatcgcttaagccctaattgtttgcgcgctttcgtgatacccacaggaagcggcttcaaagcacgagcaacatatgccacacccagcttggccattgccttgtggattcgatttgcattgttattcgagacgaccaccactttaatcccgctattgcgcaagtccgtcagccagcgagtcagtgtttcagtgccttcgggatgatcccacgccatcaacgtattatctagatccgtcaagaccgccttaatcccttgttgtttcaagctggcaggtgtcaaactgaaaatattcgttaccagccaagtcggctcaaaaactgccacaaatcttgtcccctctccggttttcatatccttatattatagccgaaaagcgtgccgagcgcgagtcagcttcattgacaggcgtggcgagctccaatcctattgatccaaaggtgtacgcctttgtccgggatggttccgcgagctctctgcttgccattaaaattaaagaagctagttaagctactctgttttcttccaacagcaaaatccttcagcaattataaaaattgctatttttccaaacaagcgtcaagcttgaatgaaaccgttatctttttaaagacgaaatcatcgccttatatgtcaaaacaaggtacgattaggttgatagcagcgactcgcattcagcgaataagactgttatgcttatttttagtaagtgtatcaaggaggaggcaatgtcatgacccgtttgcatcatgtgtcgctgttgaccggtgatgcaccagcgacaattcagttttatacaaaggttttaggtttacgtctggtcaaaaataccgtcaatcaggagaacgttcatgttcgacatctgtttttcggtgattaccaaggaactcctggcagtgtggttaccttttttgcgattgatcgattggggcatcgctacgatgcgcaaaatcaattgggtgggattgatcttgccattccaactgggtcattggcattttgggaacagcgtctgcggatggcaggttgtgtggtgacagccacgctgaccagtttaactttggttgatccggctgatacgccggtcagactgttggtgaccgatcaaacgttaccaacgcaacttgtcgtgccaaacgatgttccgggcgaaaaccagattaccggattaattaatgtcgatctcccagtggccgatcatgaagctgaaaagaccttctttcaaaccatgctgggtgtgacccccgaaaataatcaattcaagcttgaggccggtaacaccttgacccttaagcctagcctcactgatagcatcaaacgatttggccgcggaagcatggatcattttgcgttaaccgttgaccatgaagaagcactgccgcgactggggacaattgccgcacaacatggctatgaagttgaggagtttgctgatcgcggctggtttaagagcctatatgttcgcgatcctgccgataatcggattgaatttgccactaaggaacccggctttgcgttagatgagccgcttgcccacctcggcgaaggtctcggactgccgccgaagttcgaggcacaacgtcaagccattgaaacgtattttaaaaccaaaggagtggatttccatgattgaacacacattattaggtatgaaccacgtcacagccatggccagcgatcctcaagcgatttttgacttcatgagcaaaacgctgggattgcatcttattaagaagacagttaaccaagatgcgttggatacgtaccatttttatttcactgatgatcaaggtactgccggaactgacatgacattcttcaccttccctaaccagcctaaaggtaaaaaaggcacgaacatgatctcccgcgcaagttttcgtgtgcctagtgatgcagcgttagattattggctcaagcgatttgctgaaaaaggggttgctaatgaaggtattagcaatcaattcggtaccaagattattaacttccatgatcaagatgatcaacagtatcagcttgtatccgatgaaaacgatcatggggttgccggtgggacgccatggaaacacaatgacgtacctgaggaattcgcgattactggccttggaccagtgaccgttaccattttcaacttaggtcatatgcaatatgtactgaccgagattatgggttataagcaaattgctgaagatggcaactggtcactttacgaggttggcgaaggcggtcatggcgcccaagtgattcttgagcatcgagaagatctgccgattgccgaggagggctttggcaacattcaccacgcggctttctcgactgagaatcgagaaaccttaggtacgtggattgatcgcatcaagcagtatcgtttgccgcaatcaggttacgttgaccgcttctacttcaaatccgagtatttccgcgcggcaccgcaaattttgtttgaacttgcaaccaccggcccaggcttcttacaggatgaaacttatgatgaagccggcattcacttagagttgccaccattcttggaaagcaaacgcgaagaaattgaaaagcaattaaccccagtcaaaaccgactggcgcggacgttaatgattggaggttgcgatggcagaagatgaagtaaactacgcatttgttaaaggtgatccaactgtctcaccattactattactgcatggccaaggcggcgatgaaaatgacttactgccaattggcaagtacctctcgccaaatagtcccatgttgtcgattcgcggtcgcgtgcaagaacaaggcatgaaccgctacttcaagcacacggaaaatggcggctttgatttaaacgatcttgaacaggagaccacttggctattttcagtgttaaatgacctttgccggaaatttgacatcgactatgagcgatttatcgtgatcggctattctaacggcgctaacgttgctgcacgggcgctattgacgcgaagtgatacattccacacaggcattttctttcacccgatggcactttcgacagtcgattcaaaacaagatcttagcgatgtcaaagtctggatgtcacatggcgatcaagatccgattgtgccagcacaaaacttcaaagtgctcgatacgtaccttgaagagcaaggtgccgatgtcacgattttccgtcatgggcaaagtcacaatttgaatgaagaagaattgacaaacgccaaaagctggctggcaaagagtggtcggttagctgattggcgacggaggtgaaagactatgcaacgttttggttttgaacagtatggtgatccgagcgtttttgaaaccattgaggcgccgattcccgaaccaaaaactggtcaagtacaattgcaggttcttggctttggcttgaatccctacgatgcttcactgcgtcgtggtgaacaagcggcttttcgaaaagttaagttcccagttgtccccggcacagatgttcttgggcgaattaccaaactcggcgaaggggtgactgactttgctattggtgatcttgtcttgaattatcgaccaattggcggttacagcgagtatgtcaccgcctcaacttcaaaaatttacaaaaagccgactgccttaagctttttggacgctgctgcactaccgcaagttggcttagctgcttttaacattttgcactatatgctgtcacttaagcctggccaaactttggcagtcattggcgcaagcggcggtgttggtgctatcttggtgcagctcgccaagtttgaaaaattaaatgtcattgccgttgcaggtgcccaacaccacgactatttgcaacaactcggggccgatcagatttacagccatacagatgatttacctgacagccgtgctgatgctgtggtcaacgccgtttttggcgctgcagaccacggtgcctcgctaaagcttgtcaaagctggcggtcaatatgtgacgaccgcttatgctgacgttgatgttagcagcaagcccggcacaacccacctgcaattgaacccatcgaaggactattctgttcatgatggctttgcctatttagttgatgtcgcccaaaaatggggtctgcaagttcgtgtagcgcaatcatttgcttttaccgtggatggcatcattgctgcgcatgaaatgttggaaacacaccacgccccgggcaagttgattgtgatgcaagatcgtcatgtcacccatccggttcgtaaagacatcaatcaactttaaacaaaaattgggttaacgccttgtcccgcttgttttcacgccgtatgataaacgggtgaacgaaaggcgggacaacatgaaaattgcagtttattgtggcgccaatagtggcgcggatccagcatttctacaggcagcaagcaaagttggcgcatggattgcggcacgtggcgatacgctgatttatggcggcggtaaactcggactaatgggcgcagttgcgcaaagtgcccttgaccatggcggtgacgtcatcggcatcatgccgcaagtgctcgctgatcgcggcttagccatgccagccttgacgcatttagaagtcgttgctgacatgggaacgcgaaaagccaaaatgatcgagatggcagatgccgaccttgcccttcccggcggtcctggcactttggaagaaatcaccgaagcaatttccttctcccgaattggccttaacgcaagcccaacgatcctgtttgatcaaaatgggtattaccaacctttgaaacagatgtatcaaaccgcagttgaccaaggtttctttgatcaggatgcgttcgataacgtgatattctcggatgatctaaccgccatcagtacgttcattgccaactatcaaccgttgggggttcggcaatatcattaaacaggttgagatattattctcagtcggtcaacaaaaaggaacgatttttcactatggaaaaattgttcctttttgcctgctcatggattatttacttaaaaaaccgtagtgccaaggcggagcaatcgtaggccagatggggctcagccgtggaaacaacacagcgaccgggctttgtcgctgatgttgttaggcgacttcgagaccggtttttgggctcgaagcgccgtcacagcgttccagccccatctggccggagattgcggagtttggcacggcaagaaagttttagcctagcaactttctacgattattcggaatttaatgaatcacaagtcttgcaaggaaattatggctcagcctctttttttaaatgtgaccccatgtttttcacttatatacgcaaaaagagcatgtcagctcgtcaaggcgagttgtgacatgctcttttaaattggcattaagccaaagcttttttagctgtgtcagccacagccttgaagccatctggatcgctaacagcaaggtcagcgagcattttacggttcatgtcgacatttgcaaccttcaagccatgcattagcttgctgtaggaaatatcgttcatgcgtgccgcggcgttgatccgtgcaatccaaagacgacggaaatcacgcttcttagcgcgacgatcgcggaaagcataacggtatgacaccatgacttgggcattagctgccttaaacagcaaatgcttggcaccacgatagcccttagcgagcttcagtaccttcttacgacgcttacgagtaactgttccacctttaacacgtggcattagaattcctcctcaaatcaaatccgatagattattatttcatctggctgagcatctggcggatccgcttcatatctgagtgggataccaatgctgacttacgcaattgacggcgttgtttcttggtcttgccgtggaaacggtgagacgtataagcatgaccgcgcttcagtgcacctgatgcggttttcttaaaacgctttgcggaagcacggtgggtcttgaattttggcatgactttttcctcctgtaaacatcagcgtgttgctggtgaagttcaccagcttgcgctttttatacgatcttgccgaaaactacttctcggcacgcggtgcaagcatcaagaacatgctgcggccgtccatcttaggatgcgtttcaacagcagcaatttccttaacggcatccgccatctgctcaaggactttgcgaccaaggtccttatgcgtgattgcccgaccacggaaccgaacgctgactttaaccttgtcacctttttcaaggaacttggtggcgttcttgagtcgagtattgaaatctgcttcaccgatggttgggcttaggcggatctccttgatggtgacagtcttttgtttcttccgagcatcgcgctctttcttttgaagctcaaaccggaatttcccgtaatccataatacgggcaaccggtggcttggcattaggcgatactaggacaacatctaaatttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtatgaatttcagagaaaaaacaaaagcagcgtggccacaaagaccccgctgttcattaaataccgaactaatgagcctagcggtccaaggacttaggcgagaagcgggaacttctgctttttctcaacggatataactatacaggaacattcaggcgacgtcaagtttcagcttttagcgattttaccgctgataaaatggcgcaaactcaccgctcacatagcgtcctaattcattgtcattaggacttacgtggaattgggtcgtttctggtaaataagcttctgcaaaagcaacaacggcgtgtaggtctgttcctttatctgcatctacgaccagcaacaggctttgggtatcatcagcgcggatcatggtggtcaaataggctgcatgaacagttctcagcttcgccaagtagtcgcgcaagtgcttaactaatgtggcggtttcacgcggcggttcaccgatccgcacagcctcaccatttttagcactatcaggtttagccacgtaaaacaagttggcgcgtgatagcagcatattttcgccgtatggattgatggcgacaccttgtatatcgtgatcttcgtataaaaagttggcacagtcattgatggtggcaacagcgtattgatcatgatctgggcttttaccgaaattagcctggtcggtaaaaattggtaagaagtcctgtccttgatcatccgtaatcatgacgattgtcggatcaccatctctcgttgtcccaacaggcaatatgaatttagcagtctttaaagcagcgtaaaaagcggcttgggtctcctcattctgatcagcccgtaataactgaatcaaatgaataagttgtggattttgaacaattggttcatcagtcatcatcgttttcccctttatctcgtttctgatcggcactcactttgccacgaaacctgcgtaatttttttggtaggccaaccagccatgagagtaacacaatgccaacactgccgaaaacagccacaccttgaggttgaaattcaattttagcaaaccaccaagttgcgatgccataagcaccaacaacagttagcaacatcacaatgcccatgatcactaacaggccacggccgcgatgggcaattaaccagtaaccgcgctgattcggggtccgccatggcagcttcatgtaagcgaacaaaaccaccaaatacaaaacggcagcgaggatctttgtgaccacgaataagacgagccatgaagcccataatgcgataaacaccgagtcatcctttcttttgacgtgtgtcgtaaatgtgtccagtttatcatacatgctgaaaacaaatggcggatgtgctaaatttggcgagaacaaacctgttcctaaagatactaacaacaaaattatgaatgaatggagaaatcaccatggcaacaattgacttagtgaggcatgctgaaccagacatcacgattcatgatgattttttgcggccactgaccagcgctggtcagcggcaaactcagcagttggttgacagtttgcatcaatatccgtacacggcctttttttcaagcccactcaaacgtgctgttgatacgatcacaccgattgcagatgatcacggcttacccgttcaaaaaaacgaactattggtggagcgaaaaatgcctgcatggctgccaaatttttctgactatgttaatcagcagtggcaagatttaacattctttgaaaaacctggtgaatctattcatcaagttcaagaacgttacctttcatttttatatggactgccaagttcggcattcgtcgctgtcggtagtcatggcacggcgataagcagtcttgtcgaagcggccatccccggtatcggctatcattttttctcgaaacttggttacgccgctgtcacccgtatcgaaatgcatgcaggcaatatggttcacctagctgtctgggaaccaaaatcaaagacatttaaagttctaaaatagtgtttccaaacctcaaaataatccaaaactgatggcgcttttcgggattttgatcaaaagaaaaaggagctttgagaacaatgtctcaaaagttccttccccatttgattgaaaatgacactaatcacctaaaaccttggtcgcttcgcctggcttggttttgccgtcacggctgtaattcttcacttcagcgactaaagcatcgatgaacatgttgcctgcttcttcttcggtgtgttcatccccatagcggcgaaccgaaaccgcagcatcattcaattccttatcgccgacaacaacggtgtatggaatcttcttggtttgcgcttcacgaatcttgtagcccatcttttcgttccgatcgtcaactttaacgcggagaccggcgactaacatttgtttcttaatgcgattgacgtaatccagatgcagatcattgttgactggaatcaaaacagcttgtgtcggtgctagccaagttgggaaggcacccttgtagatttccgtcagataggcaatgaaccgttccatcgtgccgacaatcccgcggtgaatcatgactggccgatgctcttcaccgtctttaccgacgtaggttagattaaaccgttccggaagcataaagtccagttgaatggttgacatggtttcgtcattgccaagtgcggtcttcgtttggatatccaactttggaccatagaaggcagcttcaccttcggcttcgtaataatccagtttcaagtcgtccatggcaccttttaacatgctttggctacgggtccacatttcgtcatcatcgaagtatttttcggtgttcttagggtcacgatatgaaagccggaaactgtaatcggtgatattgaagtcttcgtagacatccatgatcaagcgcagaatctttttgaattcttcttgaacttggtctaaagcaacaaaagtatgaccatcgttcagcgtcatttcacggacacgttgcaggccggacagggcacctgacttttcataacggtgcatcatgccgagttctgcgatccgcaacggtaattcacgataagagcgaatgtgatggttataaatctgaatatggcttgggcagttcattggccgcaattccaacatttcgccgtcacccatgtccattggcgggaacatgtcttcgcgatagtgatcccaatgaccagacgtcttatagagatccaagttagctaaaacaggtgtgtagacgtgttcatacccatcagcaatttccttgtcaatgatatagcgttcgataacacgacgaatcgtggcaccatttggcatccagtacggcaagcctgcaccaaccttaggatcaacgaagaatagatccaaatcacggccgatcacccgatggtcatgttcagcagcttcttggcgtcgtttggcatcattttccagacccttttcgctccaatatgccgtgccgtagatccgttgcagcatcgggttgctgctcttgccttgccagtaagcaccagccactgacagcagcttcagatgcttcaagtccttgagacttgggagcaacactttttcttcaaaatcaacgaagtcgcctaacttatagcctttgatcggatcgccagcagcttcaaccaactgcttcttgaatggatcatttttgaaggcttggaaagcttcggcgcgactcaacacaactggttcaagtgccgcgttttccttgataatcgcttccattttcttttgaacggttggcaaatcatcaacactcacctgaccgtcagcacgatcggtatcgtagtaaaaaccgtcttccgttgcttgaccctgaccaaaatgaatatccgggtataagtctttcaaagcagcggccagcacaaacgctgctgtttgccgcaaaacggtcaaaccttctgcatcatccttggtcataatttgcaattgaccagaatgcgcaatcggttcgtcataagcgatcaaatcgccatctaacttgccagcgacagccttctttgccaagctattactaataccctcggtgattgccttaactgtggtgccatcaggaaactgtttgacgttaccatcaggaaatgtaatatctaatgccatgagtaagactcctttattgttttttcgaagaaaccaaaaaatccctgacatctcttaagagatatcagggacgatcagtgatcgcggttccacccagtttgccaacagcaccggctgttggccacttaattgacgcgtaacctgcgtaacagggccttgcggcaatctcgagaagtggttcggatcagatcttgcaagactttcagccatggtctcgctctctattggatgatcctttgttgcttccgtcttcgatagcttcattgaaacacattgcgcagtcaggtgcaagaggttttctgaaaaagagcgctctctggcgcgtttaggaaccggaacataaggacctcaagcctcaatggcggggctttggccatttaggcttgaggtccttatgtgcagatttctgcgccagagagcgcgtttcagccacagcgtgaactagctccgtccgcacggctacaattaattctggaaataacatcatccgccaacggtttacaactgaatagcgctactttgagcgtcaatctgccaatggattgcgccgattttcaccgccgacctgcacttctttagctaaaaaatgaatccgttccatgatgcgcttggctttgagcatctctgaatttccgcgatctgtgccggcaagtgaggcagttaaatcttccatgcttttattcgagctaaacaaggtcggcattttttcctgcatgcgatactgcaaaatgatgccaagaacatcgtcgcgaacccatgggctaatgctttcagcaccgatatcatcaagaatcagaacttgcgcgcgtttgatgcgatcaatctttggcaagacggtgttgttcccgatggcatttttcatttcaaccacaaatgttgggacatgaatcaaggtactggcaatcccgcctttttcggcaagatcattggcgatcgcgccaagcaaatatgttttgccgactccaaatggaccactcaaatatagtccttgatgaaaagccttaggatcggcaacaacggcgagaacgaattgattagccgccaacaaagcatccatccgctcatcagtcggatcgtaattggttaagcttgccccacgaatgtccttgggcatgttaaccgatgtgactaaggaagcctgtttagcctcctcatcggccgcaattttggcatctgttggttcataagcgacgtcaatcaaaccgttagctgccactagggtcggcttataacccggtgccaatggtaattcgccacgagcaattttgtttcgttcgctgacaaattcgtagatcttcgcggttccgcgatcaatcgcatcatcggcgagttcgccggtatgttgttttagaaaagcctgaacttcagggtcctgcaaggcttctttgaccatcttgaaataacgatcccgccactgtcgagaatccatcaacatggcaattcgtttccgcatatcttccatcagttcgcgcctcctttatcaccgagttcacgcagtttcgccaattgggctgctagtttctcgcggtcagcatcgctcacctttttcttttcaggctggtaaccttcttgtgcccaatctggcaacttctcctgccgcggacctttggcgctaccttgacgccgtttttggccactggccttctgtttttcaaagtcacttatctgtttcaaagcagcctcgggactgttcacattagctttcagccaactgttagcaattgcatcaagaaatgcctgattaatactgtcattggttcgtaaaatataatcaatcaaaatattgatcgtcggcgcatcgaacacattccgctcactcagctgctgaacggcacgtaactcgttgttagccgggtacattcggacattttttgcctgcttggcggcggttaagaattggcgcggtggcatacttttggctttttgcaacaaagcttcgtcagctgatgccacttttggcggcgccgtcgtggtcgtcggctgcgcatgtggttgtgctcgggtgtagccttgttcagctaagcgccgcaattgactcaaattaatcttgccggtcatgacatctgtggcgcgactaatcaagcgagcaaaatccggcggttgaatcccgtaaaaaccggcgatttgatacaacgcttcctgatgcgttgcgagttgccccgcttgaatattactattcgccagcatcgctttgactaatgcccaatcatagccgccgcctgtgccaagccgtggccgcgtggcttctttttgcgtcatatctgatttagctgccaccactgctggtggttccttgctcaaatcatgatcaaaccgaaacacatcgagaaaactggctgtaatctcctgccattcaggtctgcggactggtttgaggctaaattggccaaccagctcatcgtatcttttttccccaactttgtcgtataggagcaacccgagaagatcgtccttgaaaaaggcatcaggtgccaccggtgcatacaactcataagcgtagtaacgccctaatgagtcgacttgcgtataagtgcgcaataacccgaccgcctccagtttgacacgcgcattgaataattgatcaatatcaatatctaacaaatccagcagccataattgcagacgtcgatcagtcactagtgcgcgatctttaacttcctgccacaggctcagatacaatgccatcgcaatcggcccgatgagcggctgatagagtgaaattgctactttttcgtcaaaatcactcaaatgaccggcttttgttaacacaaaccctgcctgtggactaaatgtatcaggacgttgcatgcactttcacctcttttcagacaacggacctgagacatttgcctcaggtccggtttaccattttcagctgcgatgatctttacttcttggtcttttctttcttcatcatgtcctgcagttcctgcatgaagacagacatatctttaaactgtcgataaacgctggcaaaacggatataggcaacatcatcgacatcggctagtttagacatgacaaactcaccgatcgcctgactggagacttcgttttcaccaatcgcacgcaactgattttcgacagaatcgacaatactttgcatttgttccatggtaaccggccgtttttcagcagcccgaataagtccttttaggatcttctcacgattaaattcttcacgtgtaccattctttttgatcactaacagcggggtttgttcaacccgttcaaaggttgtaaaccgaaacccgcaattttcgcattcgcgacggcggcgaatcgcacggccaccgtctgttggtcgggaatcgacaactcgcgaactattatgatggcaatggggacattgcaagactccaccctcttaatcaaagtttgatagcttattatagcacgcgtaagccgcttatgatagccgttgcagccggtggatcaaggcattggcttgggcaatggttgcctcttgagtcccattattatcaatcacaaaatctgccaatgctgccttttgcgctaacggcatttgcgattgaattcgggcctccgcgtcagcctgtgagtgcccgtctcgtgcgattaaacgcgatagttggatattgggatcaacgctcacaaccgcaacaccatcaaagtcatcggcataatcggcctcatacaacaaaggaatgtcgccgacaacgatggcggccccaccggcttttgcctgtgcaagtgcctgactgatggcctcgcgcaaataaggccgattgatctgattcaaggctgccattctgcctggctgggaaaaaacaatctcggccagcttggcgcgatctaggctgccatccgcgcgcagcacttcaggaccgaaagcttgagcaatgcgcgcaagaacaggctgcccaggctcgacaatctggcgggcaatgacatcagcatccaccaccggaaacccagcggctttgaaagtgcggctcaccgtcgatttccccgatgcaatgccaccggttaaccccaagagataagtcacgctggccgcctcctttgatgtaatggctgacagtgtgggcagtaatgggttccgcgctgaccaaccttaattttgacaatcgtcgtgccgcagcgatcgcacggggtaccttcccgatcatagacgtgcaaggcattttgaaaagaaccgcgattgccttctgcatcaacatacgtatgcgcgctggtgccgcctgccgcaatggctgcatttaattcttggataatcgcgtcatgcagtgttttgatttctttagatttcaaggtatcagctggctgcagcggattgagccgacttaaccaaagtacctcatcagcgtaaatattgcccacaccagcgaccacggtttgatcgagtaaaaccgacttaatcggtttatgatgacgtttcaaacgctgggcaaagtccgcttcgtcaaaggtgcttggggttggttccggcccaagtttagcaagtgctgtgacctgatcctcctgcccggttttgatcagccgcatccgcccgaactttcgcagatcccgatagcgcaactgactgccatcctgaaaagtgaacgtaacgtgatcgtgcttgtcaaaaggtgtgtttgcatctttgacaacatagtaacgcccttccatacgcagatggctgatgatcgtttcaccattgctgaggcgcatcaaaagatacttgccgcgccgatcaatggtcgtgatctcactgctgacaatttccttttgaaaagtcgccaacccattgatcaggattttctcccagttagtgttgatggcggtaatgactttatttttgactaacggcagaagcgagcggcgaactgtttccacttcaggtaattcaggcattgaaatctccttatttagcgtcgaaccaagttggtccataatgactttcaacctttaatggcacatcaaggtgaactgctgagtccatgactttgggcacgagctcgctaagctgggcaatttcttcttcaggtgcctcgaagatgagttcatcgtgaacctgtagaagcattttagcttgcaaaccggcctcatccaaggccttttgcatgcgaatcatggctaccttgataatatccgcagcgctaccctgaatcggcgtattcatagcggtccgctcggcaaacttacgcagattgaagttgcgtgagtgaatttgtggcagatagcgccgccgatggaacagggtttcgacatagccgtcttcacgcgccttcttgaccatcgcatccatataatcatgaaccttaggatattgatcaaaataaccatcaatgaacgcttttgcctgtttacgggaaatgccaatgttttgggatagaccatagtcactaatgccatacacaatgccgaagttagttgccttggcttgccgccgcatatcaggtgtgacttgatctggcgaactcaggccaaaaatcttcatcgcagtgttggcgtgaatgtcgacgccatgtttaaacgcctcctgcatattctcatccccggaaatatgcgacaacacccgcaactcaatttgggaatagtcagaactaaaaatttgccaaccttcatgtgacggtacaaaggccttgcggataatcttaccttcatcacgagcaggaatattctgcatgttaggatcaactgagctcaatcggccagtttgcgtcaaagtctgcaaatagcgggtatgaatcttatgatcaggcaattgcgccttcaacaagccgacaacataagtcgaattcaatttagcccagccgcgataatccaaaatgtcctgcacaatcggacttgccgatttcaattcgttcaacacgtcaacgcttgtcgagtaaccggtcttcgttttcttgatcacaggcagattcaatttttcaaaaagaatttcgccgagctgctttggtgagttcaaattgaacttcacgccagcttctgcatagattttctcttccaaaatcttgatgctttgtgagaattcagtgcccatagccttcagtgttttagcatttagggtaatcccttgaatttccatttctgccaaaacccgagaaagcggcatttccatatctgtgaataagtccgtttgttcctgtttttccaaatcaccagtcaaatcaggccgcaatgcgaacaaagcatcagacttgcgagcaaactggccaaacagcttatcgtcttctggcacttgccgtttggcgcctttgccataaatatcctcatcacgcggcaagtcatgataatcgtgatcttcagcgattttacccaaatcattgctgttttcgtcaggattaatcaaataggacgccaataacacgtcaaaagcgatatccggtaatttcacgccgagtcgattagcggcgacgatgtttcgtttgccatcaaaaactgtcagatctcgtttggcatcttccagccaccgtttaaccgctggcagcgtcagcaaggtgacatcggtactcacataagtttcttccttagtgccaataaagaaaccgattcgttcggccacatgataattatcctcgagcatttcaatctcaaaagtcagaggttcggtcagtttggtgagtgcaagaatcgattgctcatccagcacggaaaaatgaaccgcctgaacaggtttagcgacactaccaccaatttttttgagcaacgaattcatattcatttttgtatagaagtcccggagtttgtctaaatccggtccagcgtatgtcacatccgctaagtccacggtaagcggtgcatcgcgatcgatcgttgccaactgtttgcttaagaaagcgttatctttatcgttgatcaaattctctttaagcttgctctttttcatgtcatccacattagcatagaggttttccatgcttccgtattgattgagcaatttcagagctgttttttcaccgaccttggtcaccccaggatagttgtccgaggtatcacccatcaaacctttgagatcaataatttgagccggtgtgatgccaagcttttctttgacatgtgctggggtgtaggcttcaagctcattgacacccttcactgtcacttgaactgtggtccgatcggtcgtcagctgcgtcaaatcgcgatcacccgtgacaatcgtcgtttcccagtcggcctcatccgcatgcttagccattgtgccgataatgtcatcggcttcgtaatcctttaattcataatgcgcgatgcccatgtcatccaataattccttgatataaggcaattgttccagcaattcgctcggtgtcttggcgcgaccacttttgtaatcagcatatttggctgtgcgaaaagtcgtcttgcctgcatcaaatgctactaaagcggcatctggttggactgcctttaaaacaatctcgagcatgttgttaaacgcataaatggcgttggtgtgcaagccatcttggttcgtaaaacggtctaattgattatataaagcaaaaaatgcacgaaatgcgactgagttaccatcgactaataataattttgttttgctcgccataagtgggcttccttttctacggccgctgctgtcaccgcgacctgagttagttgtcatagtcattgtaccaaattctgctaaccggtgacttgctggtcaggggaaaactggcagaaaacaaaaagagaactggcaaataccagttctcttgaacatttttagttaattattgttattcccaacaccgagaatctgtaggattgcggtgaacaggttcaagaagtcgagatagagcattaacgcaccgagaaccgctagcgagccttccgaaacggcagcttgtccatcattgccagtggtgagatacaggttcttcagccgctgcgtatcccacgccgttaatacaatgaagataatcaggacaccgtatgaaatcagcagttgcatcccatttgagccaaggaacatattcacaaatgacatgatgatgatcccaaacaaggcaaccatcgcgatactgccggctttgctcaagtcacgcttgccaaaatggccaaccatcgacatgaccagaaagacaaccgctgtcgtagctaaagcaacggcaaggttagtaccgtccgcaaccatggcaactgaagcgaacgtgaagccaaaactagcggacatgaggtaaaacatcactgttgcataccccggacttgcctgtgcgcgacgccctgtcacaaaaaatgacaaaatgatcggcataaaagccatgatccaaaaaacaatcggatgcccactcacaaaactggtgtactcagctctgaatggaaatcctaacaaataactgacgagcgccgtcacgaccagcccgctccccatcaaggtatagatgcgggagaagaactgtgtcaagccggcctcgtttacaacacggcgttcttgcatagcgttcattcctttcaagtaactctttcgagtatctgaagaccattataaccggaatgatgatatttgtcagtcaggcgaaagaccgatctttattatgagcagttttcgatcattttagacacagttttcgatgtccaacaaatcatgatcacacggtctattcttcagccaatatggtttcgtaagctttttcatacttttgaatatcaccggcccccataaagacaaccactgcattatgatattgcagcaaaggcttcatgtcttcctgatgaatcactgcagcgcctttgatctgcgcggtgatatcttcggatcggattttaccagttttctcacgagcagaactgaaaatcggggttaagaatgtttgatcagcttggcttaggacctgaacatattgtggctcgtaggcctgcgtgcggctgaaggtgtgcggctgaaagacagcaataatcgccttgtcaggatacttttgacgagcagcatctaaggttgctttgatttcattcggatgatgagcatagtcgtcgacgatgatcatgtccttgagatccttttcggcaaaccgacgcttaacgccactgaagttgccgagctcgcgggcaatcaactttgcatccagcttttccatgtgagcgaccgcgaccacagccagtgcatttaggacgctgtgttcaccaaacagcggcacaaagaaatgaccgatcagttgatcgtggaagtaagcatcaaagctgctgcctttcgtatcgcgatcaacgttgcgagcctgaaaatcatcacggtcactaatcccataataataaaccggcacctttgcctttagcttccgcagccaaggatcatccccccaagctacaattgcttttttaacttgattggcctcagtttcgaaagcatcgtatacatcttcaaaaccagtgtagtaatcagggtgatcaaaatcgatattggtcataatcatgtagtcaggatgataggccagaaaatgccggcgatattcatcagcttcaaatacaaagaatttggagtcgggaatgcccttgcctgtgccatcaccgatcaaatagctggttttagcaacgccgcttaaggtatgggccagcaaaccggttgtactggtctttccgtgcgcaccagcaaccccaatactggtataaccttcaatcagcttgcccaagaattcgtgataacgataaatcgtgagtcccaattccttggcccgtttgatttcaggatgatcgtccgtaaaactattgccagcaatgacagtgtaacccggtttcaggttagccggatcaaacggcagcatcttaatgccggcagcggcaagtcctttttgggtaaacgtatattgagtaatatcactgcccaaaacctgatgccctaaatcatggagcaccaatgccaatgcgctcatacctgatcccttgataccaataaaataataggttgcctctgtcatgacgtttgttcctctttctttgcttgactgtaataaacttcccgcggctttgcgcctttagctggcgaaacgagatgcttcgcttcaagcgcatcaatcaaattagccgcgcggttgtaaccgatagaaaaaacccgttgaagctttgaagtcgagatatgccgttcaccagatagatagtctagaacttcaggcatcaactcgtcttcatgtgacacgctggcttcagccgatttgaccaagccagccggatcaaaaagataacgtggtccgcgccgagctttgacataatcaacaatcgcatcaatttcgcgatccacgaaggttccttgcaggcggatcggctgactagcgccattgcccagatacagcatatcaccacgaccaagcagccgttctgcgcctgccgtgtcaataatcgttcgtgaatcaatttggctggcggtcatgaaggcgatgcgcgtcggaatattattcttgatggtaccagtaatcacatccacacttggccgttgagtggcgaccaacaaatgaatcccagccgcccgggccttcgccgtgattcgcgcaatgtcatcttgaatctcactgcccgcagctagcatcagatcggccaactcgtcaatgataatcactaagtatggcaggacttgtgcgtattcgtgaaaacgctcggcctttgcattgaactgttccaaattacggacaccagccgccgccaacttcttatagcgatcattcattgttgacacgacccacttcaaagcggcactggcagctttgggatcggaaataactggcgataccagatgtggcaagccattataaccggcaagctccactgcttttggatcaatcagtaataaccgcacttgttccggtgtagccttatagagcaaggatactaacagactgttgatgaagacagactttcccgaaccagttgctccggcgatcaagccatgtggcatcctagccaagttggtgaccacaggctggccaaaaagatccacacctaaagcaatcgtcagtggcgattttgcctgctgaaaagccggggtatctaggacttcgcgtagcatcactggtcgcggtttcagatttggtatttcaatgccaaccgtatttttgccaggaatcggtgcttcaatccgaatgtctttggctgctaaggccaatttcaagtcatcattgaggttcgtgattttattgactttaacaccactggccaggcggacttgaaattgggtgacagtcgggccaacagtgtgagcgaccacgtgtgcatccacgttaaaggcttgcaacgttttatccaaccgatcgctttgtgccacaacccaatcttcttgggcagcctgatcaactttgaccggcgaagcaagtagcttgagcggtggcagtgtgctaacccccggtattggccctgtaggtgcggaacctgtgtcctcagccgcagccattgatgaaggtaaaataccagttgacggtgattgcgttagtgctgacgttgaatagtcggcatcattggctgatggtgtttcagccgtcgttgaaggtggccctgatgtttttggtgatgtttgcatctctgcctgagcttgctttgcctttgccttctgggcagctaattcacgccgtagctttttggccgcatgtttgcgccgcaacgcctcaattctcgctgccttgcgactgttaggcgcatgtggcttattgatgacagactgtgaggacgaatcaacaaacggcttgttaaccgatgctggagcctcctctgcctcatcagcggtcacagcggtcagtaatgtctttttttcggtctccgctgacttagcctgtggttcaacagcagatgttgccggtgtcgaagacgataattggtgcgtgtcggttggtgttaccggtttggcggcaactgacggtgcggttgcttctggcaaagtctcatcaagcggcttttggttctgcgtcccggcttcatccgatttttctgctaataaggtatcttcctgcggtgctttagaagcgttcgctcgtctgtcagcctcattttcatcttgtttttctataaatgacgtcgtcgatttggctgtattcgtatcagacggtgtcagcgaaatatcatgattgacggccatcttattttcgatgccatggcccgcaaaaagataaaccgtttgcgaatctggtcgcaaaatctcagcaatttgtgcgtaatcggtacgatcaacgggacgccgatgagctgtgctgtttggtgtcgataggcgcgacaactcatcgcggccccgcggtcgttgcggataatcaaaggcacgcaaatcggcctgagcctccgcgaccttgcgcggatccacatcaggctttggttcgtgcgccaattgcggtggcaactgatattgttcctcgtgttgcgcctgtgtccagtccgaagtattcaactcagattggggttccggcactttattttgatgtagaaatgccgggccatcataatgcgccatgattgaatccccttctattcatgtttctagcagtgcctctattttagcataagcaccgcaaccaataatccttgatccctaaaaatatcaccagcaattggaaaaagattcatgttaagaccagtgattttgcaattggagacaaaagaaaagacgtaagcacgaggcttacgtcaaattttttcgttattcgcgatcaaaacaattacaaccggctgttcagatgggcacaaattatgatgcttgaccagcaacaacggcctcggcttttttagcatcaaatggtgtgcctgcaggtaaactatcaggcatcaccaagataccgcgacgttgtggcgcgccaggaatgcctaactcacgagcactgctgatcatgccgtaagagtcaacaccacgcaacgagcccggccagataattttgccatctggcatcatggcacctggcaaagcaacaacaaccgtttggccgagtgctgcatttggtgcaccgcaaacgatttgaacctgttcattaccaatatcaacttgcgtcacatgaagatgatcagcatcaggatgatccttaaaatcaacaattttgccaatcacaaacttaggggtttcatcgaccgctagtttacccggcagccctgccgtctgaatagcctgattaagctcggcaatttgtgttgcggtcaacacaaggcgaccttggccagttaactgacccagccactgtgtcacgttgaaaaagttgtagccaatcacgttgcctttatcattgagaatcgcaacaatgtcaccacgtcgctgaattgtttgtgttgccgtatcctgacctgtgatggcaagcaaggtgtcgccaaacgctggttgattataactggtaatgagcatataaacctccaaaaattaatgcaagccgttaatgaaatcttcgacttgttgtttcgtcttacgatctttattcacaaaacgaccggtttccttgccatcgttaaaggcaataaagctcggaatgccaaacacacccatatcttgagcaacttctaaattcttatcgcgatcaaccgcgatgaattcataatctgaaaagtccttctcaatttcaggcatagctggtttgataaaacggcaatccgagcaccaatctgcagaaaagaacaacatttttttacctggttgcttgacctcatttaaaattgctgcattagagcctaattctttcatagccaacatcctttcgcttactatttataagtaactataacaggaaatcgtcttaagatcaatgatgctcgtgctgtgttacattatactcaaggtgataaagcttgaacaggtcaacaaaagccaagtcacacatcgtcagatcagttagagattagcagaagacgtcagcaatgtctcgcctttatatcagttttaaaagaacgtccggaataggttggacaggttcgtcttcatcactaaagggggtcacaaatttggcaattttcaaaaagaagtcgaattggcgtgtctggatagccgctgctgcggtgacggccggcatggcttcgattgtttatcggcgcctgtattatcgaaccattcctaatcgcattttgtccatcgtcaagaccaactttacaaatcgcggcaccatcgaaaatagctggatcaacatgcagccaaccgaacgcgggactggccgtgatcgctatcgcgtgtatactggcgggttgaccgtgcgtgaaggcgaccgcctcaatcagtttgcctttgctgttgagcccgatggtaccttaagacaattaaaacaacttcacgaaccgattaatgcttaaaatgcgcgacaagttcgtagattcgaccgccatcagcgctgaacttctcttcgtattcagtgggcacgttatccgtgacgcgtttgtcgtgatgtaggttcaaggaaaccaaatcgaacgtcatcccaaaatgattcatgctgaccaaggaatattcaaacaacccttgattatccgttttaaactgcagcaaagcatctggcttcataatggcttgatactgtcgcaaaaagtcacgataagtgagccgccttttttcgtgacgggtttttggccacggatcggaaaagtttaaaaacaagccatcaatctcaccttcactaaaataatcggttaagtccgcaccatcgcccagcacaagctgcaagtttggcaattttaaggcaacctgttttttcagaatcatcgctacagcggcttcctgtaactctaaagcaataaagtttcgatctggatgggtcttggccatttcgacaataaattggccctttccagagccaacctcaagatacaatggccgtgcttggtcaaatcgcgattgccagtgaccttgcatcttttctgggcgaaccaaaatcatctcaggatgagccaagattagcggtttcgcccactgtttgttacgtaatcgcataaaatttctccttaacttgaacattggctaggtcaaagtacaccgtgaccgctcaaaaggcctgggacaaaatcactttttgcctcaggccttttttgatgaatgaccttgcttgtttgcagcacagcttaccgactcgcttgtaaacattcgaattgatgcaaaacttgcgcaacttcttcgaatcgttgatgcgtggctgctaccttaatatcatgaagcaaatgcagatcaccgtaccagtacagtcggcgtttcaaatcctcatcaagtcgtgcgccataagcatccaaaaactggtgacttgtggctggactgccatagtgggcaagtacatccgcaagatcataagccggatcgcccagcgccacctgctcccagtctactaaatacaaccgaccgcctgcctgtaaccaattcttgtggttcaaatcgccatgacaaaccgtttgcacatccgtgtgcggtaaccactgctttaaatcgtgcagagccgttttgatcttaggctgcgcagccacatcgactgggaaatcctgaagtagtgcgattcgtaattgctcaggatcaaggacttgaccgcctacttgacgtaataaccgttttaacagacttgagtggtgcacctgtgccaacattttggccacgactggcaacatcatttgttgccgcgttaacgtttcaccgtccagccactcttgagcggttagcacgtctcccgtactcacccgccgcgtccacaacagccgcggggtaatgtgttcaactgatagtgccgcaagaaacggcgaggcattgcgcttaaggaaatatttttgattggcataaaccccaagaaacgcacttccggtggatccacctgcaggctgcagggaccacccggaatctaattcaaactccataggcactactccttacttctggccgcaggaatgattcacaacatcaaaaagacactcccaggcgctcgtgcgtccacgctcaatattactaacttgcgaaattcacgtcaagagcagagcgcaaactggcccgcttagaaaccggaacataagcggccttaagcctaaacgggcggtctttggccatttaggcttaaggtccttatgtgtaggtttctgggccagtttgcgcgtttaggcagagtgtgaactggcgcggttagaaaccggagcataagctgccacaagtgcgatggctgtactttgaccattgtgcttgtggtccttatgtgaaggtttctgcgcctgtgagcgcgtttaggcagagtgcgaactggcgcatctgtcattcaacgcatcgcatcatgtaccctcaaccgaacacgtgcataccatcgcgtgaagccccagacaaatgcagtcccgctaacaaatattgtcaacgcggcgagccactgcagtcggatcaacgcaaccagtgtgaaaacaaccacttcaagcagcaacaacgtcatcaaaagccgttcaaaggccgccagtttttgatttggtgctactggatacaagtgcgtgaagacaatttcatcatattggaagaagaatggcaacagctgaaagccaaccatatacaagaatagaatcgtaaagccaagcaacagccaccactgagacaaaaccgccacgataatcgcgccgatcaccagtagccgcaagtacaacccaagatactcaccgccacgcaaaaagccgcgcagatacaagtatgcccacgtctctgtcttgcttggcttaaccaacttcaaaagtggatcgaggtaccggcgacgatggacgctattggcaaaacctggcacatccgtgaatagattataaaatcgatacagtcgacccatgcgatctgcttcgaggtcaattaaagcttcaaaattcaataacccatctgccaacaaggaacttcgcagccatctgaagaccaaattcagagtcagcgccactaacaaggccacagccggatgcaagtaaaaacctagaaaaagagctgcgaatgtgatgacaagcagtacaagtcgtggatgtcgccaattgatcggcagatgatagcgctgaagcaattgcagccacaagtcgagatctttgaataaccacacagctagtagcagcgtcaccgtcgcactgattggatcttgacccaattgtgcaaataatggccacatcgccaaagccgcaaaacccaataaagttgccggtaacatcatgctgtatcgccgtgccttcaacaaatagtcactgaaggcctctgcttttggcagtaagaagacttgatcgggcgcctgcgccaacgtggctaactggccaagcgcgattaaagccgtaaaaatgacagccagacacaaagctaaccaccaagatggttgcaatgttttcactagcagactgtaggcatataaggcaccaccaaaaagtattagcaagaccagtacaaaatggtcattgaacaccaatcgcaaatatttttgctgttcttggacatgttgtcgaagtcgagttcgccataacgcgaccattactgttcctccgtcattttcatatagatgtcatccaagctgccatcctgaagatcaaattgctgcttcaaagaaggtaaatcaccagttgctctgactttacctgctttgatcaaaacgaattcgtcagcatattgttgagcggttgccaaaatatgggttgacatcaaaatagacgctccttgctccttttttgctgtcaccaagtccaacagatcatggacggccagtggatcaagtccagtaaaaggttcgtcgatgataaaaagctgtgcatgcgtcataaacgccgccacaatcatgaccttttgctgcatcccttttgagaattttgctggaaaccagtccaacttattgtcgagtcggaacattttcagcatattatcggcatcttgccatgcaaccgtcgcatcaagatcgtaagccatgatggtcatttcaagatgttcccgcaacgtcaattccggataaagcaccggtgtctcaggcacatacgcgaggtcagctcgaaaaccagtgggatcatcgtgtaatgttttgccatcaagtgaaatcgtcccgctttgtggggtcaacaatcctataatatgtttgatggtcgttgacttgcccgcaccattcaaaccaattaacccgacaattttgcctgccggtacggtaaagttgatatctttcaagaccgttaaattgccgtaaccaccggtcaatccttcaattgttaaagtcatcttaccagtcccaatctgtataatttcagttagtgatatgatagcatgaaatcaaggtttctatttaaaaagcgcaagcagaaatgaggcagcaacatgaatgattgcattttttgcaaaattgtccgtaacgaaatccccaatgttaccgtatatgaagatgacgttgtcaaagcctttctggatatcacgcaggttacaccgggacatactttattagtccccaaagttcacattccagatattttcgcttatgacactgaacttgccgcagcggtttttgaacgtctgccaaaaattgcccgcgccatcaaggccagtgacccggcaattaaaggtatgaatattttgaataacaacggcaaggtcgcctatcaaagcgtttttcactcacatatccatttgattcctcgctatagcgatcaagatgattttggcatgcactttggcgatcacagtgcacagtatgacacagagaaacttgaagcggtcgctgacaaaattcgtacccagctggaggcctaagcatgaaatttaaacacggctttttactcggagcactgaccggaacagtttatgcgctgttgactgcaaaaaaaaccggtccacaacttcaacaagagatcgcggcctactttgaaggcttatcagacggagttggtcaggtgcgtgagagtgttgctcagttcagtcaatccctcacccatttatctgacgaactcaacaatactttgaaacctgccatgaaagatatcacagatcgggtcgagacttttgaatttgaaacggccccgcgcgttgatgcgatccaaaagcatgttgaaaatatcaatgatgctgtcagcaatcttgatgctatgccgactgccgatcagcgtgaacctttaccaaaacattgaaaattgccggcgatgcccatcaattaagtcgtgacggtttcgtgaaacttatgtgaagatccgcgtgcggcagtaagttatggtatagtatacggcagtgttaaccgaaacttttaagattaggatgtgtgattgcatgaaaaaatggattctcggcgttgttggtttgtttgtagcagtgacgttagctggttgttcaagcagcacggttgcaaacatgaaaggtgccaaggtcaccaaagacgagtactatgacgccatgaagaagaccaccactggccaagcaacattgcgtaacatgattgttttgaaggcattggaacaacaatacccgaataaggtgtctgataagaaggtcaacagtcagttcaatacactgaagaaacaatatggttcttcattcgatacaacccttgaacaaaatgggtataccgaatcaagttttaaggatcaaattcggacaaccttgtactcagaagttgccttgaaggccctcaaaaagccaacagaaaaacaaattgctgctcagtggaagaagtatcaaccgaagatcaccgtgcaacatatcttggtcaagaccgaagatgaagctaaacaaatcatttccgactaccaaaaagacccaaccgaaaagaactttgaggcccttgccaagaagaactcaatcgatactggaacaaaagataagggcggtaagttgacggcgtttgacaacaccgatactagcttggattcaaccttcaagaaagcagcctttaagttaaccaaggccggcgatatcaccacaacaccggttaagacgcagtatggctatcatgttatccgcgttatctccgttggtaaaaaaggcacgatgaaggaacacaagaaagatttggaaaaccagctctatacaacatggcagagcgaccaaaccgtgatgaacggtatcatcaccaaagtgcttaagaaggaaaatgtttccattaaggataacgacttgaaggatgttctttcaagctatctgagcaccagctcaagtaccagtacttcaaactaaaaattaaatcagtgttagcacttgaaagcctcgcaattaattttgcgaggcttttatttgtgttgcaaacatgacgcaatgaatggcaagtgattgtttgtaggactcaaaaaaggctgataaagataggcgctatcccatctttatcagccttttgacaaccacatgactacaactaaactgactgaattcgcctagtgcggatccggaaaagtttgaccatttttaggtcgatagaagcgacgattgtccataccgaaaagtcgttctgtgaaggtaccaggatcaacatgttggtaggcggttgtcatcatattgattgatgcgtccaattcgtctaaatcatgcaacacttgcgcttcaagcagctctggccgcaccggcgagccgtattcaagcaatccgtgatgtgcaagcacgacatgacgtagtaagagcatatcttcagcgttgatatcaattttaagttgctgtgctgctaagacaatctgttcgtcaatgagaacgatgtgaccaatcaagttgccttcaaccgtgtaatcagttgagattggcccgcttaactcaatggtcttaccgaaatcatgtaaaattgcgcctgcatatagcaaacttttgttcaagctcgaatactgttgaacgacacttttagcaagtcgcaagatgcttagcgtatgaaaagcgagaccaccagcaaaagcatggtgatttgacttggcggccggataactgaaaaatgccttcttgtgatcattgatcagtttacggacaattcgattccagttagcattggtgatttcgaagatgtaactgttcagttcctcttccatatcactgggtgcttctggcgcccgctcaacaaaggctttaggatcattgccttcctcttgggttgccaaccgcaatgaaaaaatcttaatttgcggattgccttgatataattcacgcttacccgacaattggacgacttcgccagccttaaactgagcaatgtcattgtcgctagcatcccagaacttacctgaaatatgtcctgaattgtcttgaaaaatcatcgcaataaattttttgccattctttgcgacacgcacttcagctgatttaatcagcacaggaagccgaacatcttcttcattatgataatcgaaaagccgttttaccaaggtcgtcaccttttccttgaattttcacactacttaaatcatacagatatcaatgataaagtacaaggaaggttggtgcttgagtgaatgagaaaccatgcttcattgtcatacaaatgttaggcacatccaaggacgagtcagcgctcgggtaagagctggcacctaaccctttttaaaaataatggttggatactgaaaagaaaatgcaccacctatgaattgccttttgccagcaagcttagttcaaacattgtcgcgacacgctcagccttctctatgcgcatgaatttccaaagaaaaaggatctccgcaatcaacggaaatccttcaatcaccagtcattacttgccttgatagacatcaataattggttgggaaataattttgttcaattcgtccatcatctgagataggccttgttcttttgccatcaaattttggatcggctggatgtcgcgcatcttgtcgccaagttcttgcaatgacttaacttcatcatccgtgaaatcttgtccctgcattgacttttgctgcatctcatattgcttttgttggaattgttggaacaaaccgtaagcaacggcgtccagcttcaagagatcaaacgccttcttgagatcctgaaattcctgtgttgtcttgatatctgccgccatctgattagcggtgtcgtaaacatttgccatactttacctcactttttgagcctatttaaaccagcccttgatattatcataccattgtcccacagtttgcttggcactgtctatgcctttctcgatactatcctgaattccttgccatgttttgtcgccactggatggtgtttggatgctagccatttgtgcggcatctttcgtgtcaaacgcggtttgtggcgtattcggcattaggttcgtcatttcgagtttaaataacggtgccaccccagacgtgctggtgccttgaaggaaatgctgactgtcagttgtcgggtagccaatccaggtcgcatttacaatatctggcgtatagccaatgacccactgatccttagtgccatagccccaactacttgggacctcagtactgccagttttcccggcgattgtgtagccagctggtttagcagtttgaccggtcccttcgttaaacgttccgatcatcatgctcgtcatttcctgagccactttttttgatatgatttgacgcatcgttggatgtgagttgtcgaccaccgtttgacctgacgcatcaacaattttgcgaatgaagtgagtcgttggcaatttaccgccattcgcaaacaccgcataggcccgtgccatcatcagcggtgaaaccccatttttaaggccaccaagtgcagcagcaagattctgatcgctttcttttagttggatgccaaaccgatctaagctagtgacccctttttgtacaccaatcttattaagcagccaaacagccggcgcgttgatcgaatcggctaacgctttatacatcgggacagtacctaaataggtgccggttgcattggtcggcgtataattatttttaccgtaactaagtttctcgtccttcaagacagaatcataatgataaccattttcaagtgctggtgtataaaccatcaacggcttgatcgtggaacccggcgaattgcgaagttgtgttgcgtagttaaaccctaagaaggtatgctcaccgcgattaccaacgaccgccctgacaccgcctgttttcggatcaagcacgatggaagccccttgaacctgcttaccatctgcggcatttgccggaaacgcccagtcttgagcaaagctgttttgaaggttgcgttgataagtttgatccaaattggtataaattttataacctttgttcaaaatatcatcgacactaataccttcactgcgcgcctcttcaatgacggagtcaaaataagacggatatttttgactgttggccgttgaaaaagtatcgacaacctgcactgactgcgcttttgccgcattggcctgcgcctgcgtgagcttcttattgtccaccatcaattgcaaaacgacattgcggcgcgacaaagcattgtccatgtgatcagcggggttatagtagctaggattccgtaacatccccgccagaattgccccttcactcgcatcaagctggctggcatctttgccaaaataccgcttagcagcatcttgaaccccccagaccccattgccaaaataagcattattgaggtacatcgcaagaatgtcttgtttggagtaaactttattcaactggatggccataaatagttcttgggccttgcgcatcaccgtctgcttttgcgtcagcaaggtattcttcgccaattgttgggtaatcgtactaccaccacccatgatttggccatggtggatgacataattcaaagcagagcgaagaatccctttgattgaaaaaccgccattggtataaaacgtacggtcttccgtcgagataacggcattttgtacttgcggactaatcgcctttaactcgacgtaggtccctttttggccgtacagtgtgccggcttcttcgttgttagcgtcataaatgacggtttttgtttgtaaggtactcttgatgttttcaacatcggcggttttggctttataagtaaaccaagcagagaacccgagcatgactgtcagaccaattaaaatcagccaacgaatcacctgaaacctgcggaaaaaccaccgtgttccctgccaaattcgtgataagaactgcatttccgtcctcctaatgtgaatcttgtttattgtagcataggcgacaaccgccaaaatttcatcgacatctttttaagcaaactttatggtcaaatgaattgaggaaatcacttgttgtttcaaacttctgcacgcgccacgctgcccaccagccttcgtgatcaacttcaagcatggttgataccacgtaaacggcaacaccaattgcgcgttgccaaaacaattttagttaatggtcattatcgtaattttaatgaaaaagtacagcctagtgatgttatcacgatgacttatgatgaacccacgccacttgcctacgttccggaaacgccggccctcacaattcattatgaagatgatgatctactcattgtcgataagccggctggtatgaaaactcacccaaacttaccaggcgaaaccggtaccttaatgaaccaggcagccgcttatctggccccttttccggcgttaattacccatcggctagatatggcgaccagtggtttattggtcatcgcgaagaaccctttaacgcaagccatcattaaccgacagttggctcttaaaaccatgcatcgggattatatagcgttagtaccgcagggaattgcggccagtggcaccataacggctccgattgggcatgatcctgatgatcagcgtaaacgcatgattagaccggacggggcatcggccattactcattttcgccggatcgcagaaacgtcaacaactgcgacggttgcgctcagactcgaaaccggccgcacccatcaaattcgggtacatttagctaggattggctatccaatcctaggtgatccgctttatgcccctgatcagacaacctatcagcgcatgtatctgcacgcctttcaggttcgcttcacaaagccgctatcagacacaacgttgacggtgaccagtcccctgcctttttgaacaattttgagccaaagtaatggcacataccatggcaagcagcgggccactaattgtgtgacaacgaaaagagctgggtttgacaaggttgaccttgttgcccagctcttttgcttgtgatgttgccagatggttacgaattgaaggcttgccgataagccgcttcaaaccattttgcctgcttctcatccgggctaatcacgacaatcgtgtcatgaccagcgatggtgccgacaacttgctcaaaaccgatgtcatcaataatcgctgccaataaattgccgttgctcggtaacgttttgatcacgttcatgaaatgcacccgagtaattgacagcccgacttcgcgaattgagcgacctaaccgttctaactgggactctgaagagccgcgaaaaatggtataacgtaacgtcccggttgcgtcctgcgatttgacgatcttcatctcgcgaatgtcgcgcgaaatcgtggcttgcgtcgcatcaataccagccgcttttaatgctgccaataactcttcctgcgtggcgattggcttttgattaatgattcgtgttaaggccgcttggcgttcacttttattcatcacatggcctccaccattattgttgcgcgggagtcagtccaagagacatcggcgtgtaagcggccttagatgtgatggccgtactttgaccattgtgaccaaagtccttatgcgtaggtgtctggactgacgagcgcgttatcgtcactgccggttgctgacgcgcaaggttacatttcttctggcgcaccgacacccaacagttgcagcgcatttgttagcacttgtgtcgtcgccttaaccatcgccaatcgagctggcagctcactgtcctcaaccagcactttgacattggcataatacttattgaaagcttttgccaagcgtagtgcatacttagcaatcacagaaggttcatattccttggctgcacgcaagaccatgcttgggtaatcgccaagggcgcgcaaaacgtcccaagccgctggatcacttaaagccacttcaggcgccgggtcaatcgcagccttccgcaaaatgctattagcccgcgcgttcgtgtactgtacatatggaccagtttcaccttcaaaacgcacgacttcttctaagttgaagtcgaagttgtctaagcgttcgttcttcaagtcatggaaaatgacggcgccgacaccgacttcatgcgcaactttatccgcatttggtaaatcgggatgcttttcagcaatttgttgtttcgccagaccgacagcatcgcgcaaaacattttccagtaagataatgttgcctttacgcgttgacaacttcttgccattcgccgtaatcagcccaaatggaatgtggtgaatatcattcgcccagtcgtaacccatttctaacaagacggcttttaactgctggaagtgttcgcgttgttcattaccaacaacgtacaggctttgaacaaaatgataatgttctttccggaaaatcgcagcagcgagatcacgcgtcatatacagcgttgcgccatctgacttcttgatcagcgctggattcaagttatacgcactcaaatccacaatttcggcaccttgactagttttcagcaaatgcttgtcttcaagccgcttcaccacatcagccattttgtcattataaaaggcttcgccattgtaagaatcaaaatcaacaccgagaattttgtaaattcgattgaactcagccagtgaaactgtgcggaaccagcgccaaagcgcaatggcttcttcatcgccatcttccagccgcttaaaccaagcacgggcctcatcgtccaactcgggatttgcctcggccttctcatgaaattccacatagtaatgcaatagatttttgatcggatcggctttgacagcgtcctcggatccccacttcttgtacgccacaatcagtttaccaaattgtgtgccccagtcgccaaggtgattaattttaatcggtgtatacccgattttgctgagaatgttggctaaggcattgccaatcacggttgagcgtaagtgccccatggacattggtttagcaatgttcgggctgctcatgtcgatcggtacattcccgctgccgatattagcatcaccataatgctcgccagcttgcgcgatcactttcaacacatcgtgggcaaaactgattttatccagataaaagttaacatagccaccaacagccttcactttttcaaacggggtcacatcaatttgaccgaccaaatcgctcgcaatcatctttggtgcgcgatgcatgatcttcgccaaggaaaaggttggaaaagcataatctcctaagtctgatgatttgggtgtttcaatcaaggacttgatcgcagccgcgtctaattgaccggcaagtgctggttcaagtgccttaacaacaagttctttaaaatccataacttcctcctaaaatgatgatgccacgaaaaaaggacccatctctcctgttcgaagagacgagccctagcccgcggtaccactctgcttgacaatatgtccactcaaagcactgattctcaaaagcgcgccatcaggtccgacgtgatcgtttgcactatccgatctcactaagaaccgccaactgaccttatttcctctttctcacagaaccttatacagcggtcgacgagaatcgaactcgcgacaccagcttgggaagctggagttttaccactaaactacgaccgcaaatcaacggatataagtatatcacgagggctacattttgcaaaggtcatcaaaggtgactttttctatgaatttgatgagaaaaaatcttaaaaatgagtaccggcaattttcttgttaatgtttctcaccgtgctataatattagtaaagaaggagtggtcgagatggcaaaaacgggacgtcactattatttcgtggcgcgcaacgagaaaaccaaaacaggttatcacattagttttccaaatattcctaacgctgaggcagtcgggacaacatacgaagagaccgtttattattcatatcgggtcttggctgacttcctgagccatctgccaaaacaagaagcggaaattcgtgcctacacgctttccgatattccggatacggtttccagcaatgttttctattcattggtgagcgtcacgcctgactttgatccgcacaaaatggaaacacattttaccttgccacaaacaccgcctgccgatattcgacaaaaagcagctaaactggctggattagtgacgccaaatgataacttggctttgtaactaggtattcaacatgcaaacttttcgaatgttgttgttagttatttttcttgttggcgttgggttagctttgatcggcctagtaagttggttgattgccctattgcgacaccgcgaaacaaaaccgatgcggcgactgacttggctgagcggcggagtggcgcttgcggcgctgattgtcaacgcgtttacgtaaacaactttgatttaagcgataattcttaagtcatcatttcaagaagagcactgccagtgatgggagtgttttttgtttgggattgcacggaatggtcgtgcaatcaaatcgagaatgaaaattgaacgttgttgcttcaaaaacgcgttcgctgccgcagaaactggtgtgtaaggaccttggaagcaatgaccaaagcccggtcatcacgtccaaggccgcttacacgccggtttctaaacgcctcagctcacgctctgaggcgttgactggtttctattgtatttctatgcttaaataggaacagcaaataatgaaggagtgggcttatgactgacctgcaaacaagtattggcgactttcaatttgataatgtgttcatgaacgcaagcggtgtacgctgctacaccgaggaagacttagatgcgttggcacaaagtgatgctgggacctttgtcactaaaagtgctacccaagcaaaacgcctcggcaatcccagcccgcgctatgctcgactagaactcggctctatcaattcgatgggcttacctaatgagggcctcgattactatctcaactacgccttgaagtttcaggaaaagcatctaggtcaatggatttttctgtcagttgccggcttgacaatggaagaaaatctcgccatggcacacactatcgaagactccgattttaatggcttggtcgagtttaacctgagctgcccaaatgttccgggtaaaccccaaaccggttacgattttgaccgaaccaaggaagtgcttaccaacctcttcacgttctttaccaaaccagcaggcgttaaattgccaccttattttgacctcgcgcaattcgaccaaatggctgccatcttaaatcagttcccgttgcaatttgtgaattctattaacagtctcggcaacggcctcatgatcgatcccgaaactgacacagcgttaattaagccaaaaggcggctttggcggtattggcggcgcctatgcgaaaccaatcgcactagccaatgtccgtgccttttcacagcggctggacccgaagattcagcttatcggcactggtggtgtgaccaatggccgtgatgcctatgatctcatcctcgcgggtgcgagtttggttcaagttggcaccttgcttcaagaagaaggaccggccgtattcacccgcctgagccgtgaacttcaggctgtcatgcagaccaagggatataccaaccttagcgactttaaaggacaattgaaaacccaatgacgaacgaaaaaatgaaggtttgggcatactttaaacacaacgctggcgactttagccggcattggggcgcgtatatcatgctcatcagcgtcactaatctatttattgggttagctgtgatcccgttttttaattttgctgctcagcaaacgttgcgaattggtcacgtgccttacattaccttgacgaacctcggacaaattctgactcatgatcccggagttgctgcagttctcaccttgttggggctgctactactgttattcgtttactggcagttcaccttcttgattctaggtattcaaaacattcatcggcaaactcgcttaagcttctttcaattagcaatcgcgactttgaaaaaaacccaccgcctaacaccgacaaccatcgctgtcttaatcgcttactttgttttaatctttccattttcaagcgttgttttcaaaacaagcttgctggccaaattaaccattcccgatttcatcgtcgattttatttttgcccgatggtatctcggcctactggtcatagcgctttacatgatgggtacctggctcgccgttcgcttgttgccgttattacctgctttaattttgagcgaaacccctcctcgaaaagcggttgccaaaacttggcggatgacgcgcggccaaacttggcgcacattgttagcagtcttgttaatcttcataccggtagctgttctgaccactttgctgaccattggcctatatttacttcagtcatacttggacagtcactgggaacattgggccttacttggagcaaccatcaaccttggtgtgttgcaagtggttatgctgctattaacagtgttctttaccgttatgctttatcaattgggaacctcgcaggcagagacatttcaactcattcccaaccaagacttgattgcccgagtcccaaaacgtcggcgcaatcttcttttccgaattggcgccgttggcttaattgcgttagtcatcggtggcagcagtcttttctactacgcttatctgactggtgcactggcaagtcagccgttaactatctcacaccgcggggttgatgatggtaacggagtccaaaatacaatcccagcgttacaagccaccgctaaagaaaaaccggattatgttgagatggatttgcacgaaaccaaagaccatcaatttgtcgtcatgcatgacgagaacctgaaagatctaaccggtgtcgatgccaaaccacatcagctgactttatcagagatgaccaaactgacagctcgcgagaatgggcacaccgccaaagtcgctagttttgaccagtatttggcggctgcggaacgactgcatcaaaagttattgatcgaaattaagaccacacctgaagacagcccacaaatgatgaatcattttattcaactatacgggcaacgacttctagccgatcatgatcagttgcattcgctcgattatcaagttgtcacaaccatgcgcaaacaagtgccaaagttgaaaacttttttcattttgccgtatacgctcgtctttcctgaaacaccagctagtggttacacacttgaaacaaccacgttagccatgcgggtgattgacgaagcgcataatcgtgatcaaaaagtctatgcttggactgtcaatgacagcgatgatatggaaaaagtagctttcatggatgcggatgggattatcacagatcaattgggtgaattaaaaacaacactatatcaaatgaaccaccatccaagttatgctgatcagattttgcaatatctgacgagcttttctgatgatgctgaaaactagctatctacaaataaaggcaccaaaaaaggccatcaacttttattcgttgatggtctttttagtcatttacttgaagtaatacctagctgtttctaatgcgctggtttccatcaagcgtttgccatactcagacagcaccgctgatgacaacggtgaccgatcgccaaattccatcgcgacggacatttgatcgtgcgcctcgtcagacgaaatctcatttggataaaaggtcagtaccagataataagcgttcttataacgataaagatcgctctttccgccttcgagccgcaatgtatctgctaaactaataaaatcttcaaagtcctttaatttcaaaacaagctcagtctgtggtgctttgtcggcatcaatatagccgccttcatcaactgcctgatgatcttgttgatcactggcatcaagtccttgcagttgctgacgaatataatcaggcacctgggtatccgtaccttcgtcatcagtctgatcggctgcgctatcatcgtttttttgaccacttttactgatcagcaattcgagtccggactgactcggcatgacctgaaacgtcacggcctcatttgtagcaaacgtatgatctttatcgacctcatcgaggatactatagaagaagctctcaatctgtttatgattgcctaacagatccaaaaccgtgatcccacgctgcgctagatcatcgttgcctaacatgacccggatcgtatttgcgttaatccgttccatttccatgattgctgcacctcactttagtcacggaaccctggcttctgtgaatatcacattaccacttactacattatagcagatttcgtacgtcaaggcattctaccgcaggttagcgtgagtatcaagtaaagcgcgcggtcttcaaacttggttcaaccttcactctagtaacacttgttttatcaacctgcagtaacatcgcgtttgcgcctttcatacgcaaaaaccgcaccaaattaggtacggtttttgcaaatgattggctcatttataattagttttttaaaaacctgcaagtagttgtgcttgttgcagctccattgttcggacagaacgcggcaagaaacgccgaatttcatcctcgttataaccaacctgcagacgtttatcgtccatcataatcgggcgacgtagcaagccaggatacttggcaaccagcttaattaacgtaccagttgacaagtcatcaatattaatacccagctcctggaagattttcgaacgtgttgaaataatttcttcagtgccatcttcggtcattctcagtaaccgtttgatttcatctacgtttaatggatcagaaaaaatattacgttcctcgaatggaattttattttccttcaaccaggcgcgcgccttccgacaagatgtgcaacttggggatgtatataaaataaccattagcgctcgctcctttttcgtgacgaggtacttttcatctctacaggtatagtataagagattggaccggcgctaagcaatcacatttagaaaaataattttttaaaagctgaaattccatattaacgaatattgactattgtccattttatcaacaattatgcttattcatttgcaataaataatacacgttataataacctcgatttacacatcttgttatcattttaaagtaaggcttatcaagagtatcagattgagattgtcaagtcatcctctgccaattgaattggtatacccccagcagcagtctgtgcttgctgtttcaaggtgacaagatcaagctgttgcggcaaatgtgtcaataataagcgctttacttgagcgtctttggctagttttcccgcttctggtgctgtgagatgccaacgcggttgtggctgatctgctagaaaattggtatctgccatcaaaagatccgcatctttagaaaacggtgccagtgccgggaaacaacgcgtatcacttgtattgacaagtgttttaccagtgacgtcttcaacgattcgaacagcaaacgctggcaccggatgttgggtttcaaggaaagttaacgttaaagggccgagatgcaaagtgctgtctgccgtatagcctttagccgttgtataagggccaaacgttaaactagcaaagttcaacgggtcttttgtatgcccatatatcggcaacggtgacacctttttgtccccttttcgcaattgataatagtactgcaaaacaccgacatccgcgatgtgatcatgatggtagtgagtcaataaaactgcatctaattttaatggatcaaactgctgctctagtgaaagcaagccgccgctacctaaatccatcaataaatgatagtcaccactttcaataaggtaagtgctggtcgcgtgacccgcatctgggtagccgccaagataacctaaaactgtcaatttcatcttgtttttccttcctttcaatgtgaaaccattcaaaaagcttataatggatttggaggtggtcagaatgtccacaatacaaacagtcttcggcaacaagtcgttccttgtcaaactgctagacgaacgtcatgacccgcaattgaaactgttgaaaccagctgaagagggtttggattacatgatctatgaccccagcggaaaagcacacttttccgcgcccttgcaatatgaaacccttgcggatttaggtacgcccgccgacaatggttatattcacttcatgtactttaatttgagtagcgatgacgtgaaagttttccttgccaaaattaaggatctcattgataagcatgatatttttcttggtcaaactcaagtcttagtcgcccagaaagtcaaacacccagacgactttgtggtcgtatcaggttggcaatccagtaacgactactacgagtttaagaatacgccggccttgtcagcagtcaaggagttcattcgtcgcgcggcctccgcaaacggcttccatcaggctggctatgcggtgattgatccgcatcagaaaaactaaataagttacatagacggcttgttaacgcctatgaaaaatccgaagtcaatcacttcggattttttattggcgcctaatgcgctttttaagaatgcactcgcttgtgtaattattcagatagcccacggatagcgccgtagctaatcaatcgcccaacgggaaacaggttcatctaccatgcgggcagtaatgtgcacagttgcctcataaaaaagccaatcgataattgcatagatcaaaatcatcaaacccaaataacgcgaaggcggattatcaagataagttgtcaaaacactaatcatacaaagcccaattgttgtcccgaaaagaaacggtaccgcaaagacaaccgcagcttgccgataaatcgttatacggagttgccttggatccataccaagatgttttaaaatttgaaaatgtcgggcctcttggcgagctgcaatcacctgttttaaaagtaaaatgctacccgtagccacaacaaaaacgccgccgagcaataaaatcagaaagaacaaaaagccatacaaagtgttcacaattccctgctggaaggactgaattcccaacggattgcgccaaaagttcaaggtagtgctggctcgatctgtcactctcaaatcattgccatcccgctcagaactgccaatattgacatactcttgaagattttgactattctccaagtgctgtaattgtcgcaacgcagcggcggttgctttggacttaggtaagcgagccatatacaatcgatcagtcgttccttcaagcatgtcaaacgtccgatcactgacaagcaacccccggtcaaaaaaattgtttctgccggtcgggaaaagattggttgttcgtgttaacaataatgacgcatcgctacccggcaatatgatggctcgatcaggattgcggcgggcaccgactggtcggaaactggttcgcgttggcagcattagaagtgcttcgttcccacgaagtctaacaggagctaaatagtgctgtaagtgggcagcgcgttgataatcccgcatcgcaatcacattataaacaccaggttgttttcggacctgatcggcctgatctcttagtcgaatttcggcatacacaagtttcgaagataggataattgcttgagttggtttgaccttagcttttgctaaaattttcgtgacattatccacgcctgcccctgctgcaaccacagtcgtcggaatctcgcgctgaaccagatcctgattatattgaaacaacatagcagaactgccaagcatcgtaatcgtaatcgcacacagcaatgttgttagccacaatgaatgcgcgttcccttgaagtcgtttaatgatcaaatgtcttgagatggcatgcgcattgcgcgtcttcatttgacttcgttgctggaaccaagccactatgccaggcagaaactcctcaaaaactaggaaaagtcccagcaacaaagccactagcatgaatcccattaacaatggtagaatcaaacgcccctgagttcgcggcagtatatgcatcaacacgccactaactggtaacaaatggaccatcgtaaacagactgccagccaacaaaacgacgccagcaatgccaagggaaaaccgccaccatgtttgcggtttgggagcggccgagacatcctgctggcgaataaaattacgcaatgggttttgaacataaatggcattgatgctgcccactaataggtagacaacgcccattaaaatcacgacatcaaccatagctgggaaagagagcatcaaactaatcggtgtgtgcaaggccatcaatcgaatcagcaccatgcccaataaaggtgagataatcaatccgagtaagagacccagagccattccgaatataccgatcattaaactctcaatacagactaacaatcctaatttggccccagacaaaccaagcaaacgatatagcccaatttctcgatcacgacgagcaatgagtaaagtgttgaaataaagcaaaaaactgatcgcaaaaagtgctaagaccatcatcacaatcatcaatagaatcggaacaatatccagatccccaagccgcttgctggcatcgctcaaaatcggttcattattcgcaaccgccccaatggcatacataacggcactgatcaatgctgccactagtacctgcaagccatcctcgtgacaatggcgccgtaaatttgtcttaatcagatgccacacgggtatggcctcctccactgacagttgcttccatatcaataattcggtcaaaaaactgctggcgggacttaccacgcgttacttcagcaaaaaatgccccatctttgatgaagatgatgcgacttgcgaagctcgcggtgaagggatcatgcgtcaccatcaatatcgtggttttttctttttcgtttaattgacgcagatagtttaaaaaatcagttgctgctaatgaatcgaggctgccagtcggttcatctgccaacaaaagatcgggttgggtgatcacagcgcgagcagccgcgacgcgttgtcgttgtcccatacttaactcccccggaaaagcctgcagaatgggagttaagttaaggtgattcgcgactgtctgtaatcgttcagcacgatcaggctgaagctcttgctgcaaggttagcggcaacaaaacattttgcgtcaccgtcatatcatccaataagttgaagtcttgaaacacaaaaccaagatgatctcgacgaaaagccgcttgttgtcgttcattaagggcctcaagatcgttccctgcaatattgacttttccggtacttggcgtctcaatcgttgctaaaatattgagcaatgttgactttccggcgccacttggtcccataatgccgacgaactcacccgcgttgacctgaaagctaaggtcgttcaaagcgcgaactcgatcatgccgttgtccaaaaatcttgctcaagttagatacttcaagaattgccatcgcgcacctccgccattatcataccaaaaacgtgttatgcatgtgctgccaactcccgttagacaaagaatctcgggtttgttgctcttagtttacattttaaagtaaatcctgaaaacttatttattagaagattgcggcttcctaaaagccggacaaacccagctcataaaaactggtcttattgaccttgttcgcgcttgtgcttccttcccaaaacttataccattagagcagaaatggagttggtcacgtgtttaaaatcatgatcgtagaggacgatcagacgattagtgggctgatcgctgataacttaaaaaaatggcaatttgatccagttgtggtaaccgattttaatgctgtatttgatgactttttgcaagaaaaaccccatttagtcttattggatattaatctaccagtttttgacggctattattgggttcaaaaaatccgtgaagtatcaaaggtccctgtgattttcatttctagtcgtaacacgaatatggatatggtcatggcaatgaatatgggcgctgacgactttttgaataagccgtttgccatggaagtgttgatcgcaaaaatcaacgccttgcttcgacgaacctacaattatgctgatcaaggaaccgatgttttggaacacaacggcttgatgttgaacctcaaaaacggtatggcacaaattggcgaaaacgaaattaacctgtcaaaaaatgaatataaactgttacaaatcttgatccggcaacacggtcaaatcgtcagccgttcccggttattaaaggacttatggcaagacgagcgatttgttgatgacaatacacttaccgtcaacattaatcgcctgcgcaaaaaaatcgaggaagctgggttgaaagattatattcaaaccaaggttggacaaggttacatcgttccttaggaggctggcagatgcggtttcgtgattatttaaaggatcatttaagcccgattggtggctatattctttgtgttggtctggcggccttgatcatctggcttgacccgcagcatcgcgttaaggccatgacgctttggtacgctgtgttgttagtgacactattggccagcgcttttttgatcgcacggtattggcgcgtacggcggttcgcagctcggcttcaggaacggatcgatgctcaggaggctgcgttagattggcccttgcctggcggtgaatccgcaaccgaacaacttgtgacgaaaacgtacaatcaaattttgacccagcatcgccaacaagtaactgccctgctagcacaacagcaagatcaaaaagacttcattgattcttgggtgcacgaaatcaaagtaccgctcgcggcagtgacgttgctggccgaaagttttgaggggcaagtacctgatgacaaactggataatttgaatctgcaattggatcaaatcgaattttatgtcgagcaagtcttgtattactcgcgtctcgacagcttttcaaaggattatttgctgcatgagacatcattgcgcccgctcatcaatgacgtagtcgccaaccagcggaacggctttatcaataaacgactatctttcagactgaatggcaccgatcaaatcgtattgacagacaacaagtggcttcgctttattcttgctcagctcatctccaatgcggtcaaatatacgccagaaggaggccgaatcacggctctcattcgtaacaccgggaaggaaacgcaactacagattactgataccggtatcggcatccccaaagatgagcaacatcgtgtttttgagaagggattcacgggcagtaatgggcgcctttcgaatcataagtcaacgggattaggcttgttcttggctgaaaagttagctgaaaaacttggccatcacttgtcgttaacctcggtaatcaatcaaggtaccacggtcacaatccattttccttacgtgagctattatggtgaggccgatcaaactgtgcaccatcctgaatcccacgcgattgctgtgcaaacccagactaggtcacatccagacagctgacgaataagatagcatcaagtagttgaatcaaccctagatctcaaaattgagagccacctattcaaccaaatcggcaccagaggcaagcagcctctgatgccgattttttaatagattatcttatcgtccttcgaattgcctgaacgaactaacgaatcagatttttccacaacttgacttcgccagccgccattgttgctagtacgtcaatgatgcgctggttagcactgccacgaaactgtaaggtcagatccttttgcgccaacaaaaagcgaccgtcaaccaaaatatcgatcaattttagcaactcaagtttatcgtctgaatcctgaatcaattcatcatacgtatagccgctccagctccaaatgtctttctcatgcccgaattcttgacgaattcgtttgcacaagcgaatgcagacttgcgtgttgaggaaaggctcgccgcctaacagcgtcagaccctgtacgtaactttgactaagatcggtcatgatttgatcctcaagttcttgtgtataaggtttaccataacgaaaattttgtgcaacccgattgtagcaaccagggcaagcgaaacggcaaccggagacatataaactacaccgaaccccttcgccgtcaacaaagttaaacggtttgtaatcggcgatgcgttgctgtgaaagctcactggcaagccattctttaggtttgggattttggggtaatttattttcgatcatatgtctgccttccttgagggtgtgccaacccacgtggtgtcacgcacccagctgtttagtcttgtgaatccacttttttcatcgtatcacgtttcacccccaagatgtagtatcagttgtacacaaaatgccggcctgtcatctatatcttgacgccaggccggcattctctgatgctatacgtcatacacgtgacttattaagcgcgctttaagtgcagtgtcattgcattcaaagccacaacaatcgttgacaacgacatgatcgcagcaccgaccgcaggactgagaatgaagccaacgggggcaagaatccctgcagcaagcggaatcgccagaatattgtaaccagcaccccaccaaaggttttgaaccattttccggttagttgcttttgccaatgacaagaagttgagaatatcggccgggtcactatgaactaagacaacatcggcggtatcaatcgcgacatccgtcccagctccaattgcaacaccgatgtctgcttgagccaaactaggcgcatcgttgaccccgtcaccaaccatcatgacaacgccatgctgttgataagccttcacttgcgcaactttgtcttcaggttttaactctgcctgaaattccgtcagaccaagctgaccggccactttcttagcagtttcatggttatcaccagtcagcatcacaggcgtaatcccctgctgtttcaactcggcaacaaatgccttactggaagacttcaactgatcgccttcagccaccatgcccaaaacgtgctgacctttcagcaaaaaggctaacgaatttccggcagcagcccactgatcagcctgggttttatcgtaggtcaactgatgatcctgtaaatatcgggcattcacaatctcatactgaatgccgtcgactgtgcctgacagcccgacacccttcatgacctgaacattttcagcagctggcactgttagcttttgctcaattgctgccgctttaatcccagttgcaagcggatgctcggaatgactttccaaggcggccatggttgctagaatttcttcctgactctgatcagcaaaatgcaacgttgtggcaaccgtaaacttgccttcagtcagcgtccctgtcttatccattagcatgtacttggctcgcttggctgtttcaagcgcttggcgattgcgaatcaacaacccattcgtggcgccaatactggtactccgagcaatgacaagcggaatcgccaaccctaatgcatgtggacaagcaataatgaagacggtgaccatccgttcaaaagcggtggccaggccgcttggcatccagagaataaacgccagaataccaatagctaacgcggcatagaacaaccagccggcaactttgtcggccatgccctcggccttacttttatttgcttgcgcactttgtacaagcttcattacttgggctaaatagccgctttcaccagtacctgtcacttggatttcaatgaccccatctccgttgatggaaccaccaataactttatcaccgcctgccttacgaacagccttggcttcgcctgtgacaagcgattcattgacactactgctgccgcttacgatttcgccatcagctggcatttgttcaccagccaaaacccgtaatcgcgtgccaacctgaacctctgacaatggcatatccatcacactgtcgccatgaaccacatgcgcctgatttggcaataatgcagccaatttttcaaccgcattaccagccgccatcacagcattcatttcaatccagtgacccagcaacatgatcacaattaaagtggccagttcccagaagaagtccatcaccatagcatgtggcgcgataaagtgattcatgacgaaagcataaagcgagtaaccgtacgcaacggtgatccccattgcaatcaaagtcatcattgcgggctggcgactttgcaactctgatttagcgccggtcaaaaatggccaaccgccatagaagaatagaaatgacgaaagaatcaggacaagccaatcagacccaggaaaaactattggcaattgcaaaacgccgaggtggatatccatccccatgaactgcgaaagcaacaacacgggtatcatgacgatcaaactcacccaaaacttttgcttgagatttcccatatgcatcatgtgacccccgccatgatccatcgagccgtgatccatatgcatgtgcatgtgatccatcgcgccgtgattcatgtgcatctgatccattgctgcatgatccattgaacccggttccatctgcatcttcgccatgccagcatgctcttcttcagagtcgtgatccatgtgcatgtggtccatatcgccatggtgacccatcgccatatgatcgtggttcatttgatcttttttgtcagtctgtgatcttttcgtatcgttcatcgctttcatttcatcgtcattcatgtgcagcctccttacaaccttctggtaaacaattacaactaactgttttcggcgcatcgtgctgcttcgctaaaagcgtttgttgcaagatctcaatatcatgtttcgaaagggtgacgttcgtcatcaagtgattgatggccgtgccgattttcatttgacaaaggtggctaaataattccgccacggcggcatccatagactcttgttcacccactgcagtgtgataaagaaattcacgtccatttttttcagtggttaaggcgccttttttgactaaccgtcctaaaaaggttttggtcgttgccactttccagcccattttttcagcaagaattgttgcaagcgtgctacttgtcagtggaccaagtgtccagataattcgcataacctcccattcagactgggaaatttcaactttcggtgtttccatcgcttgcctccgtttacatctgtaatctatcaacacctttaatttacaactgtaaaccataaaagtcaaccgcagtttcttgagcgcacaaaaataccccggctagccagccgaggcgcgattgtattcattcacttttacagtgtgtggaacccaatatcagtgcgataatccaaaacgccttgaattttctccatggctgtttttgccgctttaacggcatccggcaaagactccgccccagctactacggagaagattctaccagcatgactttcccagccgtggtcacttttcgccactcctgctggaagccaagttccctctggccaatctgtcggcacaatgacgggaactgtcttgagcgcgctgctcgggtacgcaggattaacggcaacaaagcaagcataggccttatcgctcaacgtcaaactaggttggcggtttgctaataagtcgctaatcagttgataaaaatcatttgtgatttgcggcagcaggacttgcgtttctggatcgccaaaacgcatgttatattccaaaatcttcggtccgtcaggtgtgaagatcagtccaatgtacatgaccccttgaccatctaagccatcagcctgcatgccctttaacgttgcatccacaagctgatgggcagcggctacttgatcatcgttaaattgcggtaacggactaatcgcccccattccgcctgtattaggaccacgatcattggcaaaacgccgcttgtgatcctgagaaagcggcagaatgacacgcttttcgccattaaacaaggccatgacagaggcttcttcacccgcaagatattgctcaagtagcaccgttgcatctggagaatcggcatacattttttcgatcgtttcatccagcgtttcagcatcttgggcaatagcgacgccttttccggctgccaaaccgtcctttttcaagactagtggcaagcccattgtcgcggcttcggcatgggcatcaatagcattgtgaaccgtcttgctgccggcagtcggcaactgatggcgcgccataaaatccttggcaaacgttttgctggcctctaactgggcaactttcttggtgacgccaaaaatcggttgatcagctgcctgaaaagcatcgacaatcccagcggctaacggcacttcgggacccacaaaagtcagatcaatttggtgggtctcagcaaagtcaatcaacttggtaaagtcattgtcatcaatgttgatcggatcaactcccagcaaggtcattgccggattacctggcgccacatagacatgatcaacttgcggagactgtttgaattttaaagcaagggcactttcccgggcgccgccgccaatgatcaaaacctgtttcatcgtaacctcctagtgtatttgctggtggggaagctttataaacgcgcctgtttttctcttaaatgcgctcataggcgcggaaacctatacatcagaaccttgaagctatctggccaaaacccagccagttcacctcaagaccacttatgctccggtttctaaacgcgcctgttcacgctcttctttttaatgtctaaaatgacggacaccagttgtcaccatcgcaataccgtactggttagccttttctatagaatctttgtcccgaatactgccgcctggttggatgatggctttgatatcatgcttagccgcgtaatcaacgcagtcgtccattgggaagaaggcatcactggccatgacggcgccagcaaagttgtcgttttgttgggcctgggtgagggctaactcaaccgaaccaatccgattcatttgtcctgccccaatgcctaacgtctgatcagcttgggcaacaacgatcgcattactcttcacgtgtttgacgactgtttgcgcaaaagcaagtgccttgagctgctcgtctgtgggtttcaccgttgtcacaacagtcaaatcagccggtgtttctgtctgattgtcccgcgtttgaatcagtaacccgccataaattgctgtcgtctctgttcctaattcagccggcgtatcagctgtattgattgtaagcagccggacgtttttctttttggccaacacagcataagcatcatcatcaaatgccggtgccataatgatttcaagaaaaagtttgtgcattttttcggcagttgctagatctacaggccgattcaaggcgatgatgccaccaaaaatcgacatcggatcagcagcataggctttgtcccaagcgccttcaatggtttttccaagaccaatgccacaaggattcatatgtttgacagccacaaccgctggctcggaaaattcacgaagcatcgctagcgcagcatcagcatctttgatgttgttataggacagttctttaccgtgcaactgtttggcagcggcaaggctagttggattcggatcaggttcaacgtaaaacgcagcttgctgatggctattttcaccatagcgcaaatcttggcgctttgtgtaggtcggtgtgaagtgctcgggaaatggctcaggatcaagataatgcacaatttgagcatcataagccgctgtgatagcaaagaccttagcagccagcttttgacgcagatgagcatcgtcttggtcaaggccggttaaaacagcctcgtaatcggccggatcaacgactgcccagacactgtcgctatttttagctgctgcacgtaaggcagaagggccaccgatatcgatttgttcgatagcttctgcccttgtaacatctgggcgtttgattgtggcggcaaacggatagagattgacacaaaccaaatcgaccggttgaatgtcgtggtcagctaacgcttccatatgggctggatcatcgcggcgtgcaagaatgccagcatgaatctttggatgcagtgtcttcacccgaccatcgagcatctcgggaaaaccagtcgcctcttcaacgctggtcaccgcaataccggccgcagccagttcgcgatgcgtgccgccggttgagactaattcaaatcctcgatcaatcaaacctttggcaaaagagaccaaacctgttttatccgaaacacttaacaatgcacgcttcacttaaatcgctccttcttgaatgaggttcttcacagttgcagggaaaatttgatgttcttggcgatggatcgcctgctcaagctcggctaagctcataccatcagtgatattgactggcacttgggcgataatctcgccggtgtcaatgccagcatccacaaaatgcaccgtgacgccggtgactttcaccccgtagtcgaaagcatcctgaataccttggcgccctggaaaactaggtagtaaagctggatgcaagttgatgatttttttagggaatgcccttaaaagggttggcccgatgatacgcatgtaaccggccaaaatcaaggcagatactggcggtaactgttctaagatggccgtctctgccgccgttttattaggatagcttttaaaatcaactacgatcgtcaaaatgttgcgtgcggcagccttttgaatcaccggcgcctgtgattgatcacaaaccagtgcggcgatgcgataaccgctatctggttgatcagcggcatttgccaacgcctcaaagttggtgccatgaccagatgcaaaaacagctagatctttcatcgacgactcacctgccagtgcagcttttcgacaggatcttcgccaaccgtgccaatcactttactactaggaatcgcgtcttgaacaagactaaccgcttgttctggcacgacaaggatcatgccaattccaagattgaaggtactacgcatcgttgtttcacttaaatgtccggcatgttgcaaacgatcgaacaactctggccgttgccatgctagcggatcaatgtttgctaccaaaccgtcagggatcacccgcggcaagttttcagtgatgccgccgccggtaatgtgggcagccgcgtgaatcaatccttgctgcatgagcggcaacacctccttcacataaatccgagttggccgcatcagcgcattcagcatttccgatccgtcatcaagcgattgactgcctaagtcggtttctgccagcagcttacgcaccattgaataaccattgctatgcacacctgaacttggcagaccaatcaaaacatcgccagccgccactttttgcggcaggcgttttgaagcggaaaccaaaccaactgcgaaaccggccaagtcgtaatgatgttgtgggtacatgtcgggcatttccgctgtttcgccaccaattaatgccatctgagcctgctgacacccataagcaattccgcgaacaacggcttcagtgcggtcaacatccaaatgatccaccgccatataatcaaggaaaaaaagtggctgggcgcctgacgccaataaatcgttcgcaaccatggcgactaaatcaatcccaacggtttcatgcgcgtcacattgcaatgccaacagcaacttggtaccaacgccatccgtggcgctgatcaaggttggctccgaaatctccggcaaccgataagctgcggcaaacccgccaacactggctaacacattggcattcgttgtttcttttgccaacgccgcgattcgttgaacagctgcttcgccagcttcaatatccacgccggcgtctttataatcagtcatgcactaacctccgcaacattgactttgagggatgccacttccttatccaaggcaaaggcataatcatctaacggtgctgggtactggccggtgaaataagcgacacacaaaccgccattaggtgccgtggccgataagccgacactctcttccagcccctgggttgaaaggaatccaagcgactcgaccgctaaaagatcccgcatttcagcaacgctatgattcgcagcaaaaagttcgctggtcgtctgaaaatcaatcccgtaaaaacaaggaaagcgcaacggtgggctggcaatacgtaaatggacctcagctgcgccagcctctttcaacaacttcacgatttgtttggaagtcgttccacgaacaatcgaatcatcgactaaaacaattcgcttaccggcaacaactggtttgatcacactgagcttcattttgacgcttttttcccgcaatgcttgtgtcggttggataaaggttcgcgccacatactgacttttcattaaacccatctcataagggattccactggccttcgcgtaaccaatggcagcagacagcgatgaatttggcacgccgacgacaatatccgcttccgccggttgttcttttgctaaccgttcacccatccgtacacgggcctgatggacattaatgccgtgaatatccgaatcggggcgggcaaagtagatgtattccatcgaacaaactgctaattgggtattcgtggtgaaatgatcaatgtgcaaaccagcatcatcaattgtgattaattcccctggctggacatcacggacgaattcagcgccaaccgcgtccaaagccgctgtttcgctgcacacaatatagccgccatctgacaacaccccgacaaccatcggccgaaagccatacggatcaactgcggcatataaaccatgttccgtcagtaagacaaacgcaaaaccaccgtgaacttcatttaaagcggtcttcaactgtgtcagccaaggctggccaacttgccgtcggattaaatgcatcaaaacttccgtatcggaggtggactgaaaaattgcgccttgatcttccaactgccgccgcaaactgatcgcattggtcagattgccattatgcgccaaggcaatggcttcatccgaaaaccggaaaagcaacggctgaatattttccagcacgcgtccccctgctgtcgagtagcgcacgtggcccaaggcggcgcgtccgattaatggcgtcaattgatcggtattcgtgaaaacttcgctcagtaaccccaacccataatgccgccgcatcccgtctttggtcagcccaacaataccggcgccttcttgaccgcggtgctgtagtgtgtgtaacccaagatgcgtgatgctggcggcattaggattaccccaaacaccgaaaaccccgcattcttcatttaagccttttggttcatgtggcatgggagcgcctcctcgaatgctgtctgtagctgttgcaacgatgcagaaaaatgttgattaacggttgtgacttcaaattctggtgcggcctgaactcgaccaatcaattgggccggaccatgcaatgcttcaaatgctgcctgattttcaggggccaccgtgagcaagaagcggccttgcgtctcggaaaatccccaagcagttggcaatgtgacgttaatctgggcgccaagttgggcatcaaaccccatctctgccaaggcgaccaataacccaccatcgcttaaatcgtgcgctgcagtaattagatgctcacgaatggccttcaaaacaaagtgctgatgctgcttttcagcctctaaatcaaaatcgaacagcttgccagtgacttctcctgtttgcagcttctgcagttcgctgccgttaaaatcaccatgagtctcccccaccagataaatcagatcatctgcttgcttgaaagccgccgtggtaatcgtgctcaaatcctcaatcaagccaaccatgccaatcattggggttggatagatcgcctcaccattcgtttcgttatacagcgacacatttcctgaaataactggggcgttaaaggctttggtagccgcaatgattcccttcgccgcctcagccagttcgtagaaggcctcaggcttagttgggtcgccaaaattgagacaatcggtgatcccaagcggttccgccccgctagcaaccaaattgcgcgcagcttcagccacactcattgccgcacccacctgcggatcaagatacaagtaacggcccttactatcggtggtcatcgccagtgctcggtgagtaccgcgaatccgagtcacggctgcatcactgcctggcaagacgacggtattagtttgcacctgagcatcgtaacgcttgtacaaagatgacttgtcagcaatcgtcggcatcgccatcatgtccgtccatatttgcaccggatcagtgatgatagggtcaaaatccgcagccggttgggccagtcgttttggcattttcccttgttgatgataaatcggcgcatcatcggtcaacgaactcacaggcacatcgcaaaccaatttgccatggtgataaagctgatactgatgaccagcaatcacatgaccaacaatcgccgcatccaaatcataatcagcgaaaacagccaaaacttcttgctcaaagccggcccgaacgcacagcagcatccgttcctgagactcagacaacataatttcaaacggcgtcatttcggtctcacgctgcggaatcaggtcgagatctaacaccatcccgctgttagccttaccagccatctccacgcttgacgataccaatccagctgcacccatatcttgaataccaacaagcgcctcctgatgatgcccggtaatttcgagacaagcatccatcaacagcttttccatgaagggatcgccaacttgaaccgccgagcgatcggctgcttcttcgtcagaaaaatccccagaagcaaagctcgcaccgttaataccatcacgccctgttttggccccgacataaatcaaagcattgccaacaccagcagctttacctttttgaatttgatctttgtccatgatgccaacgcacatggcattgaccagcggatttcgggtatagctcccgtcaaagtttgtttcgccgccaactgtcggaatgccaattgcattgccataaccgccaatccccgcgacgatccgatcaaccaaatgttgggtatgtggctgttcaatgtcgccaaaagctagcgagtccaacatcgcaaccggcttggcaccaattgagaaaatgtcgcggataatgccgcccacacctgttgctgcgccttcataaggttcaactgccgagggatgattatgactttcggctttgaagaccactgctttgccttcgccgatatcaatcacgccagcaccttcacctggccccattaacacgcgctcatttttggtccaaaattggcgtaacaccggcttgctatatttgtaagcgcagtgttcgctccacatcccgctagctaacccgatctcggtatcgtttggctgatggccgattagttctgcaaaacgatcatattcagcctctgtcagcccaaggtctaaataaggtttctgggttgcaatagcctcggggctcatctcaacgtgcaccacgtacatcggctccttccgtttggttaatcagcgattggaatacgcccaagccatccgtaccgcccagcagtgcttcaacagcccgttccggatggggcatcatgcctaacacattaccagtctcattggtcacaccggcaatatcgtgcatgctgccattagggttatttgcataacggaaaaccacttggccattagtttccagagccgccaacgtttccggatctgcgtaataattgccttcaccatgagcaatcggtaatgtcaaatgttcaccaacttggtattgatttgaaaacgccgtcccggcattttctaccgtcaatgcaactggttcacagatgaagttcaagtcgcgattccattgcaaggcgccgggaagcaaaccggcttcggtcaaaatctggaaaccgttgcaaatgccaatgacatagccgccagccgcagcaaactgctttagggcagccatcactggtgaaaagcgtgcaatcgcaccactgcgtaagtaatcaccataggaaaaaccgcctggcaccatcacaacatcataagcagtcaagtcggtttgagttggcttgatcaagtcacactcggctccagcaatggcacgcaccgcccattgcaaatcaagatcacagttcgagcccggaaaagaaatcacagccgctttcatgcgttaacctccgccatcggttctagctcaaagcgataagtttccatgttgacattagccagtaattggtcgcagatcgtatcgacttgcttgcgaacttccgcttcgctgcctgctaacgttaattcaaagtacttgccatacaatacatcttcaacattgtgataagccattcgtcccaaagcagttttaatgacctcggctttgggatccagcacggaaggtttgtaggttacgtaaattttagctttaaacatgagcagctcctttttcttgcaggcgtgaaaggacttcttcataaaccggggtcaatggtccacggttttgtcggaaaacatctttatcgagcgatgccccggtttgttgatcaactaagcgaaaattatccggagacaattcatcagccagtaccaaggtgccatccttgagcgtgccgtattcgagtttgaaatcaactaaggtgatcccaatcgccgcaaaccgttgcgtcaaataagtattgatgcgatcagttaaagcgtgcacttgcttgagttgttcaggcgtagcttcgtgcaaggcgaaaatttgggcttcattcatgaacgggtcgccaagttcatcagacttgtaatagtattcgtggattggcgggtcgagcttcatcatcggcttaacattgaacttggtgacaaaatgaccggatgcataattacgcacaactacttcaagcggcaacatcgcggcttttttgacgatcatcgtcgtgctgtccggcgaatcaagataatgcgttggtataccggcagctgtcaattccttaaatagcaacgtcgaaatcgctcgatttaattcgcctttgtgggcaatctgggcttttttctcgccatttaatgctgtggcttgattggtgtatgccatccacaacacatcaggatcatcggttgcataaacctgttttgccttgccggtatacaataatgttgttttgttcaccatgctgcctccatttgtttaagtatgtccaacacattacgatcatcagttaccgtaagatgacccattttgcgaccggagcgaatctcggctttaccataatcatgcatgtgccattcaggatgctgaggccacttctgcttggcaatggttaaatcgtcgccgagcaggttgcgcataaccgctggctgcttcaatgtaatcggcggtatcggtaagccacaaatactcaaaatatgtgcatcgaattgtgaaaagttgcatgcctcaatcgagtagtgtccggaattgtgcggacgcggagccaactcattggccaccacattgtccccttcgataaagagctcaacgcccaacacaccacgaagatccaggccaagcgcaattttagtcgcgagatcatcaatctttttggctaacaccggcgaaatgttcggtgcaggcgcaagcgtgagatgcaaaacatggtgctgatggcgattctcaacgatcggaaaaacacgcacttgatcgcggccatcacgtgtcatcataacggagacttcacgatcaaattgctgccgtttttcgagaatgcaaggaccatgcgtcaaaagttcgcgggcggcgggaaaatcatctggtgtattgatatcttgctgaccatggccatcataaccgccagtggtcgtcttcaggatgcttggcaagccgatggtcgcgactgcttgtgccaactcagcggcacggttgacagcggcaaaaggcgtcaccggtaccccatgtgtctttaaaaaagtcttttctttgatccgatcgcgggttatcgccaaaatggcggtgccttgaggaatccgcgtctcgctgcgaaccgcctccaacgcggctaagtcaacgttttcaaactcatacgtcagcacatctgacgcatcagccagttgctttaaggcggcttgatcgttatagggcgcagtgatttgaaaatccgctacctgaccggctggcgaattgggtgtcggctctaaaataccgacgcgataacccatcgacttggcgctttgtgtcagcatgcgtcccaactgaccgccgccaatgatgccaattgttgctggggacgtcactacatcaatcattgaagcgcggcctcgctttctttggcacgcttagtttgagcatcgcgaaaagcttgcagtcggtcagccagttctgaatcgttcagcgctaaaatagcggcagcgaacaacgccgcattgacagctccggcatcaccgatggccatcgtgccaaccgggaccccgccaggcatttgcacgattgacaggagactatcaaccccatttaatgttcgtgttttgatgggaaccccgataactggcagcaatgtattagcggcgagcattccaggtaaatgagcagcgccgcctgcaccggcgataattgcaccaaaccccagtgccactgcctgtttaccaaaatccgccagctcgtctggcatccgatgagccgaaataacccgcttctcataaggaatagccaatgacgttaactgagccgtcacttgctgcatggtcggccaatcagaggttgaccccatgaccactgctactttttgcatctcgttccccgctttctttaagatgttttgagaatagcacgtcagcgcgacagattcaataaaaatgagaacaattctcaatgttatattaataatcgttcgcgtttatcttttaaaatcttaacccgtcagcttttcaatgtctgaaatcacatctgtgttgctaatattccttttgacaacttattgcagtcgccatcgccaaagactgccgcccgcgcacaaaaaaacgcacatcacagagcgatgtgcgttcatcagatatgcgttgttgaagtcttaaacttaggcagccttcgttgaaaatgatttgccgtccttagcaacaaagagttgcggggcaacggttagcaatacaccaacaacaacaattgttaagacggtgctgaataacgctgatccaccattgacgatcaacgagtatacccagacattcgttcctttaggcgcatacgcaccccagaaaacaacgccagcgatgaaatggataaagtatttagcaaacgtgccgataataataccagcaaaggcatagccgctcgccttcactttttcactaccgcgcactgccttttggaaagatgcaaacgtcaaccccattaaaccgaccaaggtaaacgcaatcggatattcaagaataccttgtaaaggattcaagacactgccaccgccaataccacgcaaaatcagatccaaaatcccccagacaaagcctgcccatgctgcaggaactaacccacgccgcatagccaaaacagcaattggaatcagaccataattcagttcaattgccgaaacacccgtggtatgtggaatataagttaatgccatcgcaaaagctgcaatgatcgcagtttccaaaatgacaacaagttgcttgtgctgttgcataaaaaaagcctcctagtgagtccccgttcacaaagaaggtcgcttccgaccattcacaaatccctacgctcgcattaacgaacaggttcgaagggtccgggtttccccgttctcagccaatggctcccctttgtgaaggttcatcgaattgttgatacacctttatggtatcaaactttttgtaaagcgcaactttttggtcttgaacaaatcgcttgtcattaatgatttaagcgggctttctcctctcggtgcaaagtttcgagggagcgtccagccgtttccggcacaaaaatcagaacgaacaacaatgaaatcaaatttgtcccgatgaagcaaacgaatgtccagaacatgcctatttgggccagaccaaccgggaacagaacgccaacaccaaagttagctaaccacaagcagaaagttgcagcgcccatccctataccccgaacctgttcagggaagatttcagacatcagcagccaagtcattggactgatagcgccttggaagaacgccaagaacagcatcatcatcccgattgtcgcaaatgcccggaatgacgaacccgctggtagtcgactagcgaaggtgacaccagtaatcgccacggttgagccaatcaatcccacaatcagcattggccgccgcggaacatgcttcaacaattgcaacgtcacaatcgttgcagcaacggcagtaaccccattggcaatgttggcgatcaaggcactatctcgcccaaaacccgtcatttgtaaaattgaggtgccataatacatcatgacattgataccagcaatttgctgaatgacgcctaggccgatgccaatcagaaccagtcggcgaatccatttggttttcaatgctcgaacactcgcctgcttatgtttagcatcttcggcaagattctgtttcaaatggtcaatctctgctggcacttcagcagcagatcgcaacacttccaaacttgaccgtgctgctgccggccgtcctttcatcattaaccaacgaggagattccggaacaaaataagtcccgatacctaagataattgccggaatgactgccaatacaatcatccagcgccagataccaggaacgttaccaaaagtagttcctaaaaaggcattgagaacaaaagcaagtaactggccagtcacgaccatcagctcattttgtgtgactaaccgcccacgatgactcgttggggcaatctctgctaaaaagctcggaaccagcacagagacgccaccaacggctaatccaaggatcagtcgtgcgccaatcagccagccagcactcggggaaagtgacgaggctaccgttgccagaaaaaataagcccgctaacatggtgatgagccgcctgcgcccatagcgatcacttaaacgaccgactaagatggcaccaaaagcagcacccagcgtcaaactactggtgacccaaccctgtgatccaggggcaagtttcagttccgaagaaataaaaggcaatgcgccattgatcaccccagtgtcatagccaaaaagcaggccacccatcgttgaaatcaaagctactagccgcaaccgtgtcttcgcactcgcaaggtgaccggtaaatcgatgattgtgtgtttttgattgatacatgcaattccccctacaagtccaaatgaaccaccgctcacagtgtcataccatgaatcagtaactcaatttttagtttacataataaccttaacacttttctgaaaagtctgcagtcagtcactgttcagatgccgacgaatagtcgcgcaatcacctttttgcatggcaaagataaagtcccattttcgagcgggtttcagaaaaatcaatgctagcgagcccgatcaaaatcaaattttggtcaaaaaaagaagccgtcaacttattcagtcaatagcctctttctgataatgaaagtttatttctgaccagttgttttcttaaccagatcagcgttttcatcattagtgatattttggttcagagcaatttcgtccatcttagccatatcagctgtcgaaagcttcttcatcaagctgcgtactttaaggacagaagttgcggacattgagtattcgtcaagacccataccaagcaacagtggtaccatgattggatcaccagcagcttcgccacacataccggcccacttgccttccttatgtgccgaatcaatcacatgcttgattaggcgaaggatggatgggttgtatggctgatacaggtaggaaacatgctcgttcccacgatcagcggccatagagtactggatcaagtcatttgtaccaatggagaagaagtcaacatacttagcaaactgatcagccaaaactgcagctgcaggaatttcgatcataatgccaagttggatatcatcagatactttgacgccatccttgactaacttatctttttcttcagtgaaaatctgctttgcttgcttgaattcagcaatggtagcaatcatagggaacatgatccgcagattgccaaaggcagatgcacgcaacaaggcgcgcaactgtgtccggaagatatcttggcgatcaagactgatccgaatcgcacgataacccaagaatgggttctgttcttcaggaagcggcaaatatggcagatgtttatccccaccaatatccatcgtccgaacaacaacaggcttcggactcatcgtttcgacaaccttcttgtaggcctcgaattgatcgtcttcagttggtaattcagcagaatccatgtacaagaactctgtccgatacaaaccgataccttcagcaccgtttgccagcacaccatcaagatcctttggcgtgccaatgttggcagcaacatcaaagtgtttgccatcagctgtgattgatttggccgtcttcaaaagagcccattcagctttttgcttagcaaatgcttcagcatcctgcttgaacttagctacttcatcatcggtcggatcaacaacaacttcaccagttaagccatcaacggaaataagatcaccgttattagccttcttggtaatgtcatctgtcccaacaacagccggaatttccaacgaacgtgccataatcgcactgtgcgcagtccgaccgccaatatccgtgacaaatgctttgacatacttcttattcaattgtgcggtatccgaaggggtcaggtcatgcgcaaccacaacgacttcttcatcaattaatgctggatttggcaaattgcgaccgagcaagtgtgccatgatccgctttgtcacgtcgcggacatcagccgcacgttcctgcatatatggattgtcggtcataccttcgaatgtcttaataaagaattcggagacttctttcaaagcctgctcagcattgactttttcatccttgatcttagtctctacctgaccagtaaagtcaggatcagccaaaatcatcatgtgcgcatcaaaaacctgagcctcttcttcgccaagcgattcagcggcctttgctcgaataacctttaactcatcattactttgatcaagtgactgcttcaggcgatcgatttcctttgaaggatcatcaaccgtctttttttggaatgacaaatcaggttgaaccagtaaataggccttcgctgtggcgatcccatcactagcagcgattcccttcaaatgttcagccattattcagccaagccttcctttttcattgtgtctgtaatagcagcgatagcatcagcctcgtctgcaccttcagcagaaatggtaacatcggcaccttggccaacacccaaactcatgacgcccatgatagacttcaagttaacgctcttacccttgtattccaagttgatatctgagttgaacttgcttgctgcctgtaccaacaaggttgccggacgtgcgtggatcccggtttctgcaataatattaaattcgcgtttttccatgactgatctgctccttcgtattaactagatttctagtttttttccgaatagtttgtgtgcgcattcgtacccaaaacaattcatgtaaaccttaccattttttgaagcttgtcacaagcgccacatcagatttggcgcctatattaacgagaatcaactgatcgataatggtattcaatgacaccatcacgtttagccattcccacgatctcttcacgatcaggataattcgtccatgccgcgcgaaacgccatgaacgtttctggcgtcaccgtgattttgtcccgctgaccagtctttaactcatctattaaagcgacgtaatcctgagtcatctatttgcctcacctcacctaataagagtagcataaaagctggtaaggaaaaagcgcaagtgcttgctgtcactgaaatttttgcaactttttagcactcttagtggcagagtgcttgcattccagaaatgtgggtgtatactattgccataggtcaagaaaggtcaaaccttttttgactgcacgtggcacctaaacagataggaaggttgtgacaaaatgctgtgtgaaaactgtcataagaatccagccactattcatctttcaaccgttgttaatggcactcgacaggaaattaatctctgccaaaactgttatcaattactcaagaaccaagcaggaggaaatatgagaccaactgatgcaaccgatccatttggtttcggcagcttagatgatattttccgtgcgatgaatcagggaatggatcaaccgcaacaaccaaatgctcagaccccgccaactcaggcaggccgtggcggcaatggtaataacggccgcaatggcaaccgtggcaagggactgctgggacaattcggcgttgatctgactgaacaagcacggaatggtcaaattgatccggtcattggtcgtgacaaagaaatttcacgggtgatcgagatcttaaaccgccgaacaaaaaataatccagtcctgattggtgaagccggtgtcggcaagactgctgttgttgagggcttggcattgaagatcgctaatggcgatgttccgtcaaaacttcaagatcggcatgtcatccgactcgatgtcgtttcactagttcaaggaactggcattcgcggtcaattcgaacaacgtatgcaacaattgattgacgaacttaaaaagaataagaacattatcttatttattgatgaaatccatgaaatcgtcggcgctggcaatgctgaaggcggtatggatgccggcaatgttctgaagccagcattagcacgtggcgagttgcagctcgttggtgccactactagcaatgaatatcgtcaaattgaaaaagattcagcccttgctcgtcgtctgcaaccagtcctcgttgaggagccaactgtagaagagacgattaagattctaaaaggcctgcagccgcggtatcaagattttcatcatgttaaatatacagatgccgccattgaagcagctgcaactttgagcaatcgttacattcaagatcgtttcttgcctgacaaagcgattgaccttctggatgaatcaggttcccggaagaatctgaccattgccactgtcgatccagaaacgatcaagaccaagattgacgacgccgagaagcaaaagcaagctgctctgaagcaggaggattacgaaaaagctgccttctatcgtgaccaagttactaagttagaagatatggctaagaaacagtctaatctgcctgaaaatgaaattccgactgtcaccgaaaaagatatggaacagattgttgaagaaaaaaccaacattccagttggtgaactgaaggcgcaggagcaagcacagctgaagaatctggctggtgaccttgaaaagcatgtcattggtcagaatgaagcagttgataaagttgctcgcgctattcgtcgtaaccggatcggctttaacaagtccggtcggccgattgggtccttcctattcgtcggcccaacaggtgtcggcaaaactgaactggctaaacagcttgccaaagagctgtttggttctgaagacgccatgatccggtttgatatgtcggagtacatggagaaattcagtgtctccaagcttatcgggtcaccgccaggctatgtcggctatgaggaagccggtcaattaactgaaaaagttcgccgaaatccttatagcctcatcttgttagatgaaattgaaaaagcccatccagatgtgatgaatatgttcttgcagatcttggatgacggccgattgactgattctcaaggccgtaccgtttccttcaaggacacgatcattatcatgacatccaatgctggctcaaccgatgccgaagcaaacgttggttttggcgcagctttaagtggtaagacgcacagtgtgctggatcagcttggtaattacttcaagcctgaattcctgaaccgttttgatgacatcgttgaattcaagtcattgtctaaagacgacttgttgaagattgtgtcactgatgattcaagataccaacaataacatcaaggatcagggcttgacgattcatgttaccgatccggttaaggaaaagctggttaatctcggttacaatcctgccatgggagctcggccgctgcgtcgagtcattcaggaacagattgaagaccgcgttgctgacttctaccttgaccatccaaaggctaaggaacttgaagcccgcatcagtaatggtgagattacggttggtgaacctgccaaggctgaaaccactcaaaaatctaaaaagtaatttgttttaagaaagccctcgaacttcattgcgttcgagggctttcaattcacatattattattttccgttaaactgttttataataaaaacagtagggagagaaatggagggcatgagcatgcgactgattaacgtgaccaacagtttcagaaatctagtaagccaacaattgagtggtaccgatgcccggctggtcaaggtcttctcacttggccaaacgacagttgtttatacggaggcaccttcccatatcgaacttcttttcaccaatgagcgccgcaatattcagcgtgcggaaattgctctcacactcgaacggcttttgcaaaaggacattggcgatgtttcgccgattatgggtcatcatctggcagaagtgactgttcccaagcttgagcggcaagcagagtaacccgaagaaggatagtgccatgcttgccaataccaatgagatttttgcacattgctagattaataggcgcacacaaaaagcgactgacattgctcagccgctttttgtgtgccacgatactcatacccaagcaccctattacattttggcagttaatttaacgtcaggatacttgtctgcaaaccagcgttcagcgtattgattctcaaataggaacaacgggtcgccgtggatatcctgaaccaataagttccgggaactgctcatcttttcatccaattgatctggattgatccagcgagccgttcgcgagccaatcggggtcataatcacttctgaatgatattcatgcagcatccggaattggaaaacttcaaattgaagttgcccgactgctcctagaatataatcattcgtgttataggtcttgtaaagctggactgccccttcctggacaagctgctgcatccccttatgaaatgatttttgcttcatcacattcttcggcgtaacgcgaacaaataattcaggggtgaactgcggtaatttttcaaattgaatcggttccttgccttgataaatggtatcgccaatttgaaaattaccggtatcatacaacccaacaatatcaccggcaaccgcagttgaaaccgtttcacgggtgtcagccataaattcggttgagttattcagtcgcatcgttttgccggttcgatgaaggatgacatccatcccccgttcaaattcacctgaaacaattcggacaaaagcgatgcgatcgcgatgagcagggttcatgtttgcctgaatcttaaagacaaatgcggaaagctctgggttagtcggattcacttccccgccttgttctgttttcttcggtcccggttcgggtgcatattgaacgaagctattcaaaaatgtctcaacgccaaagttagtcaacgccgatccgaagaacactggtgtttgctcaccagccatgatctttttcaaattaaactggttgcccgcgtcattcaataattcgatatcatctaatgtttgcgtataaatcgaatcctgcgtcaatggttgacttggatcaagctgaccttggtcattcaacggcaaaaatcgatcatcaccttcacgccgataaagctcgattcgctgattcactcgatcgtagagacccttgagtcccttacccataccaatcggccagttcatcgcatagccttcgatacccagcaagtcttcaagttcagcaatcaaatccaatggttcgcgaccatcacgatccaacttattcatgaatgtaaaaatcgggataccacgttgtttgacaactttgaacagtttcttggtctgagcttcaatcccctttgccgagtcgatgaccatgactgcggcatcaaccgccatcaaggtccgataggtatcttcagaaaaatcttcatgcccaggggtgtccagaatattaatgcgtttgccctgataattgaattgcatcacagagctggtaaccgaaataccacgtttcttttcgatttccatccagtccgatttcgcaaaatgtccggattttcggcctttaactgttccagcctcgcggatcacgccgccaaacaataaaagctgttccgtaatcgttgttttcccagcatctggatgtgaaataatcgcaaatgtgcggcgttttgcgacttcttttgctagttcctgtggtttcatcgtgctttccttccaaaattgacaaaatttgctaacaacgttgcctatttacacagactgcatcgctagctatcggcctcgtgggaggcttcttctggttctgatgatagatgaacatgaacattgacgagtcgtgacccttcaactttgccggtcgccaataacacacctggtgccagctgcattttttcgctgtgatgcgatgaaggaatggcaccgagttgcgtcagaacataacccgcaatcgtgtcaacatccggtgcatccaaatcagttttaaacaaatcattgaagtccgaaatcggcatccgccctgagacaacgaaatcatggtccccttgtttcgtgaacaatttttcaacctgatccgattcgtcatcaatttcaccgacgatttcctcaagcaagtcttcaatggtcacgatgccgacaacgccaccatattcatccaataagatcgccatttgttgttgcttcacttgcatttcagtcaacaaatcatcgactgtaatggtttcgggaacaaaaaccggcgcggtcatgaccgattcgattttaacatgatcaaagccgacgcggcgtgcttcctttagcagattcttgatgtgaacaatgccaaccacgtgatctttgtcttcttcataaaccggaattcgtgaatagatattgttcaaaatcgcgtcaatcgccgtgtgatcaggttcttgcgcatcaaccataaaagcatccgttcgcggcaccatgacctcgcgcgccatcgtatcggacaacgatataattccctcaaacatttgatactcatcgggatcaatcgccccagaatttcgaccactttcgatcatggaaaccatttcgtcacgggtcacggtttccccttcatgattgaattccatcggcgtcagtttcattaacaacttggttgaagcagaaagcagccaaacaaacggacgcatcactttggctagccaactgatcggggtcacactcattttagcaacccgctctgtcatttgtaacgctacctgtttgggatataattcgccaaaaattaacgaaaaataagacaagatcagcgtgactaagatgaccgctgcctcatgcgcaaatgaccagccgccaaaaattggtgcaacccgatctgccagcgttgttgcggccgaagcagacgcaaagaaaccggcaaaagtgatcccgacttggattgttgccagaaaattactcgaatccttcatgatggtcacaagcttggcggccttacgatcgcctttatccgcctgcgccttcatacgagtacgggaacttgaaaccacggcaatctccgccgcggcaaatcctgcattgattaaggtcaaaatcacaatgaggatcaattgtccccatatctgaccgtctgggtcactgcccatgcaaaaacacaacctttcgtaaaaaaaacggggaatcatccccgcttcgttcgattgtttcagtataccaagtctttatttatttttcaattgtggatcggcttgatccttgatctgatgagcttctccagcattttcctcatcactgtcagcatcctcgtcatgcttatgttcctgatggaaacgataaagctcgtataagtatgtcacaactgttttgatgacagcatatgtcggtacagctagaatggtgcctaacaatccccatagattgcctgcaaccatcagcaaaataatgatggttaaaggatgaatgtccagtgagcggccgatcacattcggataaataaaattaccatccgtcatctggataatgacgacaacgacaacaacgagtagcatctttgtccatccctcagtggcagcaattgccaaagctggtgcaataccaatatagggtcccaaatacggaataatggtaacgatccccgcaataaagcctaagagatacgcatacggcatgccaataatcagataaccaataaaagtaaaagtgccaacgaataaacattcaatggcctgcccgccaatatagtgagacagtgtcgagtttaaacgcgtaaaaacagttgcaacctcttcgtgataccgatgaggcaacatcttttgaatacttggcacaaagttttcaccgtctttgagaaagtaaaatagcatcaccgggattgtaatgatactgatcatcatgctggctactgatccgataaccgttggcaagccggtggaaaaaccgcccagaactttgctcaacaccttgcttggcgaaatttgaagactggcaacatatttgccaatatttagccgctgataccaagtatagtgtgacgccttactaatgaataaccggacgccttttaagaaatccggaatattcgtaacaaactgagtgacctgatagatcaagtttggcagtacggccatgaataccagaaccaaggcaccgatgaccaccaagaaaatcaataaaatcgaaatattgcgactgatgtggaacttctgcaataatttaacaatcggattgaagagatagaacaaaaacccagcagataaaatcggaatgagtagcgttgagaaaaaagtcgccacaggtgcaaacaagaacgaaacctgtgtcaacccgatgaccacaaaaatcaaaatcagaatttcaacggaccaaaacattaattttgaatgccgtaacctatcaaacatattcgacctccccagcagcattttactagtgctataatagcaaacaatttattaaaacggaaagaaggttcaacttttggaagtcaaaacgacaacaaccctcgattcacagattcatcaagacagcgtccagattcgcacccacgttttcgtggaagagcaacatgtgccaccagagctcgaagtcgacgccgatgaagcaaaggcgacctattttgtcatttacgatgcaggtgtgcctgttgctacggcgcgcattctgcctgagggcgacgcctaccacgttcagcgtgttgcagtcgaaaaagcctatcgcaagcatggccttggtaagatggtgtttgaagcaatcatgacttatgcccgcgcccagcaaattcaagcgctatgcttaggtgcgcaagttcaggcgattggcttttacaaagccctcggttttcaattgaccgatcgccctgaatttcttgatgccggcatccgccaccgtgaaatgatactcaagctggcttgacgatcattcaaatttatcagcttcacttgattaaaccatgagtatgtgagaaaaatgcgatcccaacacgaagatatcgggatcgcatcaattcaacaagcaggctaatcccctgcttgtttttatttttcatgcaccttactcatactcatccacaccttttaactgatgaggatcaatatatagacgataagccacttgatgaaccgcgccatcttgaatcagatagctttcaagataataaggatgatctgtttgcccgagtctttctggcaaaggataccctgccttttcaatgatttgcagacccttattaaagcttgttgcaagtggtaattgtttcaacagcacacttgtagctggctgcctgacctgaccagccgttgcttcaggtaggcgaaacgcttcataaggtttgggaaccgctgcatcagccggtaacaagctgccgatccaatataaaaaggtgtcatatggcgaaaagacaaccatcgccgatcgattgggtatctcggctaaatcatcgagcgttttaaacccaagttgcgcctcaaagtcttgccacgctggttgaaatgtaccaagctgatcactgttttcgacggtataggcatgacccgcaaaaagttgagcaggttgttttggaatttgtttcatttttgcctccaagtttgaccggttgggctagatccggtgcgctaactgaatgtaacgacggtaccataaatcgacataggcttgtgaaaagggtcctttgccgtggttgatccaatcgacaagcaccttcacattagtttttaaaatccgatcagtggttgcaggatactgccaaagtttgcgatgggcctcgtattcatccacatccagcaaccgtttttcaccatcggcaaacaccttgacgtctaagtcatagtcaatatattttaaagcttcttgatccatcgtgtacggagtggccagattgcagtaatacgacacgccgccttcacggatcatcgcaatcacattgaaccagtaatgcttatgaaagaaaatgatcgccggttcccgcgtcagccaacggcgtccgtccgactccgtcaccaaggtgtgatcattgcacccgatcagggcatcttcactggttttcaagaccatcgtgtcacgccaggtgcgatgcagactaccgtcatgtttataactttgaatagcgaacgagtcgccttctttagggatccgcatacaaaacccgctttcttggaaatttcgttcttcattatagcagagcatggacaggcgcgcttagaaactagcaagcgtgtgaaacagcccgataaaaatccggtgtataagccagcctcatgtgtgatagccagactttgttcatttgtgcctgaggttgacttattgcagcagtgaacgcttttcagcaagagtcggcagcttacaagggcatgcaaaaggatagcttgatctttcaaaaaaccacgatcaactttccgccaagtcgtttagcacttcatcaatagcttccacatcaaagcctttacgaaacaaagttgttttaactttttgtttgcgctcccgatcaccatatttcgcttttagacgccattgtttggctgcctccagcttaagcaagtcgctttctgcctcaggatcgggttgcgggtcgatggttgcgatagctgtttggatagtagtgtcatcgaatcccttttgcattaaagcgactctgagacgttgcagttggtctttataagcgcgatgctggtggtgccgaagattcttctgaccagcgcgaacagccgcatctagccatgctgttgttggaatagcagctaactcattggccaacaagtctggcttgaggcctttttgttgtagcttatgttgcagcgttcgcggcccaagttcacccattttcagatgctcttcaatgtaacgatgcgcataatctgcatcatccaaaaagcccagatcggtcagacgcgtcagcaccttttgaatcacatcagccggtaagtcttctttagctaaccgatcactgacctctttgctcgtgcgactttggtggctaatgtaggtcagcccgatctctagtcccatcgcggtgacttcactgctcttgatttgggcaatggtctctgctgtcaataccattcctttggccaagcggtaatccaccagcgtggtttcactcaccggaaatgcgtaagtcccgtcaataaaaatattatagcgcccacgccttttttgggcggttatctttgtaatttcactcatgaacccctgtcacctctctaatcacgttgccattctatgttatactttttataaataaatttggaggctcgttatgtttgaagccagtttctttgaccggcacagcttaattaattatcaactattccgggcaatgaagaccctacaacagacgacaatgtcgatcaatacgcttagccgcaatactgggctttcgtattcgcagacttatacggcatttcagaccgttttagcacagctcaaccaaatcttacctgacaaaaagattgacgaatcaagcttcgcagcagttttgcctgatgtttcgattgatcgttatcggttctcgctattaaaaaacagtctaccatttgaatttttcgatggggttttcaagaatccgcattcggactttcacgccttcaagcagcaccatcaaacaagtatttcaacgttacggcgccgaatttcgccgtttcgagactacttagctgacaatggtgtcacgctaaatagtactacttgggccattgaaggcgatgaattgcatatacgcttagccatgttcaccttctttacattagcctatcgcggggcaggatggccattttcaagtgcagaagagcgggaaccaaaagcacttctcaaggtaatcaaccaaacaaaacaggctttcttggtgtcaccaatccaaccaatgtccaaagaagctttactgattctcgccattcagatgttacgaatcaactgtgggcacgcccttttaccaaatcggcgaatgcagctgttgtttgacggtgaaactgaattgccagatttgatttttacgccagactactttcccaatttatctgcttctgaattaaaagcagaaaaacagtattactatttttcgcgtatgtattttatgaccgtcactcggcaaccacatcaaattgattatcagatcatgacccattttcaaagtaaagataacttagtgaatcgatttgtgcgacatctggtcacttctttgaataaccaattaaaagaaaccaaaagtcagttaattgccgaaaatcaagtcatgatagccaatctttaccgattaagtttcaccgagtatgtgctgaatggtcattttagtcagaggcttgattttgcttcgacattgcatgacgaagcacgaacaagccaattgacggccaaaattcgcgactgtttgaaacgaattcccaaaatggcgcctgagtcaatctacgcagactttacaagccaatttattaatggtctctatatattagtcaatgataattatcctgaactcaatcgtgacatgcaaatggtcgttaacgttttgattgaacatgattctttcgtcaaacgggatctcttaaactttttaaacgatttaggctttattcgcgttgtgcctccaaccgaggcgatcaatcctgatttgatcattacaacgctgacaaagccaaaacgggtgatcccttgcatgggccacccgtttgatccaactgttcccttgatcacttggtccaaggaacccagcgatcaagactattttcacctttttcaacgcttaaaacgcctacagcgcgagcaacgaacagcagccgatacgaatcagactcgtcagtgaatcggttttgccgtgtagccgacaaagtagactagggcttcatacccggcaagtcccaaaatgaccgctgcaattagaatcgtttgactgaagttgcgattaaaccaaagaaagactaccatcgcaaacatcacaacaaaataggcattttgtaggctgcgattgatttgaatttcaaattgggcatccggactttgatagtcaatcgtgtggatcgcattaaaccgaccaactttataagtaatcttatcgccgcgttgcacctttaagtctagcgtctcgccaactcgtatcgtatgcggcgtgtcattttgccacaccgttgctgtcatttttctactcatcgtattcgaataattgattttcacattaaatcctcccgatgattcattatactaaacattcttaagcctcgtcaccatttctcaaagcaaaggagcatttcatggcagtcactgtcaaaatcggtcagcgttttcccctgaccatcaagcgtctagacattaatggcgcaggtatcggttattatcaacggaaaattacgtttgttaccggtgcactacctcaagaggtcgtcgtcgcagaggttactgggattcacgaccgttatcttgaggccaaagttcataaaattcggacggcgtcaccaaatcgcgtaaccccggcagaaccgctatttggacaaatcggcggggtcgaactcaatcatctcgcttatccggcgcaattgcgatttaagcgagatgtcgtcgcacaatcgcttgccaaatttaaaccgactggccggacccattatgatttgcggccgacgattggcatggcacaaccaacgcactatcgaaacaaggcccaatttcctgttcgggtcattgatggtcacgtacgcgcaggtctttatgctccaaactcacatcatctcatccctttaaccaagtttctgacccaagcaccgctgacaatgaaagtcgtgacaaccttgtgtcagattctcgaacagcttcagatcccgatctataacgagaaaaagcgctccggaattgtcaaaacattggttgttcgcgaatcatttgcaacgaaagaagtccaggtcacgttcatcacgaacagtccaaaattaccgcacgaaggcgaattgctcaatggcatcgccactcagcttcccatggtggtcagcatcgcccagaatatcaatcctggcgaaacatccttaatttggggcaaagaaagtcgcctgctggcaggtctcccttatatccaagaaacactgttaggccggacttttcaactctcaccacaagcatttctccaactgaacccaaaacaaacagagacactttatacattggccgcaaaagcacttgatttagggccgcacgacaccttaattgatgcgtactgtgggatcggaacagtcggcatcagtttagcaaaaggcaatcaacctatttacggaatggacaccattgcggaaggcattgccgatgccaaggcaaatgctaaagcaaatggcctcaccaatgcccattattcagtgggcaaggctgaagacatttttccaaaatgggttcaggaaggcatgaaaccagacgcggtcatcgttgacccgccacgagctggactagagcgtgccttcatcgacgccctccttgaactcgatccacccaaatttgtctacatttcctgcaacccttccaccttggcccgtgatctcgttttcctcactaaacgctacaaagtcgactggattcaaagcatcgacatgtttccacaaacagcacgatgcgaagcagtggtaaaatttacaagagcgtgaacagctgcgtttaggaaccgtaacataagcggcctcaagctgtaaccagccgggctttggctggttacggcttgaggtccttatgtgcaggtttctgcggctgtgaacgcgtttcaaaaagagcgtgaacagccgcgtttagaagccgagccatatacggccgtttagtttcaaggtctgtatgtgtcagattttgcgactgtgaacgcgtttcatcaggccaccacttcacggcaccccacctaaaccaacaatcccgcaaactacagacgaggtcttaaaaaatgaaaatttactttgctaacgccttgttcagtcatgctgattttaattacaatgcgcaactcgctgcccaaattcgccgcgccttaccagatgttgacatgtatgtgcctcaagaaaatgccgcgatcaacaacaaagaggcatacgccgattcgaaaatgattgccgaagccgacaccaagcggctgctgtcagctgatttgatgattgccattctcgatggccccgtgatcgataacggggtcgctagtgaaatcggcgttgcctatgctgctaagattcctattttgggtctttacacggacagtcgacggttaggcgccgccaatcaacaaaaactcggtgctttgcaacaagttgcagaaaaccagtttcactatctcaatctgtataccactggtttaattaaacttaacggcgccattttaactgatgaggatagcttgatcgccagtatcaaatcccgtgcttaaatccgattctagtgacatgtaaaaaagcttgctaatatgttagcaggcttttttacatgtcactatcagccgaattaagaaaattaatgcattttcttaagcataaaaaatttggttttacgaaagtcataaaagattttcgaaaacgcaaataattttccagaacttagatacgaatcgtcacgaacaactaaacttggacttccgtctgcaatcccaaagaatttggctggtaagccagaaatcatttcacactcaattacagagtcaatgaatccaactttcagaccaggcttttgatcaataaaagcaaatagggacccctttaatgcactattcggaatgttgtccacaatcgatcttaaataatacgagtgttctactaagaacggttgaccgtctagtgttcgttgccgggtcaccgaaattaatgtcgtctcattcggcaatttctggctttcaggcaaaaaatctgcctgatctagcgtaatgacttgttgatgaattgccgttgttttaacaactcgtccctgtctcgccatttcttccgtcaacccaacgttattttgaagcgatatggccccctcaacgtggtgtgggcgagcaaaagtgccgctaccatgtgcctgataaatgtagcccaaattggcaagatcttttaaggcttgtcgtaacgtgtaacgagtgacttgatattgacgcatcaattccggctcagcaggtagttgaccatcttcatcttgaatagcaccttgttgaatcgccttgattaattgattctcgagtgttttaatatcatagctactttcccgctgagacaatttatttccgcctttcaactttgcttccaagctcagtcatttcatgttattataccgccatttactgttccggactagctccacgtccccagtaaaaaaaacgcccttcgaaaggcgtttttttgactacatgcattttcatgctaggcgagatcatccccgttactacgaatcactttttgaaaccaatcaaaagaggcttttttgcttcgtgcaagtgtgcctttaccttgatcatctttatcaacataaatcacgccataacgtttttccatttgaccggttcccgccgaaaccaaatcaataatgccccacggtgtataacccatcagcttgacaccatcgacctcaaccgcaagtcgcatctgattaatatgttgacgtaaataatcgattcgatagtcgtcttgaatatggccatcctgattgatcttatcaaatgccccaaaaccgttttcgacaataaataagggtacctcatatcgatcactaaaccagttgagtgcataacgcaacccgactggatcaatctcccaaccccagtctgaacgttgaagcgtcgaattcttaacctctcgattgtgtcccatggtaataaagtctgtaggttcatcttgtgaggcttcagtgacatgggaagcatagtaagaaaatccaatataatcgactttcccagctaataaaacatcacgatcttcaagtgtgatgtccaagttaaacgcatgtcgatcaaaataacgatccaaaaatgcaggatacttgccctttacttggacatctgccagataataattagtctgcatcgttcgctcagctttaaacacatcatttggattcggtgttgcgggataaacaggacccatcgcaaccatacagccaatttgaaaatcggggttaatccgatgcccaatttggactgccaaggcacttgcaacggcctcataatgagcggcttgaaacatgactgcttctttatcttcatcaggcttgatcagtagcccagaattggtgaacagagaccattcattcatcatgccaacctgattattgatttcgttaaaagtcatccaatatttaactttgtctttgtaccgatcaaacacaacagtcgcaaatttgacgaagaaatcaatcaccttacgactacgccaaccaccatattttttgacaaggtgataaggcatttcaaaatgtgacaaggtaatcactggttcaatctgatgcgataaaagatcatcaaacacgtcatcataaaatttcagccctgcttcgttcggctgttcttcatcaccattcgggaaaattctagtccaagctatgcttgtccgaaaacagttcaagcctaaatcagcaaagagctgatcatcttcatgatagcgatgataataatcaatagcatcatgattgggataattctcgcctgattgaacaccgtctgtaattctgcgtttagtttcattatcgcctgcggtcatcacatcagcaatgctgacccctttaccgcctgcttgccacccaccttcgaattgatgagcagcgactgcgccgccccacaagaaacctttaggaaatgctgtcaaaataatcctccttatttagtcctcgaaccatttacaattggtctgccgcttcttaagccgccgcctccgctgcaccttttgcctgctcatctttatatagtttgccatcatagaacttaataaatgggaaccaaatcaggaaggctacaagcgcacaaacgaaagctaaaacaattgctcgccaatcgcctgccgtgccgatgaaccctgaaagaccaagtggtgttggccatgccggctgtgcaatcatcggtttaacccaatgcattgaaattgcgaagtaagccatactcatggatgccatcggtgctaagaagaatggaatcgctgtatatggattataaacaactggcataccgaaaagaattggttcgttaatgttgaagaaagctggaacaacagatgccttgcctaatgcaccaagctgtgccgattttgcaaagaaggcgataaaaataaccattccaagcgtagcgcctgatccacctatagtcacaaaacagttattaaattctccggcaaatgggatgtttgcccccttctgattcaactgcatattggagagaacaattggggtaaggaacgaggtcacaatcgttgcgccgtgaatgccaacgatccaaagcgcatgcatgataaagtagacgaccattagtcctacccatgtactggtcaggttagtaacaaaaccaaacggaatagcaacaatcttatagatatcggtgttgaatgccatcaaaataccattaatgataatgacagttaaggcaatcgcagcggtcggaatcaaagctgtaaaggaacgtgaaacaccagctgggacggtatccggcatactgaccacaatattctttttaacaaaccacgcataaagttttactgcaataatcgacatgataatggccgtaaagataccagtcgttcccagccgagttaccccacctgcgatggcataaccatctataatcttgttgtccttggtgatttcggtgaccaaggtcgctgtcccacctttaaagactaattcaggtatacacataaaaaacgccatcatagaaagcaatgcaccatttagaggattaatatcaattttttcttcctgagcctgaatgcgagtatattcataaccaaaaactaaacagaaataaagtgctaaaatgcccatggtcgcgccattggcaagcatatacaaatttgcaaccttatcaaaagaacccttccaaataccgactaatgccggaaaactttgggggagaacattaataattaaaaacattgatccaacgatggtaaatggaatggatgccattccggcagccatgactccgcgaacgattctgaacgaggcaagttttcccattggtcccatcaaatgattgttcataaatttaaacaatttattattacttgaatccatagttttgtctccttgtttgagctcattgtattctttgagcaaatttatttatttgttgtaaataccgatcctgatttttttcaatcaaacggatacgcactaagagataaaaacatatgcctagaccaattaacagaacagtcgttgccagagataaacccttttgtcctaaaaatggaaacagttttgtcccagatccagcgacaattatggataagctcaggaaattgcttattaactgaactacataaccgaacttagtaaatggtaacttgctatctcttcgccagtacttacttacttgttcaaccgctaccactgcatttataacggtcaaacaaaacggtacccatttcatcgcgccctgtgtgcccaaactaagaaaaaaccaatataaatttgcaaagaaaaaaccggcggtcacgtaacggattaataaatagcgattaaagtacatactagttaagcttaattctctccgactcttgtcatatcttgctttattttgatctgacatgcgtgtcacattcctttcgcttagacttatttcgtagctaactttttatagaggtcaacgatttcccctgctaagtctcgaaatgtgattgcattcataacatgatcctgtccgtgcaccatcaataatgatactggatgttttttcccttgagcttcttcggttaacatacctgtttgtgcattatgtgcatctgacagaaagctgtctgcctctttcagttttgcttctgcggtagaaaaatcaccgacttttgcagctttaattgcctcaaaagaagatccttttgcatttcctccggccataattagctgcatgatcactagttgctcttgctcgttcatcctgacctcctactgctcgtcaatcagcttaagcgccgtttttagaacattttcgcctttcattaagccgtaatcctgcatattgatcacttgaactgggatactaagatcctttttgaaatctccctctaaataacgcacttgtggtccaagcatcaggacatctggcttttctgaatctaacttgtcatgggcatctgaagccgaagtagcaaagatttttgcttcaataccatctttggtcgctgcatcttccatttttttgactaacatactggttgacatacctgctgcacaaactaacataattgtcttcttacccattagtttttcctcgctttcaaaatttcaaagttattgttcaccacagaatgactttttaatatcagcatactcgctagcttaacgagccatatcagaagtcattcgaatgactattcgttcgaacgacttttataataccaagaaatcgctttcttgtaaacgatttcttgaactttttgaaattttgtctctacgccttatcgcaaaaggccggcaactgataatgaagacttcaaatagcgataagcaaaaaaaagccttccagcaaggcatattaattgctggaaagctttataatttatattttaagtcaaccagttaagcatttgttaccggtttctccgcatcttccaataactgtcggaatggaatcagactttctgcatgatatttcttcacaaaagcatccacagcagcaggatcctgagtttgcttgtccaaaacaagttgttcaaccggaattggacgaagatcagaaatcttcacatcaatgacaaccggacccttacgatcttttgccttagcaaatgcggctttcaattcgtccagattgtgcacttcaaatccttgagcacctaacgcttcagctgccttaccataatcggcatcaattaaatcaaccccggagtgcggctgttgcgtgtcatcctgttcagcttcaataaagcccaaactctcattcgtcaaaacaacgttgatgattggcatatgatatttgacctgtgtcagaatatcctgcatgaccatggcaaatccaccatcaccagaaattgaccaaacttgccgatcggggaattccgcttgcgcaccaatcgctgctggcaaggcataacccattgtcgcataccagccagacgtcgtgaacacttgatcatcattggtcttcagataacgcatcccattgatggtaacattgccaacgtctacttggaaaatggcatctttttcggccatctcattgatcaatttgaagattggttcaacgcgcagtggcgtggagccatcatcttcaaatgaagtcatccactcgcgccaattttccttgttggccagagcagcccgataccaagcgctttctggcaattgatcagccttttcgctcagtgccttgatgaacttcttagcatcggccaaaacagctaagtcaaccgtgtgacgacggccaaacttgctaccgtcaatatcaacctgaatgtatttagcatttggtgctataaagtatggctggaatgggaaatccgatcccaagaacaagacggtgtcagcaccgcgcgcaacttcaacgccaggtttagaagccacacggccggccgagcccatgtttgccttataatcatcaggcacgattcccttagccaaggcagtcgtgatgatcggaatatgcgttttttctgagaaagcgatgatctcgtcgcgcgcaccccgcgcgccatttccaacatacaagattggcttcttcgcatctttcaagatatcccaagctgcggcaacctgatccgggtctggatcaggcaaaagcggcttctggtacagattggctgatgatacataattgtcatcaatctgggtccaacctaaatcctttggaatagtcacaacggcaaccccgttatgcttataagcctgacgaatcgcctcgtcaacaacatgaggcaattgctcagcagtcatggctgtacggttgtatacagacacatcagcaaacattgggttctcgttcatttcttggaaataattggtgttcatggcagcagttggtacttgccctaccaatgccaaaactggcacattatcatactgtgcgtcatacaacccattcagaagatgaacagcaccaggaccggcagaaccaaacgtcgccccgattcgacccgttaccttagcttcacctgcagcagccaatgcgcctacttcttcatggcgaacctgaacataattaatggtgtgacggcgattgtacagcgcattcatggtactatcaaaggaaccgcccggtaacccataaatattatggataccccagtcttcgagcaccttgatcattgcgtctgcggcgtttattttttctgtcatgacacttgcctccaatattattacttacattttgtaagttctttacgattacgagtataacaatttattgataacaatgcaagccctttcatctggtttaagcaaccttaacgcccaaattgcgaccttagcgtataaaacgcttaaactagcaagcgacgacaccataacagtcaaacaagtgaactaatacagcatcaccacgccataacatgcttggtaaatctttttcacaaattaacttcatgatgatcaggatcatggatcaaaaaacaggaccgtcgagggacggtcctgttcatcatcttattagctgtcaagcattaccgctgctgatattgacgttcttgaccgatcacaccggtcaaaacaaactgaccatgataataagtcggatcactacgataatcttctggatcataaggcaccttatcgctgaaaacagcttcgtattcaggaacggttaattcctgacgatcagccaacattttagcgtgattggctgcatgcagttgtgcggcaaaatccggttgcaagatgccgctaaaaaattctgccacggccccggagccatacgagaataaaccgatccggtcacccgctttcaagctagtatcattgtccaacaacgacagcagacccaaatacaaagaaccggtataaatattgccaactcgccggcagtaccgagtgcttgcctcaaagcgccgttgcagtcgctcgccagtggcttcatctgtgtccggcagaacaagctttaaagctttcttgcccattttggtatacggtaaatggaatgtcatcgcagcaaaatcacttgctgtgtgatggcgttgggtctggtatcgtgaccaaattgcttgaaaaaaagctaaatattgttccgttgaatactttccttgtgcaattgctgtgtcttgataaaccggccgccaaaaatcgtcaatagattcagaccgataaaccgaatcgtcttcaatggtcatgatgtgcggctctgctttgattaacatggcaaccgcgcccgcaccttgtgtgacttctcctgctgttgccaaaccgtaccgggcgatatccgcagcaatgactaaaacggttttatctgggtgagcggcgatgtagtcacgcgccatcattagtgcggcagtaccgccataacaagcttcctttaactcaacggcccgcacccactcagggagtgccaataaatcatgaataaacaatgcagacgatttactggcatcaacaccactttcagtaccaaccaagaccatgcccaagctagcgcgaatcgctggcgtcaacaactttgtcgctgcattcgcacccatcgtgacaatgtcttggctagaaggtggtaccgcttgctcgtcttggccaatgccaatcgtatatttgtccggatcatcacctcgaacctgcgcgagttttactaaatcaacgtagaaatctggggtgtccatagcgattgcatcaatcccaattttcatcttttgattggcctactttcttgtttaaacgaatggttgttaaatattgttgcgcatgttttaaatccatactaccttgacgaagtgcgttcacaagcatcggcaattctgtttctgttgccccggcagcaatggcgagggcattagcttgcaacttcatgtgaccagcttgaatccccggtccagccaatgctcgcatcgcagcaagattttgcaccaacccgagggcggcaataacttgctgcatgatagctaaattctgatacccaccgagccgacggacaacctgcgccattggtaaagcaccgatcgccccgccaactgcccccatcggcaagggcagctgtaagtgaccaactaaatggccctgatccatataccagcgcgataaaggctgatacctgccagacgcacatgcaaatgcaccgatacttgctgcgacagcgcgggtatcattgccagtagccaatacagcaccaataataccgttaagaatgcccttgttgtgggtcactgcccgctcagcatcgacaaaggctaaatcgctaagctgaacaattttcttagcaatcacatctccagaaacagctttcgtcgctaaagaaaccggctcaagcgaaacctcagccgtcacgagttctgttggcgcgttggttagaatactgacaagcacatcaccgtctacccagcttgtcaccgccgctgcgaccgcttcggcaactgtattcgcataattggcccccattgcctgttgcggatcgagcgttaaacggattttcaagaactgcgctcctagtgattcgactgttaactgatcaagaccaccgccacgttgaatcatcgaaggatgcgcaaccgcaatgactttctgaatatcagtctgatgagccaaaatcgtttgccttgcttgcactaagtcggtcaagttagtcaggactacttcagcgaccactcgatgcgccgctacatgggtcctaacgccgccgtttgcagtcgcaagcctggccccattactggcagctgcaatcacagaaggttcctcatccgctataggcacttgatgtagctgtccattgaccaacaaattgcgagcaacgcctaggggtaaaggaaactcgccgatagcattttcgatcagacgcgctcctgtgatttcaggcaagctatgcgtaccagctaacaacgcagcatcctgtgttgttaaccacccttcttgaaccaattggtcacgccgtttttctggagacaactcgtaaaatttcatcacgatctccctcagacatgcatcgcgatttgcatggcgataccgatgccaccgccaacgcacaatgcggcaatgccttggcgttgattacgttcagccagatcgtacaataatgagattaaaattcgggcacctgaagctcccaatggatgacccaacgctaaggcgccaccattgatattgaattgttcatcctttaaaccaaggtcacgagccacagcaacgctttgtgaggcaaatgcttcattcaattcaatttgatcaattgccgcgatagagccgccggttgcctgcagtattttatcgatcgccagttttggcgcataccccataattgccggatcaatacccacctcggcaaaaccagtgatcgtcgctaaataatggagccccagttgttcggctttcgattttgccatcaggatcaaggcggctgcgccatcattaatgccgcttgcgttacctgctgtaacagtaccgccgacttcaaaaacaggcggtaattgggctaatttagccaatgacgtatcgggccgaatggctgaatcacgatctacgatgacatccccgtgacgggcagcaatcgtcactggggcgatctgactcttaaaccgaccctcagctgcggcggccgcggcgcgtaaatgcgaacggagagcaaactcatcttgctcctgacgactgacgttaaattgtgtcgccacattttccgccgtgattcccattggctgttgactgaaggcatcatttaatccatcgcgactcaaaccgtcaaccagcgttgtatcgccaaatttgtggcctgaacgaaccgcttcggcgtaataaggtacttgactcatgctttcggtaccgcccacaagcaccgcgtcagcctcgccgagttgaatggcagcttgcccaagccgcactgccttcaggcctgagccacagacttcattgacagtcatcgccgtgctgctagtggccataccgctttttaatccgatttgtcgggcaacattctgcccagaaccagcctgcatgacattaccaaagatcgcctggttgagtaacgctgggtcaattcgtgcagccttaatcgccgcctgcgctgccgcaacccctaaatcaacggcactggcgccagccaaatcaccacccaacttaccaatcggcgtccgtttggcacttagaatcacaacttcttccatgatgacctcctaaagagcgtgaacagccaaccggcgcataatcaagaacgagggcaatggccgagccattgttctcgtggttctgatgtgccggtttctgtggctatgaacgcgtttcgacaagcatatgctgagataaaccgtttcagtttatcacagtcgttcagatgacgcactgatataataagagcgtgagccaacccggtcacaccgacttttgggttggcgatcgcctaaaaacgctactcatctccgtttactaaatagattgtatgcgattgttccccaaagcaacaaccatcttgaccaatccttaatgaatcatttcgaaagaaggctacctcatgcgtgtcaccgatttgctggctttactagccgatcaaaataaaaacgcctcggtgttactcgacacaaagccgacaccaagtcgttttgacgattttaagttaacaaccgttaatgatcaaccgcaactggtctttcagcctaatcctgagcgcaaagccgcattgcgcgtttgggaattgcaactcttactgaaccaacctgatttacagcaacgattcgtttatctagctgatgttgatgaaccgcgtgcgttatttggatttgttaaacggcaaattggcttgctgctcaattgattacgctggatgtttggtcgcagctaaccgtttagcaacgctttccaaataatgatgactttcaatcatttcccgacaatcaaactgatcctttaagccaatttcataaatccgactcgcatcttgattcaatagtggcaagacccgcgcccaatcaatccgtccgcggccaagcggtaaactatcatgcgtttgccccatggaatcaacaagatgatagtgccgaatcagcggcttcagatgcgctaggctggccatgagccgatcattatcgccatgtaacacaataaatgtatgactggtatcataggctaaaggtaaatgccagcgcaacaaacggtcttcaaaggtgggatcaccatatcggaaaatcggtgacatggaattttcaaacacgacatggcccggtgcttcctgagcaaaagcaatcatgcgcgccaaggcaatgtcttgtgctttgcccacatctgtccagccagcataatcaccaggcgtgtcaacgcggtatccgccgtgaatcaaagccgtggcgttagcttttttggcaaagttcatgagtttaaccgaacttgtcattaaaaagtcatagcgtgtaggatacttcgtcggattcatggcaagctcattacgctggccgcgaaaccgcatcggatgatgaaaaaccaccgttggcacctgactctgaactaatgctgccatctgtacaaaatgcgaccatccagcttcggtaaaatcattttcggtgagatgaaattcgaatacatcaggatgatattgcagccgatcacgaatctgccgctcatctgtactagcctttaagcctaatagcatgtacacttttcctccttaattcaaaacccgctcatgatcccaaaaattgctcataagaacgttgagcatcgctgaccaaggctctaagcggcttctgctacgctttcgaagcgctcctacttgtactttcaaatttcagttgtctttttaacttggcaaccggcgcattaaacgtttcaactttttacgatcaatcagcatcacacccaagtcatcggccaaggcgatcgccgaatcagaaaattcgctattggtgatcaccgccgcttcgtcgagctggtaaaaatgatggcccgcccaaacttcctgcacggccttgttgccaacgaaacctgtgtaacgcttgcactgaaagccaatcgttttaccttttttgcgggcaataatgtcaattccttgatcacctgaagcctgcgtcagttgaatgtgattaaacccattgcgcttcaacagatacgcgcaaaaagattcaaacttttcaccctccatgatatcgacagtttccattttcaaatcacgaaaacgaaaatgatgatgataaagcatgatggcattgatcacaacaaaaagactgatgattccaaaactagccggatcaccatattgccgcagttggcggggcagaaaactgcgggcccaaaagctgtaagcgagtcccaaaataaagagcccccacaacagctgataggcttttttgagtaacgttctcatgggtctacccctctctttccctttaagcctagcagattcaccgcgtaattgcattgaatctctgccaatttttctgtacgcttaagggattgagagaggaagcgttttcgtcatgcaactaagtgccaagatctttgccaaagtcggtagcgaacggattacccagtattctttagtcaatgaccatcagatgacgctacgttttttaacgtttggtgctcgggttcaacaggttcgcctgccaaatgctgcaggtgacgatcctaatctgctgctcgggttcgtcacgctggaagactacttacaccaacccggttacctaggcgcctttaccggccctttacaggcagctgacgctgagctagccccgggttcatggcaaaactggaattgggcggttaaaaccagtcaagaaaccgatctagccatcacattcaccctaacattacctgaaaatgctgacggtcagccaggccagcgagaactcagtattacccaccgattgacaaatgacaatttgtggcagattgacatgcaggtggcaaccactgccgacttgaaaatacatccccggctcaatttgccttggctgctcactgccgaccctgcccaaacaatgctttcagccaagttgactgccgatgaacatgttacccctgtccctaaaactgcccgctgtgagactgcgcaacgctattcccttgcggccgccgattggcagttggcatatctaagcgatgcttcattcacgagaattgattcttacgctggcatcaactccgaaaataattttaacggtattctcggccaacccaatgtagcagtcggcttttcgccggaaatgaaccaagacgctctgccgtgggtgttgccagccggtgcaacttggcggcatcatgcggaatttcacttatctagcaacgcaaactaaaaaggtttgaccccacggtatctgttgtggggtcaaaccttttttccaatcattgatgattaatagttcataaaaacatccttgaagactttaacactgtcaaagacgtcttttaaagtgacgtattcatccgtctcatgagacgtttcatttcccgggccataaatagctaaatcaagaccgtcatgatagaacaacgccgcatccgtgatgccggtgcgataggccacttgaccacgattcagccccgcacgttgacgggctgtctgtaccaactgaatcaaatcattatcaggtgaagccgcagctgcccctaaaacggaatcaattgacagactcaaccgaacacccttaggcactgtcgttttagctgcttgtttcaacgccgcaataaacgcatcattatccgcaatcatggttgtccggatgttaccgcgcaaatatgcggactccggaatcgagttgatctgattgccaccatggataatatcaatattatgcgtggcatgaccaagaatggggtcctcttttgcctgcaacggcgctgttgcagttagcgctgcattcgcaaatgcaaacaacccatgaatggcatttgcccctaaatctggccgagacgaatgtgctgctttcccgtgcgcggtcaatgtgtaatcaataataccgcgttcagcagcgtcaacattgctattgccgggttcggccacaagcagtccagttaaacgatctccgtaaccggcggcagacagttggcgtgcgccgtcattatcaacttcttcaccaactgtcgccatcaactgaattccatgatccaatttttcatgggcagcttgcttgaatgccacaaccgctgcagccagtccagacttcatgtcagttgcaccacgaccgtacaacttgccatcttctacatgtgctgagaatggtggaaactgccatttattgacgttcccagggtcaaccacatccatatggccatccacaccgagccagcgctgggcattaggattaccgatcgtcagcaccaaattatcacgaccgggcgcataactgatgcgttcccgtttaatcaatccggctttcaactcaggggctaaaaaggtttcaatcaggtctgctacctgaccttcttttgctgccacacttggtatctttaccatggcactgagtaaatcaacgacttgttcttcttctgtcaagataaggcctccacttatgatcgtttgtattctgcttttgtttggcttcggacagccgctcagcacaacatttaacgcttatttccgtctgaatcgtaataatgcatgacccaaaattggcgtcacgataccgcccaacaaggcctcggctacggcgttaatcgccaaagccgtcatcaataaccatcctaggttggtcgcatccgcacccggcacaatttgcgctgctttactggcaaacatcaaccatgtaaacccaatgaccagcaaggtgttcgtcaaagcaccgacaacaccggcgaaaaccattttaacggtttgcgctaacggtgtttgttttttcttgaacaattgatgaaaaataaatgccgccaccaaaccaaccatgacacgcggcacgatggcgataatcggatttctaaacagcagcagggtcactggatcagtcgctgatgtatacgcccgaatcagactggttaacccccataataagccaaggctggcaccgccgccatagcctaatacaataccaccaatgatgacagtcaaatgaatcgttgaaatcgcaggccaagccggaaaaatctgcacatatccgaccattggaatataagcctgaagaataatcaaagcaccaagaataccaataatcgcaatattataagcttttccgcgttgcgtcatgcgctgctacctccaaattgtctaagtttgattttatcaaattatacacgttcgaggaaagtgatgctgggaggaagacttttaccggaaacgctagggaaaaggttggctgtcaaagaattcccgcgatggcgttgcacaaaacacgctcctagttggaggagactacacataaagacctcataaataaatgactgaaaatcggtcattgacttatccgccggtttctaaacacgtgagccagcccagaaactaacgtgtaagggccttggtcgcaatggccattgtgcggccatcccacttacactacggtttctaaacgcgttcgccaccccagaaacctgcctgtaaggaccttgaccgcaatggccaaacccaggccatcacggtcaagtccgcttacactccggtttctaaccggggtggcgaacgctcttgaaaaataaagtttgactttaaatccctaatttcctataatatttcttgtgcttaattagccatgcgggcatggcggaattggtagacgcgcaagattaaggatcttgtgagcattattgctcatggaagttcgagtcttcttgcccgcatcacaaaagacccgaccaacagcacatcttgttggtcgggtcttttttgccaccttagattttctaactaccggcaaggctctctagcagctgttttaatcaattatcatgtcacacaagtcattgaaaggagtttctctatgcttcgcgaagctcaatttatcgatctcggtgccattgttcacctctatcaacaactaaccgctgaaatggcgacgatggcccctgaaacttatcgtccattaactagcgacaatcgtcaatattttgccgactacttgcaaaatgaccttgctcggcttttcgtgaccgaaacggctggtactttaagtgggtttgcacttgtcgttttggctcgcactggcgacaatgcggaatttgttccgcaacattttgcccagctgatcgatctttatgtgatccctgcgcaacggcatcagggattggctaaacagcttatggacgcggttacggcttttgccaaaagccatgatgccactttcattcagttaaacgttttgaatgccaatcagactgcccaacaagtctatgccaaagctgggtttgaaccggtaagtctgattttgcaaaaaccgcttaactagccaacgtcttttgcaggcgcaatttaccgcgacagacaccacacgcgtaccgccgaacatcaatgtgacggcgacgaacgaattggcgaccgcaatgggtgcatacatacacgtactgatggccgttcactggcaacggtggcgcaaaacgtgacccgccaactgcagtcaagagctgcttaaagtcgtgatcgcgatgctgatagccgcgatggtgatcatataggtggtaatgcaccagctcatgtttaataatgccatcggtgacactcgcaggataaaccgcaaatagcttggggttgaagtctaagttcatatcagccggatgaaagcggccacccgtcgttttcatccgattattaaaaacagcgtgaaggcgaaaaggttgatggaatgctttcaacgagatcgtctcaacgcgggcctgtaattcttgatctgtcatatctacctccgagccaatagtttactccaagtcacccgtagttgcatcatgacattttggttcctcaaaatggtcttaaaatatcaaaaacgagtcctctgagaaatggctaaatagccatctcgaggactcgtttttagtttaactgaaaaaggccaaaacatcatcacggctcatcgccgcttttttggcttggtcaaaatcagccacaattttaccagcatctaacacaatcaagcggttaccataacgtaaggcgtcttcaacctggtgagtgatcatcaagcaggtcagctgctgatcggagacgatttcgttcgtcagttgcatgatcgcctgactggtatgcggatcaagcgccgccgtatgctcatctaacagcaacagatccggtttccgcatagttgccatcaataggctgagtgcttgccgttggccgccagagagctgctcagtcggcttgtcaagggcatcagcaaggccattgcccgtcttcgctgctaaggtcttcagcgccgctttgctagccgtcatgccgcgtgatcgcaacgttagccgctgaccgcggtgactagctaagagcaagttttcggcaactgtcattcgtggtgctgtccccattttaggatcctggaaaactctggcaatatgccgcgcacgttgctccggtcgtttgccattcaaagtttgatcagccagcgtaatggtgccaccgctgactggcatatcgcctgtaatcgcgttgaataatgtcgatttaccagccccgttgttgcccaaaaccgttacaaattcacctttagcaacggtgaggttcacgtcctgaagcaaagttttcacttctgtaccaacgggaatgttcaccgtaacgttggttaaggttagctcagccatgtgcttgcacccctttctgcaacacgcgccgtaatctcaagcgatgatcaatttgtggcaccatgatcgcgatagccaaaacaaccgctgagatcagttttaagtcgtcggcattgaaccctagtgcaagcacaaccagcaaaacgaagcgataaagaatgctaccgagaatcacggcaaccaaacgctgtgagagtgttaattcgccaaatacaacttccccgatgataatcgcggcgaggccaatgacaatgatcccaatgcccatattgacatcagcatagccattgttttgagccagcaaaccgccagccaaaccgacgagaccattacccaccatcagaccaagtaccatctgatgatcaggatcaataccgagactgcgcgccatacttggattgtcccctgccgcaataaacgcttggcctaactgagtatttagaaacagcattagcaagccaaccaccacaacagcaacgataacgccgataaccacactattgaagtatggcggtaaatcttttaagaacgctgtctggaaaagattggcttgatgcaacagcgatagattggcgcgtcccataatccgcaagttgattgaaaacaacccggtcatcaccaaaataccggccaacaaaactggaattttgcctttcgtggtcaacaacccagtcgccaatccagcaagcatccccgcaccggtagccaacagcgttgcgacaatcggggaaatgccatgagtaatggcactcacggctactgccgcgccaaatggaaaggtaccttcaaccgtcatatccgggaaatccaatacccgaaatgttaagaataagccaagtccgattaaaccatataataaaccttgaccaatcgctgatacgccaatactcatttgatcaccattcctttcgcctctgccgttttgattaacgagctaggtaagtcgatgcctaacagttttgcttgtttttcgttcaagatcagtttaccggtggtttcaaaatgaatcggcgtcgttgctggttttgtctttccactcaagatgtctgccagcatccggccagttaaaacgccgagatgatgttggtcaagaccaatcgttgccaatccgccttgttcaaccatagtgtccactgttggaaaaattggcaccttccgcgtattagccaccgcaaccaaagtttgcatcgcactggcaacagtgttgtcagtcggcacaaaaatcgcatctacttgactaaccatttgtgtggccacctgatttaagtcatttgttgaactgatcgcgtaccgcttaaccgtgaagccttgctttggcccaagtttttcgaccattttagcctgtgtttgagcggaatcatcactcgacgttgcaatcacaccgagagttttggcattcggcataatttgccggattaatttcagctgcgcggcaatcggtgcctgatcagatacccccgtgatattgccacctggccgtttaacattatttactaactttgccgcaactggatcggtaatcgcgccaagaatgatcggtgttttctgattgacattggcaagtgcctgagccgatggcgtagcaatcccaactgttgccgccgcatgttcctcagtaaagcgttcggacatggacttcagattgctttgatcattttcggcattttgaaaatcgatcttcacattcttccctgcaacatagcccttctccttcaagccatcaataatccccttgtgaatcgcatctaatgcgggatgtgtggtcaattgcaggatacccacagttggtgttgcctgtgtctgtggtgttgtcgtgccggtttgaaaataggcaatccctaagaatgctgccataatgaagatcaaccctagcattcgtttcatgtttccgcctccgttttaaattaattcatgctgtgcccgcttggacttaatcagttatgattcataacgcgctcgtcagcccagaaacctgcacataaggacctcagacagaaatggccaaagcccagccgtttctgtctgaggccacttatgttccggtttctaaacgggctggctcacgcttacaaaaattgccgcgacaggtgaggactcgtcgcggcaataaaaaaagtccgcatagtcccacttttggggtatctatgcggacaaattgaacagagagccaacatagacacaacctgcgcgtctggcaggttgcgtctgcaacctacctaaagttggctttgccaagcagaaaaggtaagcaatgctgtcatgtcggtttcctccgtcctagttaattgatttgttgttagattaaagatacgtgagtaaagttctcatgtcaagtataagcttaaactttttttgacaattttgaccagcttaagacaacatgactgaaattttttggatttgcttggtgaatttttgaattgcctcgtcctgagctttttcagctgcgttgaaagctgccacatcaacttgccgatccgcgtgcaaacttgcggtcatcgccttacatgcctctgtgaaagcggcaaaatcacgtacaagtgtatgatggggccccaacaatctgactggcgccgcgacttgctgcaacttgacaagcaacgcttcatagttacttgtcccctcgctaaacacggtttgcgtttgttggtaagcctcaaggtcgtaatcggccaacttgttctcatcaatcgccttgcgcagcggttcaaacaacggcgccattttctcttggttgtcttgtgtggcttcaacgaccgcattaatggtcgtcccatagtttgctaacttcatttgttgtttattcatgtgcttcatccttttcatcggctcattagccggtaattaacgcataaaagccttgactgtcatgaccgttacaacacggacatcacggtcaaggctattcctattgttttttgactctaagcaatcttgtggtgtcttatgcgcgttgcttgcgtcgagcacgttcgaaaactttaacgatctcaacaatgacgatcatcgccacaccagccccgagaacggtgatccattgatgccaatcaagcgatgtcacatggaacagaccattgaaacctggcactaaaatcgtgactgccaacaacacgaaggaagccagaatcgcccagttaaaggccttgttccggaacgcgccgaccgtgaacagactttgatggatactcttcacgttgaaggcatggaacagctgaatcaagcccagcgtagcataggccatcgtcaaagcatcggcgtgaatcgcagctgagccgctgtgcactggataggtaatggcaatccagtaaacgccaagcgtcagcagaccttcgagaattccttgccagataaccgcggggccaacgccgcctgagaagaagtttgacttccgaccgcgcggcttttgcttcataatacctggttcagttggttcaacccccagtgcaatcgctgggaacgtatctgtcactaagttaatccagagaatatgcaccggtgccagcaaatcccaacctagcatggtcatcatgaataaggtcaagacttcaccaaggttggccgacaacaggtactgaattgccttttgaatattggaaaagacttttcggccttcttccaccgccacaacaatggttgcaaagttatcatcagccaaaaccatatcagaagcacccttggaaacttcggtcccagtgatgcccataccgatcccaatatccgcagctttcaaagcaggcgcatcgttcacaccgtcgccggtcattgccacaaccttgccttttttctgccaagcattgacgatccgtaccttgtgctctggcgcaacacgggcgtatacactgtactttgccacgttctttgcaaactcatcatcactttgctgatctagctcagcaccggtgatgacagcatcatcatcgccttggtcaatgattcccaaccgaacggcaattgcttcagccgtatcgcggtgatcgccggtgatcatcatcgggcgaataccagccgcttttgcctctgccaccgcagcttccgcttctggccgttcgggatcaatcatgccgaccaatccagcaaaaatcatgtgattttcaaccgtatcggaatcaactttttccggtaaagtatcgatgaccttataagccatccccagcacacgcaacgcctgtgtcgccatgtctttattggctttcaaaatggcatcgcgttcactgtctgacaacggcgccgtattttcgccagttgctaggtcagtcacccgcttgagtaattcatcaggcgcaccctttgtggcgactagcaacttgccatctgcgcgtcgatgaactgtcgtcattaattttcgttcagagtcaaacggtacttctgcgatccgcggttcgccagtgagtgctttggcaacatcgtaattctgggttcttccataagcaacaagcgcagtttcggttggatcgcctagtaacttaccatcgtcttgcacctgtgtgtcgttggcaaagttcatgatggtcattaatggattgccgccatgaataccagcgcttgcatcattaagctgaccgtcgtaataaactttttcaaccgtcatcttattttgagtaagcgttccagttttatcactcgcaatgatatccgtgctgccgagggtttcaacagcaggcaatttacgaaccagtgcatggcgcttggccattttctgcgtacccaatgctaaaatgatggtgacaatggctggcaacccttcaggaatggccgccacagctaatgaaacggctgtcaggaacatttctggcaagcttgccgcttgacgccagataccgactgcaaacacaatcaccgcaatcaccaaaatcatgaccgtcagcgttttaccgagacttttgaggttctcttgcaacggcgtgttggtttcttcggccgaattaatcatcccggcaatgcggccgacttcagtttgcattcctgtagcgatcacaacaccgacgccacggccgtatgtgatgttactgttcatgaatgccatgttagtgcgatcgccaattccgacatcatcagcatccaacggcgccgtcgtcttatcgaccggcacactttcacctgttaacgcactctcttcaattttaaggttggcactctcaactagtcgtaaatctgccggtacgacatctccagcttcaagtaacacgatgtcccctaaaaccagttggctgctaggaatggtcagcacctgatcaccacgacgaacatgggcgttaggggtcgacatttccttcagcgcatcaatcgcttcctcagctttactttcttggaaaacgccgaaaaccgcatttaataagacaacggccaagatgatcccggcatccgcccactcactgagtaaaaagccggcaatcaaagcggcaaccaacaagacaataatcataaaatccttgaactgatctaagaaacgggctaacatgcccttcttttctgcctgcgcaagttcatttggcccattctcatttaaccgtgtttgtgccgcttctttcgttaacccggttagactagtctgttcttgctttaagactgcctcactgcttaatgcatatggcggtttgtttgccaaagtagtgcctccttcgtatttgggccggtagccaaaaagagacctatggactaccagcagtagatccataagtctcactatttaagacaacaccagacatagccttgttggtgacgttgtcgcagaatactctgctagttactcccctatgttggttaaagtatatcaggtgcgggtcatgcttcgcaaggcttacttgcgaagagcgtgaacaggcccggtttctgggcctgcaaacgcgtttaatcagagcagagcgtgcaagtcgtgttagaaaccagcataagtggccttattaggcagccattcagcccaactcactaaataggtgaaccgctaagtcatgcagattcagtgcatgcgaattgtagttgctgagcaaaatgacggcattttggccatcatgacttatcgcggttgaggccatctgaccggcgacgacaccgttggttgagtaaaagtcagcatggttataaataccagcgttataaacaccatcgttgcggttacgcaatgtttttagagttgaaagtggtaatactttccctgtatcaataccacgcaacagccggtataagtcaccggtggaagtatagacattgcccgtgcctagttctcgattataccaaactgctggttcaccaatcgcagtttgataaggattagcagccgggccagtgtaagtgatagctcgctcaggatctgtcagcattgcgggtaaaaagcctgtgtgcttcaggttgagccgatcgaaaatattgtttttgacttgctgctcgtatgaacgaccagcaactttttctatcacaccagcaagtaacacgtaattaactgcttgataagcgtaattatcctgcggcagataggttaagttggcaatcgaccattgaataatattagcatcatccattacagttggttgatacttacgcaaactaaagccgctgcgcatagccaccatcatgcgcaaagtcacttgatcgccggttttgatgccagttagatatttgccaaccggatcatccaagctgagcttgccagaagcggccaattgcgcaagcgcaaccgcagtcacggctttttgaattgaaccaatctgaaacagcgtggttggaccgttgcggcgatgtgtcgtcgtatcggcatcaccaacgccattgttaaacacgactttgccgtgcttaatgatcagggcactgccaataaacttgtcattggtcaactcttgctcaagtggttggccttcagtcgtcgtcgcggcacgatccaaggtcatggccaatatttcttcttttgatttaccccgatcctgacgtaccgcttttgtgactgtctttgcggattttgacttcgtattcacggcggatcggctgttttgctgccaaaggtacgttcccgcaccaatgctgactgcacataaaatcagcatgacgcccaaccaaatataacgatgcttccccgacatcttaaaacctactcctttaaatgcattcacgagcgcaaaacctttatgtgaggaccttaaacctaaatggccgctcctatacttcggtttcaaaccggctcagttcacgctcttatctaaacgcgctcactggcccagaaaaccggctcagctcacgctcttccaaatttaacttttctggacgcaaaaataccacattatccagcaaaaagacagcccgtcgcatcactgattgctatcggtgatgccttggctgtctttaagcgttatttccaaaaattatcgaaaaccgtgattggtaaatgccgcttgtgggcggttttttggtaccacttttcaatcgtttcagcagcttgatcagtgacgtcttttccttccaaataatcatcaatgtctttgtacttgacgcctaacgcaacttcatcaggcagcgctgggcgattgtcttcaagatcagctgtaggggccttttcatacaggtgtgccggtgcgcctaataccttcaaaagcgcggcgccttgtcgtttgtccaatcgatacaatggcgtcaaatcagcgccaccatcaccaaatttggtgtaaaagccagtcacggcttcagcggcatgatccgtgccaatcaccgcaccggcattattgccagcaatcgcatattgcgcgatcatccgcatccgagccttgatgttgcctttgttgaaatcagaaatctttgacccatcagcctcaaccgccgcgaccattgcatcaacactcggcttaatattcacacgcttgacaacatcagcgtgcataaagtcgatagcagccatagcatcggcttcatcggcttgttcaccataaggcagacgaacggcaataaattgataagcatcgtcgccggtttctgctcgcatttcctgcatggccttttcggtcaaagcgccagcaagactcgaatcttgcccgcccgaaatgccgaggacataagtttttaaaaaagtgttctttttcaaataagcttttaaaaagtctacactacgacgaacttcagtttccggatcgattgttgcttgaacacccaatgctttgatgatttctgcttgtaatggacgcatagtcaaactcctttaatcatattcagatacaaatttttaatgagactttgggttatcttgtccgtgttggcaagcaagacaaccgcgttttggccgctggtatcaatcatggtacctgcagattgcgaagccaccaccccgtgcgttaaggtgtagcctccaaaattataaacccccgctgtgtactgaccattatccaaattccgcagtgccttcaatgaagcagttgaaatgattttcccctgattcaccgccttgatgatctgatacaaatcacccgcacttgtataaatattgccagtacccagttcccgattatagttcacagaaggctctgtgtaccgttttgcgtagggattattaatgggaccactataaccaaacgcctgattcgactcgtgaaacaactctggcataaacccagagtgagtcaatttcaacttcttgaaaatttcctgttgaatcaaatcggcatacagtcggccagtcactttctcaatcacaccagccaacaaaacataattcactggttggtaatcataacgaaccgttccataatttaagttggcaatcgaccaacggacaatgccagcgtcagaaagcgaagcactctgcgcacgcgtcaatgataagccgctacgcatgttgagcatcatgcgcaaggtaacttgcttgcctgtcctaatgccggtcaagtacttactgatcgggtcagacaaatgcactttgccttgttcaactagtcgcataagcaacacggcagtcaaccctttttgaatcgaaccaatttgataaagtgtctccggaccatttaaacgtccagattcagcatcggcatagccaagtcctgtgttcaaaataattttgccacgtctgatcatcaacgcagtaccactaaaatgattagcctccaatattttcataaacggcttggcttccgcctgattaactggctgcatgagcttgtcagtcgcggatgtcgctgttcgcgtttcattttggaggcgttgctcaaccgcccgatgtcggttcaattctgtttcatacttacgccgagtccgctcttccttagcctcaatctgtggcttcaaataaaaatgatcgtaactcgcataagtagctattccaactacaagaccgactagtaagctaaggattagctaacgatgctgcgatcgccttttcgatgccctcatagattattcctcgcggtcagccaccgctgatttgactgctttgatcagatccatcttgttgtcccaaacccgttgcgacaagtctaccgggtagtcctgtgggttcagaatgcgtcgatattcatcccataatgcgttggtactccgagtggcatatgcttggacttcttgtaacggtggtgtgtgataaacctgctggcctttgtcataaatcgtctgtagaagtggcttggcttcaaaatttttaaccgttttattgatgtacggaaagttcggatggaacatataaagacttcgttgtgtatcaatggtttcatctgccaaggcaacataatcgccttcagatttgccatcatcttgacgcgtaatacgccaaacctgctttttgcccggcgttgaaactttctcagcattgttcgacaatttgatcgtgtcgcgcattttgccggctgcatcttcaattgataccaacttaaacacggcgcccaatgccggctgatcataggcggtaattaaacgtgtcccaacaccccaaatatcgattttggcaccttgcatcttcaagttctgaatcgtattttcgtcaagatcgtttgaggcgtaaattttagcagattcataaccggcatcgtccaattgttgccgaactcgcttggagatgaaagccatgtcaccactatcgatccggacaccaagaaagttgatcttgcctttaaactcattcgcaactttgattgctgcaggcacaccagaacgcaaggtgtcatatgtatcaacgaggaaaacaacatccttattgctgcgggcatatgctttaaaagcatcgtaatcattgccataggcctgaaccagcgaatgagcgtgggtcccactgataggaataccgaattccttacccgccaatacattactagtcgcattgaagccgccaatataagcggcccgtgtgccccacaaagcagccgccgtttcctgtgcccgccgtgtgccgaattccatcagggggtccgcaccagcaacgctgcgaatacgggcggctttggtcgcaaccaatgtttgatagttgatcatattcaaaaccgctgtctcaaccagctgtgcttgcgccaatggtccctcaatttgccaaatcggctcgttgttgaataccaagtcgccttctaaagcggacttaacagtgcaagtgaacttaagatgccgtaaataatcaataaaagcatccgaatagtctgtttgcgactgcagataagctaaatcatcttcagaaaacttaagatgattcaggtagtccatcacatgttccaatcccgcaaaaacagcaaaccccgaaccaaacggtaaatcccgaaaaaagacttcaaacacggcattgcgttcgctaatcccctgttcaaaaaaggtattcatcatatttaattcgtaaaaatcggtgtggagtgtaagtccttcacccaactgtgtggtcatcatggctccccttccggataagtggcaacaacaaacaagcgctcgtataggcgcagtgatgcttaatttatagttcatcattatataccattcagagaaaatgggacagagcgcgaacaggcgcggttagaaaccggagcataagtggcctcaagcctaaaatggctgggctttggccatttaggcttgaggtccttatgtgcaggtttctgcgcctgttcgcgcatttcgaaatcagcatagcttaggctcagattccctttcaaatagcatcaaaaccaacgaaaaaagccaaagaacaagatgccatcttgctctttgacctttccaaatgcctagcgtttataaccaagcagcaaacattaccgttctagataaaattcaaatctttcgccaacatactgcgttcgaacgtattcaaacggcgtaccgtcctgcaagaatgatacctgacgcaaacgtaggatcgcttcgccacgtttgatgtccagatactctgagattcgttcgcttgccagcatcgcactgacagtctgttgcgcaccgccaagcacataaccgccttttttctccaaggtatggtaaaaactggctgtcatttctttcttggtaaagtttttgacgaggttgtatggaacagccgccgtttcaaagctaatcggaatcttatccgcgtaacgaatccgttccatgcgcaagacttgttctttaggctcaagtttaagtttttcaacttcagaacttgttggctgggccacgtggtaggagactgtcttactggatggcaccttgccttgtgcttgcatcagatccgtaaagcttgtgacgccagacattttctcttggactttctggttggcaacataggtaccggacccgacgcgccgttcgagaatgccttcatcgaccaatgtttgaatggcttggcgcaacgtcatccgtgacactttaaacgtgacagctaaatcacgctcagaaggaattcggtcgccaacgcgccatttgcctgcttcaatatctgcccgaatcgcgttatgaatttgaatataaactggtgcatccatgaatgatcgcctccaaatcgtggttcagtcttcggtgtcgtgtttaacgccatagctgtaggttgcaaccaaatcgttattgcgatccaaaacgttgatatcggcatctttcccgacttcaagcgtgccttttgatgtcaggttgaattcccgtgcttggttaaccgatgacatttcaacggcatcaaacaaggaagcatccatgaagctcatcgcattcttaaaggcatctttatacatcagaactgagccggcaagtgtgccgtctttaagccttgcctgcttatctttgacataaactgtttgaccgcctaattcactcttaccttctggcatgcctttgctacgcatggagtcggtaaccaattcgattcgttctggtcctttttggtcaaaagcgaggcggagcatatcaggcacgatgtggaagccgtcacagattaattcacaatacatgttgtcttcaagcatcgcatgaccggtaacaccaggctcgcgatggcgcaggccgcgttgagcattgtagagatgcgtcacatgtgttgctttgctatgcagcatctgttcgcgggtagcgttactgtgaccaacagaaggcacaatgttgtgcgccaacaagtagtcttcaaatgcttgtgacccttcgtcttctggcgcataggtgatgagcttaaccagaccaccggataattcctgccactgtttcactaaatcaacattaggattcttgatatattcttcaggttgggcacccttgaagaccttactgatgaatgggccttcaagatgcacgccttgaataatgtggttgcgttcagccgcctgtttaacgccacgcatggctttgtcaatattctcagttgactgcgtcatggtcgttgcaaaaagggtcgtcaccccttcgtgcgtcatcattttcgttgccatttcatcaatctgatctgcatcaccgtccatggcatcaaagccataaccgccgtgagcgtgaacatcaataaaccctggaatcaaggttttcccttgaaggtcaaaagtctgttcaccagattgggcgcgataatcaaacatgtcgccaactgccaaaattttgtcatcgaaacgaacatagccgtcatcgatgcgttctaatccagtatagatcgttgcgtgtttcaatactgtaaccgtcacaataccactcctaattgtttaatgcttcattcgacagataacatataccagtataactggtatagaccaagattacaagctataccttcgtcgtacaacgtcatacttatccttgacgatccttagcaatggttgcgtccactcccttgataacggcagacatgagccctgcttgctccatcgccaacaagccagctactgttgtaccacctgggcttgagacttgatcaatcagatcaaatggcgattgctcgctggccaaaacattttgggcactccccatcactgcttgagcagcaatggctgttgcctgttttttagttaacccatacttaacgccagcccgcgataggctatcgatgaataagtaaacaaaagctggtgatgaccctgccaacgcgacaaatgtcgaaaattgatcctcaggtaacgccatagttttacctaagacgttcaataagtccagtaagccatctaattgacccgcaacactatcattagccgcgtaagccgtcatccccgcgttgatagccacattcacattaggcataattcgcaggatcggttgatcttgactgccaagggcatcttcaagggtcgccagtaaaacaccggtaagcatcgaaacaatcggtacctgccgttgtttgagcgttggcccgattgtctttagaatcggcacaccaagtttgggggcaacagctaggaaaacgatatcggcagtgtctgcaactgcctgattgctcgcgaccgctttggcgccaattttggcggcatacggttcatagtgaatcggttgcccgccatgcagaacaatttcctcaggcgtgaccgcatttttagctaacaaaccagtgatgatcgcccgtgccatattgccggcaccaataaatccaattgtcatggcctgcctcctttatgcttgatgactttcttctgttgctgaatgggtcttgaaccaatcgacgagggctgctaatcgcgctagtcgcagattcggtagcccgctgcgagacagttcatgcgtggcattgggaaagcgcatgaacttagtatcaacgccatgcaacttcaagccaatataaaattcttcgccttggccaatcggacagcgttgatcattttcactgtgcatgaccaacgtcggggtttgggcaaagtcgatatgggctagcggtgaaaaatcccaaaggcttttcacatcagataaatcaccggtccattttccttcgagttcccaaggtgtgaagaagtagccgatatcacttgtaccgtacatactcaaccagttagcaatagatcgttgggtaacagcagccttaaatcggtgagtatgcgtcacaatccagttcgtcataaagccgccgtatgatccgccagccacatacaaacgatcaggatcaatggtggtatccaacttcaaggcttcatccactgatgccatacaatcctcataatcgccttggccgtaatgtttaatcacggccgctgtaaaggcctcgccataccctaacccaccgcgcggattcgggcagatgacgccgtagccttgagcagccaagaactgcatttcgtggaagaaggtatacccataaccaactgccggtccgccgtgaacatataaaatggctggatgagaagctgtcgcctgctgtggcgggaaataccaaccttcgatctcgaaaccatcgcgctggaagttaaatgtttgtggcgtcaccaaccccatatcgcgtgttacccgacgattaggatcataaatcacgtgttcttcttcagtcgccaaatcaaagtagctcaatcggcttggaaccgtcattgtgctttccgtaaaaacaaccccgtgatgatccggcgttaaagcgtaatcagttacatgccgacgtccgccaatcaaaggtgtcagctgctcgtcgggaccgcctgcatacaagctcgttttcccatggtcaaaaccaatcgtcagataatagtcggcggtggcaaaatcagccactttttcagataaatcctgttgaaaatcgccattaacgtgtcccggaatatcaaaatcaatatcatcggcgacatcttgcaacgttttggtcgctaaatcataatgccacaagtgactttgcgacacatttggcagatgattgtccgaccccacaagcagcaattgcttgccatctgctgaaaatgcttctggcgataaggccgcttgcggtaactgatcattaaccatggttacctgttgatcagctaaatttaacaaataagttgcctggctaaaatcatttgggtcatcgggcaggcgctctgcagtaaatgccaaggtctgtccgtctggagaaatcgccccgacttcaaattcatgctcccggcccattaccaaacgactggtcttttgacgcaggcgttggactcgtaattcataagcgacatgttctggtaataagccgaccccatttaacttatagggcacacgtgagaccgtcaccggttgtggccactgcttatccgtctttttcggctttgcgccaactgtcgtctgaataaacagtgcttgactgtccgcttgccaaccaaagtaggacacgccttctttttcagcagaaaattgcttggcagtaccgccattgaccgcctgtaagaaaacttgagtcgttttatcggatgcttgactcaaaaaggccaaccactgctgatctggactaagcagcggatgccgatcatgtttttgatcaaagccatacgcgatagtgccgccacgatgattgacgaaacaaatgcgctgataataagtattatcggcctccgaaatgcgattttcctgaacaaagtagccatcatctgtcgcacttggatacgacaatgataccaatttaaaaagatctgtcgctttaattgccatacgatcacgcccttcctcatattgctttaagcgtagcggttgggctataccatgtcaattagctggaccgcttgaaataaaaaaaacgcatggcctccgccatgcgtttacgtcttctatcgaactttaatactggatggaggagataggattcgaacctatgaacccgaaggagcggatttacagtccgccgcgtttagcctcttcgctactcctccgtgtgattgctgcgaatcaacttaaatagcatacaaaaatgcgattcaaaaatcaacagcatttgtctgatttttgaccgcatttttcgtattcttaaaggtgatagcgttcaagacaacgttggcacggttaatgtcacaagcgtctgccgccattcagtccaccaatcttgactctgccactcgaataatcgttttaagccatatccaagcggctgatgataatacgtagtaccgcttaaaagcttaggcgcatcgcgaaaatgctcatggccgaacaccactgccgacactctacctgtcagcaaatcgccgagtttggccgaccccattagcgccgttgccatctgccaaggcggccgatcaactgtgtacaccattgcctcacgaatcggcacaaaatgcgtcacataaatcatctggtgcgtctgattcgcttgcagcgctgccttcgtggtggtcaaaacccgttgcattcgcgcagcatcagtgacaggcgcgtcaatggcactatcaatccaaaaggcgcgtttccattgagcatattccgcatcggttttcatattgcccagctgtcctagcgaataatcataccagccattgttgccaataatgacagcattggtgccaggcactggcaaaatcttttcatgcagatacagcggatcaaccgctgattgaatttcatcgtacgttgcgccattcaccatatcgtgattgcccgccaaaaagcgaatggtgactgcagacccaacttctgcctgcagtgcgcgaaaataagccaaagatttggtgaagtcattgtaagtatcaccggcattcacatagatctgataatcatgttcaaccagataagcggcctgcttcttcagcatctcaaagccatcgacgcgattcacatcaaaatggttgtcaacactgaacgcaattttcaccatcagcgcacctccaccaaattttgtcagcagcatggaccaaatgacgttgaagcttcgaagcctaattaacaccttgcattaatttttcgatccgtggtgtgaagaaggccaggacaaccgcaaagccaacggacaccaaacccacaatggcgaaataagccacctcgtgatttggcgtataaaaccggacaatctgcgcattcacggcttgtgccgaggcatcagctaagaaccacatgctcatcatttgtgacgaataagctttcggtgccagtttggttgtgactgacaagccaaccggagaaattaacatttccccgatttcaacaatcgcccaactcatgaccagccataatggtgaaactttggcgctgctgccaaacagcatcactgggataaccatccataaataagaggcacccgcaaaaattaaaccaagataaaactttttcggcgatgtcggttgccgtttaccgagtttcatccataaccatgcaaaaagcggcccataaagcaaaataaacaatggatttaaagtttgaaaattaccagggagaattttaaaaaagccaaaatccagctttgtctgttggaccgcaaaaagcgccaacacgacagacccttgttcttcaatggcccaaaaaatcattgctgctaaaaacagcggaatataggcaatcacccgtgatcgttcagtcttcgtaacttttttactacgaatcatgagcacaaagtaccaaatcggcaagccaatcgcgattaaggtaatcaggctgatcacgttggcaatcgtcagcgcattgaacccggccatcgccagtaaaatgacaccaacagccgcaattgctaccaccacacggatcaccaatgggcgaacatcttcaggcttcaacggatcaggagcagtattgtcagctgggttaatatatttacgcccgtcaatcacgtaaaagatcaggccgacaaacataccaatggctgctagcgaaaagccagcatgaaaattgactttatccgccatccacggaacaaaaataggtgcaatgagcgatccgaagttgatccccatgacaaagatactaaagccagaatcgcgtcgcaggtcatcttccggatagagactaccgaccatttcagacacattgggttttaataagcccgtgcccagaacgattaaaacaatcgaaccaaacagtccagtcgccccaattggcaatgacaaaacaatgtggcctagcatgatcaacacgccgccccaaaaaacggttcgccgtgagcctaacaaccgatcactaatgaagccgccgattgtagcacttaaataaaccagtgacccataaatcgacatgatcgataacgcagtcggctgatcaaaacccaagccgcccttctccaccgcgtaatacatgtaatagatcagaattgcccgcatgccatagtaactgaaccgctcccagaattcagtcatcgacagggttaatagcccccggggatgccccataaacgtgcgatcctttgaattattcaattgaaatacatcctctcactaggaaatgatcccctagctgctctcatggcacttccctcaaaatgccaatcaataaactatcattatagatgtattttttggtgaagacaaataggcaagagcgtgagctggaccgggtagaaaccggagcataagcggccttgggtgtgatggccaggttttggccattgcgcccgaggtccttatgtgtaggtttctgggccagcaaacgcgtttatgaggagcgcgagctggtccgagtataaaccggagcataaagttgccgcggtccttatgtgtaggtttctgggccagcgaacacgtttatgtgaagcgtaggcaggtccagttaaaaaaccagcaccaaagcaaaaaactgagtcaacattcccagatgaccgcctgtccgccaaaaaacggtgtgtggcgcaaatcatcgagatatgttgctcagttcttttacctaattatgcgttagtccgcgcgtaaagcaatcgcagcgtctttgttggctgccatgcgggcaggaatatgaccgccgaggacagtcaggatggtgctaataagaatgaggatcacggcatgaatcggattgagttgagcgacattcggcaactctgtcatgctataaagaatggcattgattgggaaggtcaataaccacgcgataatgatccctagaataccggaactaacgccaaggataatcgtttcagcatcaaacacacgcgtgatatccttacgccgtgcacccaaagccttcagcactccaatttccttcgtccgttcaagcacggaagtatacgtcagaattgcaatcatgatcatcgaggtcaccagtgagatgccagcgaaggccactaggacgatagtaatggctgacataatgccaccggtcatgctggaaattgtccccgctaaatctgtatagacaacctgatcggcttttttcttaccgcgattgaatttatcaagataactcagaatcttgtctttatccttgaaactggttggataaatcgtaatctgcgtgggtgtttccgaaccgcctaatgccgtgatcaactgatccttagtcgctttgtccacactttgattggtaaagatgttcacgtcactggctcgttgtgccttgacgacatcagagtctttgttcaatgccacaagatcttttgttaaccgatcagaataagcaaacccttggctaagcaagccatcacttgttttcgagcgcgtccgcagaacaccagcaaccgtcagttcgcggttgtcgttttgtttataagcatttgcgtaatctttcgttgggacatagacattgccagcaacattctggtaataggcattattcgagattgccttgatcttagtgccaacaatctggttaaatttcactttttgaccatctttaacatcaaaaccgaggttcttcaaagcattgatgttcgtcgagttgtcccgatcaacaatcagaataacatccccatcatgcttcggataactaccggcaacaacctcataatttttcttcagataactggtgccgccttcgcgatcaaccggataaactgatgaactagcgcttgccaagccacgttgagtttgattactgcttggcttagctgtcgaaaattggactggcttgatggtaccattcacgtcacgtaacagattcataccagtgccataagtgtagccaatgttgtcggttagtttcttgctaatgccattcacataatcaatatacttttgatttaacttattggtgtgctgcgccttatcactagcactttgcttagccacaactgttgaggttgttttaaaagtcgatgtctttgtattgtccgccgctcccgctgttaagctagtggcgttagtcgagatcgtaatcgggaattgcgccaaagtctccgcttgcgtattatcaatctgtttttgaaagcccgaggaaagtgctaaaaccacggcaatgccaataatcccaatactggaagcaaatgccgtcaaaaaagtgcgaccttttttggtcataatattagtaaatgacaatttaagcgccgtgaaataactcattttggtgcgatgcaggtcaaagctggcagttttttcttcatctttgaatggccgtgagtcagaaagaattttgccatccttgaattcaatcgtccgttctgcatattcatgcgccagttgaggattatgcgtgaccatgattaccaaccgctcgcgagataaatcagcgattaagcgcataatttcttcactagtttcggtatctagtgctcccgtcggctcatcggccaatagaatcgacggctccgagacaattgcacgcgcaatcgccacccgttgcatctggccgccggaaagttgattgggttgcttacccatatgtgccttcaaaccgaccttcgtcaaagcagcctcggcctttttacggcggtctgctgctgacacaccactcaaagtcagaccaagttcaacgttttccaaaatactcagatgcataatcagattgtagctttgaaaaataaacccaaccgagttattacgataggcatcccaatcggcttctttaaaatttttggttgatcgcccgtgtaagagcaaatcaccggaatcataacgatcaaggccaccgatcacattcagtaacgtcgttttccccgaaccactgggacccaaaatggcgacaaattcttgttcccggaattgaactgagacatcgtcaagcgctttggtcgtatagtcgcctgtctggtaatattttttaatatgttttaagtctagcaatcgttgttctccccttaatgcgttttctgaaatagaaaatagttgaaacgttcgctcgcaatcgcgatccccaagcgggtgttaacggctaatcactgatcgcacttttctgcctacgccaaatcacgcgttatattaatggtgcctgtttatactttggaatgaaataacttgccatatcttagcatacttatgaactacttgataatcagcccatagtctgaattggtgcgctagtctagaaacgcgctactgtttctcaatgagatgtcacacgcaaactaatcatgccgctaactatcgttgcatttaaacaccaacgatgagtcgataccggtcatgagcaaaaagtggatacgaaaaaaccgagccgggctacctgttcaacaggtttgcggttcggtgaatgcatatgtcagcactgattaagtgggcttcctcagtaacggctgccaataaatcaaatccagactatgatccggatagatgtaataactaatatttaattttgcgaaaggattcgccattgcggcaagataaatgggttgcggagcgtgagccaacccagcgactgcgaccagaatatactttgccatctgctcaaataaaggttgtgtgagcccagtggttagctgaaattccaagtcgacataaatgagttcgcgggtttgtcgagtaagcgtgatgcgatgaatcggcatgccgccaaaattaccttcacgattgagatcatcgaccatgcgcttaatttgtctgtgcttaaactgtggccgcgcaaacatcatgcgccaaactgccatgccgtcatccccttctttgaacgcactcgctggcgcagaaacctgcgtggcacgatctcaatcacgttgagacttcggtttctaaccgcgccagttctagctttgcctctattatgccacaaagaagcgggtgatcggcttaaaaaattgggtcgaggatttttgagaaagctgtatcgatctcagctcgagcagcctgttgttcggctaaaccagcggcaaatcggtcatgatctactttgtcagtgccgattgcttgaagcatgttcaaaacaccgccacgaataccgcgcaaaccattcaccagtactttgtggaaggccgcataattacaaggtgctgcttccgcatccacactgtcaacgaatgtacaaaatttcatcacattcttggtgaagtacaaacgcaaatgatcgagactttcacttgcatagcaatttcctttctcgatgtttttgcacgtgtgcacatattccttaaaaacggtttcaaaaacaagcagtcgttccaagttctggttcacaacttcaacatagtttggttcttggcatcgtgtatgcatttcatagtcccccctagtcttgtgacttcatcaacttacgctcttaattatacccactaatgtcttataatcaatataattattgtctaatatttaaatacctaacgttatataaccctccaaaagcctattattattacgatttgcaaacatgacagcagtctgtgaaaacctttttctttgatattgcacgcaatctattcaattatgaaaacttgttttatttgagttgtgcccccatgtcttgacagacaactaattgtgattttcatgtttcatggccagttgcactgaaaataagataacaaaaatattttttaaatattgacaatttatatcttaatatttgacttccggatgcttgatctgattggcaatttgaattttgcgccattagttgttaattcagtcaatttaaaagaacctttcaacaacgtttcctcgcaagttcgcagaacatcacctataatttaatcaagctgttcggtgttatccatacaaacatgggttacgcactctggcttttgcaagcgcaccgagacggctatctgggaggaacgttatgaaaggttatccaaagcaatatccgcttgatcgacagactttatttgggatcaacactatggggttaatgagcacaacagcttattatttatacacggcagttctgatgatgttcataactgactactcagggatctattcgggtgtacccggcaaagccgctgctgtggcaacgaccctgttatttgttggccggttatgggacgctgttaacgacctctggactggctatctgatcgatatatcgccgcgaacccggtggggaaagtttaaaccatacgtgttaataggcagtttattagccggtattttgggtatgatgctttttcacattccccaaaacttctccaatttcggtaaagaggtttacctctatatcgtttattttctctttatgtttgctgccacgattattgtgacggttccgttgaccagtaccatgtcagccgaccaggaagtgcgtgcaaagttaatttcatggccacggatcaccagcaatattgtcggggtggttttcgccttcttcatggcgatcgcaacgtatctaggaacaaagcgcaaccccaatattcccttaaccgtcgatctgatcgtcataccatttctgattttgtcgttgatcggcattgtcatggtcaaagaaggtccggttaccgaggaggctaagccgccaagattgcgagatattggtcagatgatcaagatcaatcaccctttccgtatcaacttgtactttacctttgtcggtgggtttgtttgggcattactgaccgcaacctcgctttattacatcaagtatgcctttggggtgaaaaatctcggcacacagtccatgtattttggcctgctaaccttgatcacactggtcgcaggcactcttatttctcaaaaagcaatgcagtacatttcggctattcgcggtgttcagtggtgctatctggccatggcaccgtttctagtcatcatgtttatcattaatgaaattcatgtcattgataatccgtgggtcttctacttactcatcggtattgtcatgaccatcgccggagcacagtttgtccctgccaatttaatcattatggaaacaatggactacaaccgactcaaactcaatgctggtatggaagcgactatcaatgccgtgaatatgtttctgcaaaaactacaatcaggactagccacaatcggcgtcggtgctgcactactgatcgttggttacaacgcccaaacgcttgaaaaggcaacgcatgtgccagacaacttgttgcaaagtttaggcgttgtccttttcgctattcctgctgtgttttcttttttagcctatctgattgcccgacattatccattgcaaggtgccgctcgtgatgagatgtacactgctctagctgctaaacgggtgacgaatacgcagtcatcaaaatctaaatgatgtatcgatcaatcatttaactggcaacactttttcgacctgagcagaagtgacagctttcgacgtgtatcatgctctcaaggagacgatcttcatgaccagaccttcagctgttaatattcatcgcactaatccaccagactggtttaaacaagcggatttcggtatcatcattcactggggaccctatagtgtgccagcttacgcgccagtcaatattcctgattacggcactttaatcaaaaccaaatcattaggttatttgtttgaacatcaaccttatgcggagtggtatggcaacagcatgttattgccaaacagccccgtagcagcctatcaccggacgcattatggcaacacctcttatgcagatttcgcaaaaacgttcaaacagaccgcccagaatgtcgatgtgcaggcctgggccgcagcatttgccaatgctggcgccaaatatgtcgtgatcgttacaaagcaccacgacggttttgtcatgtttgatccgcacaccaataacccgtacgaacctgactatcatttgaacttcgactttgtcggtgaactggcccaagctgttcgcgcccacggaatgcgttttggaacctattattcatctttattggactggactttcccgcatctgccaatcaaagattacggcagctttctattgggcaacgacaaaagccaaacttacaaagattatgtatggcatcagtggcacgaattgattgatcggtatcacccagatgtgctttggagcgatatcggctacccagatgatcaccgcttggaaacgctgttcaagtattattatcaacaagtcccagaaggtttagtgaatgaccgctggcaacaatttcctgattggatgcgaaccagttggatacgacctattttcaatctcgttgcggcgcaggtcattaaacgtgaccaacatcactcagacgatctcagcgaggttaagtactatgactaccgcacccttgaatatcgtactgactggccgcaaacaaatcgttatttcgaaatgacacgcggcatggacaaaagttttggttataaccgcctcagtcggccagaggactatattactgcagatgacatcaagcaattgatcgcagagcttaggtctaaacgcggtcgacttttactcaatgttggtccggatatgaacggccaaataccatctgcccagctcagcattcttcaacagttaagcaataggtagtggcgtatctaaaatcatgcccagtttcctcgtcatgatcatgcaaatcaaaaagcacctgaccgcacaaaaacggtcaggtgctttttcatgtcagtagctgaagccttacccaagttgattaatagctgtccagctagccaacgcttcaggtcggaaaccgccccatgttgccaatacatcacccgtcgcatcgtcgcgaacgcgcacaactggaaaacgatcatatccggcctcacgaaattttacaattttttggtgactccacgcccgttttaacggatcattggcgttaatatcaacaaggtttgattcacctcggtggttcgtcgtacgaaaatgttgaccgtgttctgcgagccagcgtttggtgagccggcatgactcgcagttaggcttttcataaatcacaaaatgaatcgccatacgctgcactcctttgcatgacgctgccatctttttagtgcaatgggctgcgtgtattgaggttagctttactatcccctattttaatcattcatgcaatgcgtatgggtttgttcagggttaaatgacgatggttaccatcctaaaatttgggggtgggtctaccttgctcacattgcggcggcttgttggtcaagggcagcgatgacgtcttcaagcgcacggctggcatcaataggcaaacgatcataaccatcatggtcaacgtctttagtcgcaataaacgccaacctatcttccaaacgttgacggagacgagcgcgataatcgttgtcgccaaaatcaacattaaaaccggataacggcagataccgcatctttggtagcaggccaaatggtttgaaggcagctgtttcgtcaacaatcttggcaatcgcgcctaacgtatcggctggtttcacattttgaccgttgtaagaaccagtattcaaaatataacaagctgtttggcgttgttcaaagagttggtggaaatcttgataatcctcccccaacggatagctgcggaatgggttcgcaaacggttcgatgacaagatgatcacgatcaacatcaccgataacgttttccgctgttgagcgtttggttgccagcgtcacgccaaaagcagcggcaagatcaggatcttccagtttcaccaccggcggcaaggtatcatccttcatgatccagaaaatagcatcgatactctccgtaagatgatccacgcgattcggcgtgacgtaacgtgacttcacggttcgtccattgccgttgcgaatatcctgcgtcaccagtgttttcttaccagcggcatctagggtcactccaacattttgaaccgtcagaaaatactgaatgcccggatcactcaacggataatcctgagttttatcaaaatatgaaggctcaagcgccgttgttgcacccgtttgtcgatcaatcacaaaggcatcgtcatgtaagaccttcacgggatactgatcgccgtgactggccaacgtgatcgttgacttgccggaaccggacaagccaaacgctgccatcgtaaaatcgccgtcctgtcgcgtatattgtttcataccgccatgacaggcgacaaaaccattccgatgcgccgtcgcccacgcaagcgtcaacgtgccttttttcaactcgccaaagtagcgtaagcctaacacgatggcggcattatgcgttggatcaaacacggccaaaccgtttggatacgccggatcatgccaatcgggatcggcataaagataaatgtcatcttctggaagtgggcgcgattgttcatattcagcattgcgttgtggcgtatcaatttgaaaattcagcaagtacgtatacaaattatttgcatacgcctcaggcagcatcaaatgcgccttgatagcaaaatcagaggacaagccaaccgtgacatccccacggagaaaagtcttgcgactccctaaaaagacagcttcccgagcaatcgccgccagtttagtctcatcaacgtcaggctgaccaataatctggcgggcagctgccgtccgaccaactacacggccgtcattagccactaacaccttggcatctggcggcaatcccagttcagccgtatgtttgatcggtaaatccgtgataatcacacccggcgctgttttggctaaagcataggcttgggcgatggtagtaacctgcttcacattctccccgtaaaatgctgtttcaaccgtggccttaagcgctgaaaaatagccgctctgactggtgatgtcactgcttgaaaaactttgcttacttgtcatggttgaatccccctctttgaacgtgctcttcagcccacgctgaatcacgcactatctttttaacaacatggatgtcaaatgaaaatatttgcatggttcaattataccgagacgaagcagcggacgcgagttttaaaaaacccaaactagcgatttgcttcactagtttgggctcgcgcgttgttagctgtgatacgttaaaaaatcatgcgggttaagccttccgccgattgttcgcctgcaccatttttgcatgatcgatcagcgggcatccgacttcttcacattggctacaaccagccttattttttttgaaaaatgtacggtatgctacaaccgcaataattaaaacaacgataccgccaataatccatgttgccatgagctaagactcccttttttaaatgagttgacaagttaaaaacttgcagcaattgccggaaccggccgtttgattagcagcccataaacaatgagcaaaattgcgactaaaactagcccgatgctcatgacactggcttggccggataccacgagactgccttgataaatcaacatcgtgagaagataagccacgccagtttgatagcccacggcacgccatgtccaccgtgcatcaccaaactccttgtacatcgtaccaatcgccgcaaaacatggggcacacagcagattgaaaaccaaaaaggcatatcctgccatcgccggataggtagcgcgcaaagcctgaccaaagccgctagcactgcctgccccaaaactgatatgtaaggtaccgacacaattttccttcgcgatcaaaccggctaaagtggccacggtagcatgccagtcgccaaaacccagcggtgcaaaaaccggtgcaatgatggttcctaacgcgcgcagcatactgtcattttcgtcaaccatctgtaaaccgaaattgaaattagataagaaccacagcaacacgcatgacagaaagataatagtccctgctttctgcacaaaagcgcgtgcccgcgacatgacactgcgatacaagttggttaggcgtggcaagtgataggctggcagctccatcacaaacggcgctggtggaccagcaaataaggctgtttttttaagaaaaatccccgaacagatcacggcaatgatccccatgaaataagcggatggtgccacccaactgttgcttggaaagaacgtgccgctgaccagcgcgatcaccgtcaacttagctgaacaggacataaacgtcgtcaacatgatactcattcgccgatctttttcgctttcaatcgtccgcgtcgccataatcccaagaaccccgcaaccagtcgctattaaaattggaatgaagcttttaccgctcagattaaaccgatgaaacagccgatccatgacgaacgcaatgcgagccatatagccgcagtcttctaaaatacccaaacatagaaaaagcatcataatctgcggcaagaagcccaatacggatccaataccgccaatcagaccatcgacaatcagaccggatagccatggggcaacggcccaacttttcaaggtgccgccgacgacacttggcagccagccaccaaaaaccgtgtcattgagataatcactgccgattgtgccaatggtttgaatcgataaataataaacggcccacatgaccaagacgaatattggcaaagccaaataccgatctgtcacaatgcgatcgattttgtcgctcatcgacatcacaaagtcatctttgtcaaccacacacatcgcaatgacgcgcgcaatgaagtcatagcgggcattcacaataatgctatcggttgtatcatcaaacacatgctccgccgtccgtaaaatttcattcatctgatgttgctcgtctgaagaaaaggccaattgcttgaccacttgcggatctttttcaaaaaccttaatggcataccaccgcaaccgatcggcaggcaccttctggtcaatcacatcctcaagcatcgtcagcgccgattcgagtcgcgcatcatactcaggaaaggcataaggctttggtagcggcgcctgaatggtttgcaccaactcctgtaaggcagccggtttagttgctgtcgtggcaatgacaggcacctgtaatgcataactcagcttttttaaattaatcgttcgatggcccgttttgaccagcacatccatcatgtttaaagcgacaattaacggccgcccggtttccataacttgcaacgtcaaataaagattgcgctcaaggttggttgcatccaccacattcaagaccaagtccggttgatcatttagtaaaaagtcgcgcgtcacgatttcttcactgctataaggtgacaatgaataggtacctggaagatcttgaatgactaagaacctgtctagtatctgctgaatctggtagaattgtggaaaaccgactgaggcgtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtcttgtttagctagcactaacaagaataggtcttcatggcctttatggtctagtcgtcagggtgttgcacttgaattgtaaactggggtcttcaagaaattgaatcagagcaccaataaagattcctgctagagttgcaaaacataaagccgcaagtgtgatctgatgagacacaagccaaataaagatatcaaccaaatttgcaccttcttttaatgtgtaagctaactacactgtgctataatctttacatgaatcatcataaattgttttagtgaatacgtaaacactgtgttcttaattttataagaaaggagattgatctaatgcttttatctggagaacaaattaagcagctacggaatgcgcggcgaatatctcaagtagacttgtcacgtgcaaccggattatcggcgtctctaataagttcatatgaagccggaacacgaaatgtcactcaagaggcatctgataagattgcaattgctttcaatggcataactccaatcaatccagcagaacgtacgcagactgctgatcttgatgatgacaaaacgcttgttaaaatgaacggaataccacttatgcctgctgaaaaggccttgctaaaagctttagcgaaagcaatgctggatcagcgtaaatagttagctctctacatagcctgctggcgatgaagggacaaaattatggcttcaatcaggagttacaaacttgatagtggaaaaagacggtggaaggtatccgtttatgttggaattgatccaaagactggacataagaagtatgttgtaaaaggaggtaagctcacacgacaagacgctattaaagcagggctgatttggagaaagctgttcagaatggtgaactcacggttgcacctaaaactgataaagttgcacgaaagtttaaagatgtctatgaagaatggctaaaatcatacaagctcacagtcagggaaagtgcatggtccaagactcgtgactgcttcaatctccatattttgcctgatctaggcgacatgtacattgataagatcactccacaagatgtccaaactgcggtgaatagatggtttaaacagtctccagtggcatttaaacggtcctttgttcatatcaaccgaatacttacctatgctgaactcagggactatatcccacacaatcctgcaagacgcatcatcataccacgtgtccaagacaagattggctccacaaacgacttctgggatagacgtcaattggaagtgtttttcaattgtattaaccctgatagggaactttacaagtatgtgctgtttcgtatcctagcttatgccggtttaagaattggcgaggctatggcgtttgaattgggaagacattgatttcaaaaagcgactaattagtgtcaacaaaactgtttcactcggtgtgcatgggaagctgattgttaatccgccaaaaaccagagcaagtaggcatgatgtcccagttgattcagaaactattaattggctaaagcgatggcgaattgaacaacctgactatgtatatggctacgtcaagctttcaactcatcaccaacttctgttcactactaagacaggtaaccgtttccgtgttgacaaaccgcgcatgtggtttagtaccattattcgtaacaacaacttggcaccggttatatcgttgcacaagtttcgtaaaagctatatctctaatcttttgattgccggtgtcgctgtcagtacggtccaaaagatggtcggacataccgaccccagaatcaccttgcaaatctatgcccgtgtccatcaggaacaagaagtggaggccgcagagaagctggcagggtatttaaaaaccggtaaaaaataactgctgtagctccactggcaaaaaggggtacagacgacagggaaaacatggcaaaattgcttacaattaggtgctttcagaaaatctattgacacgtttttccgcgatgctatactaataaggaaattgaatcggtgatgagaaaaagggtcgcaacgaaacctattgaagcgagtcggggaaagtgtaagcctgataacggttgttgtgattggcgttttcgaaccaaatgatgaagccgcaggtagttttttctatctgaagtagggtggaaccgcgcataagcgtccctacgccattaattggcgtagggattttttcgtgtcccgaagccaatcccacttcaattcaccgggaaagaggcaatgatgacaaaaaaaatggacatccaaacgatgatcctaaccctccaaaaattttggggtgacaagggctgtatgctcatgcaagcttacgacgtggaaaaaggggcggggacaatgagtccgtacactttcttacgcgccattggaccagaaccatggaatgctgcgtatgttgaaccgtctcgacgtccagctgacggccgatatggcgaaaaccccaaccggttgtttcagcatcatcaattccaagtcgttatgaaaccatctcctgaaaatattcaagaatattacttggattcgcttgctgcactcggcattaatccattggaacatgatattcgatttgttgaagataactgggaaaatccatccatgggctgtgccggtgttggttgggaagtttggcttgacggcatggaagtcagtcagtttacctacttccaagtcgtcggtggacttgaagtatcgccagttaccagcgaaatcacttatggggtcgaacgacttgcctcctatattcaagatgtgaacagtgtctttgatcttgaatggggcgacggtgttttgtatggggatattttcaaggaacctgaatacgaacacagcaagtatgctttcgaagtcagcaatcaagagatgctgctgaagttcttcgacgcctatgaaaaggaagcttggcgtttgatggatctcggtctggttcatccagcttatgattacattcttaaatgcagccatacctttaatcttttggatgcccgaggagctgtctcggttactgagcgggccggttacatgagccgcattcgcaagatggctcacaaagttgctcgggcatttgtggctgaacgcaagaagcttggcttcccattactgcaacatcaaacggaggtggaataacatgacgcatcaatatctgattgaaatcgggcttgaggacatgccggcgcatgtggtgacgccgagtttgcaacagtttcacgataaaaccgtcgcttttttgaaagaaaatcatctcgatcatggcgcgattgaccagtatgcaacaccgcggcgcctagcattgctgattcacgacctcgccgacaagcaagaggacgtcgaagaagacgtcaaaggcccagctaagaaaattgcgcaagatgcagatggcaactggaccaaggcggcgatcggcttttctcgcggccaaggcatgacccctgatgacattgtctttaaaacgatcaaaggtgtggattacgtttatctgcataaggcaatcaagggcaaaacagcagcagctattttaccaggtatgctggatgtcattaaaagcctgaccttcccaacccgaatgaagtggggcgcttatgacttcgagtacattcggccgattcattggctggtcagcttactggatgatgcgattgtcccgatgaagttgctggatgttgacgctggcagaaccactcaagggcatcgcttccttggcagaccagtgactctcggcaatgcggccgactatgttgcggccttaaaagcacaatttgtgattgttgaaccggcagcgcgcaagcaattgattagcgatcagattcaccaaattgccgctgatcatcaatggcagattgatctggatgcagacttgctggaagaggtcaataatcttgttgaatggccaactgcatttgctggtaattttgatgaaaagtatctcaaaattcctgaagctgtgctgatcacctcaatgaaagataatcaacgttacttctatgcccgggatgcgtcaggaaagatggtcaatgcgtttattggtgttcgtaacggtaatgctgatcatttagccaatgtgattgcgggcaatgaaaaggtattgaccgcgcgattggaagatgctgctttcttctatgcggaagatcaaaagcgtagcattgctgacgatgttgatcgtttgaaagctgttagttttcacgataaaatcagttccatgtacgacaaaatggctcgaacaagggttatcgccgatttgttggcggatcgttttggcttatctgcgactgataaggctgatctggaccgagtagcttcgatttacaaattcgaccttgtcacttcaatggttggtgagtttccagaattgcaaggtattatgggcgaacattatgcgcaattggcaggtgagaaaccagctgttgcccaggctattgctgagcattacgagccgatttctgcggatggggcgttgccagaaagcttagtcggcaccgtacttgccattgcagacaaattcgattcgttaatgagtttcttcgcggttgatctgattccaagtggctcaaacgatccttatgcgctgcgccgtcaagcttacgggattgttcgaatgatcgccaaacatgattggccatttgccgttgctgaactgcagacgacgattgctgatgccttgaaggcagcaggaaaaaccaataatcttgattttgctgcgcatcaacaggatttgaatgcattcatgattgaccgtgccaaacaagtcttgcaaggtcagaagatccgccatgacattgtggatgcagtgacagttcgcgctgatgccgatcttgccggtatcttggatgctgccaagatcctttctgcgcacgcggacgatactgatttcaaacctgtcatggaagcacttggacgtgtgttgcggattaccaagaagcagcaggtaaaagtcgatgtggatacggcgaagtttgagaatccgagcgaaggtcagttgtatgatgcaacggtggcgactgccaagaagtttgatgatgaaccgacggaagccgattatcaggcgcttaaggcactcgcagatccaattaatgcgtactttgatgccacaatggtcatggccgacgatcaagccattcgccaaaatcgcttggcagctttgcttcaacttgccgcattgatcaagcaatttggcgatgtgagtcaagtcattgttaagtagccttgcattccaagcctaaacaggctatactgtattttgtattattatgccgatagactatcaaaaagtcgcatttcaactcagaagtgcgactttttaccgctatttcgggtaacgtgtgttgggcgtctgcaggctgtcaaacagctctgcggcacatgtcatgaaagggagtgagctgacatcgccggaatgattcctgaggctactgtcgacaaagtccttaaagctgtcaatattgctgattatattggccaatatgtgcaattacgcaagaccgggcagaatctgtttggcttgtgtccttttcacgaagaacacaccccatcattttctgtgaatgaacctaagcagatttttcactgtttttcgtgcggccgcggcggcaatgtttttaaattcgtgatggactatgataacgccaccttcccggaggcagttaaaaaagtggcggattttgctggcatgccactggatgttcaggtgggtcatgcagcaccggttgatccagagatcagcaagcaacagcatattttgcaagacacggccgatctatttcatcatattttgatgaatacggagaaaggtcagactgcacttgattatttgcacaaacgtggcttaactgatgacacaattgaagcttttcaactggggtatgcgcctgaagaacgtaatctgttagtagcgtttcttaataatcgcaaagtcgactatcaagatcagcgtgccagcggtttgttcgtagaggatcaagaaggaaaattgttcgatcggtttaacgatcgcgtcatgtttccgctaacggacagtcatggtcaagtgattggtttttccgggcggattctaagcaaggacaagacccaagctaaatacttgaacagtcccgaaaccaagcttttcaacaagcgtgatgtcctatttaatcttcatcgtgccaaagccgattttggccgtgatggcggcccgattctttttgaaggctatatggatgtgatcgctgcgtaccaagccggtgtaaaaaccgggattgcttccatgggaacaagcttaactactgagcaggttgacatcattagccacttaagcaagcgattaaccgtgtgttacgatggtgatgaaccagggcaaaaggcgattgaacgtgcggttgccatgttggctgatcatccgcgattacaaacggatgtggtcgttttgccggacgggatggatcctgatgagttcattcgtgcccgtggtgccgaagccttccaagcgcaagtcaaatccgtattgacgccgaccgcgtttatcctgcaattcttagcgcgcggggttgacatgaacaatgatcaggctaaactgacgtatctgaacgcggctttaaaaaccatcggtaagatttcgaatccggtagcgcgggcagtttatgtgaagcagttagctgacacgactggcgtacctgagagcgctctgaatcaaagcctgccagcgccgcagcaagccgtgcaacaacagtcgtcggctcctgtgagctatcaaaccgcgccggttaatcaaccagttcggccaattgatcgttacactgcagcccaacgacaattactgtattatgtttggcacgatgatttagtgatgcagcgtttaaaaaatactgctttcacatttccagtgccacattttcagacgctctttaccggatggctagattttctccatgagcagcctgatggcgagttagctggattcctggatcgagtcgatccggatctgagcggggtggcggcttcggtggcgatgcaggttttgcctgaggcgactgaggcaacgattgacgagttgattcagacgattacgtccgcttcaactgtcgaacggctgcaggccatcaagcaggccatcacagaggcacagcgacttggcgataagcagaaactaggcgagctaacggtgcagtatgtgaatctcatgaaacttttgaaacaacaacaaggctaggggaggaactttaatggctgataaaaaaacagcaactgaagtagacaagaccacaaagaagacaacggctaagccagcagcaaaaactgcggctaagacaaccgctgtcaaggcggcggcaaaaaagaccaccgcgaagaaaactacggtcaagaagactaccgctagcagcaaacgcacgaccaaaacgacaacgaaagcattcgacgatgctgtcaaggccgtgattaaagattacaagaagaagaaacaaattactgaagatgacctgaccgacaagttggttaagccgtttgagctcaagagtggtgccattgacgatctgatgcaaaagatcgaggataatgggattgctattgttgatgaaaatggcgagccagcagcgattagcttgaagaagcaaaagaaggtttccaagaaggaaatgagtgacatgtccgcaccttcaggggtcaaaatcaatgaccctgtgcggatgtacctgaaggaaatcggccgagtttccttgctgacagctgatgaagaagttgcccttgccttgaagattgaacaaggtgatcaagaagctaagcaacgtttggctgaagctaacttgcgactggttgtttccatcgctaagcgttatgttggtcgcggcatgcaattcctggatctgattcaggaagggaacatggggctgatgaaggcggtcgagaaattcgattaccggaaaggctttaagttctcaacgtatgccacctggtggattcggcaggctattacccgtgccatcgctgaccaagcccggacaattcggattccagtgcatatggttgaaaccattaacaaattgattcggattcaacggcaactgcttcaagaccttggtcgtgaaccaacgcctgaagaaatcggcgcggaaatggacatgccaactgaaaaggttcgcgaaatcctgaagattgcgcaagaacctgtttccttggaaacgccaattggtgaagaggatgattcacatcttggcgacttcattgaagaccaagacgccaccagtcctgaagaccatgcttcctatgaactgctcaaagaacagttggaaagtgtgctggataccttaacggatcgtgaagaaaatgttttgcggttgcgttttggactcgatgatggccggacccgtaccttggaagaggtcggcaaggtctttggcgtgacccgcgagcgaattcgtcaaatcgaagctaaggcattgcggaagctccgccacccaagccgttccaagcaacttaaggattttcttgagtaatgaacgtttgttagctgataaagccgtctgcctcattagtgaggtaggcggctttttcgtacgtcatcatgtggcgaaggccctcattcagattcgaataccggaaatctttgatgtttctgaggacgtaacccgcttttcagaaaagttaactaactgttcggcgtagtttgttataatgaaaactgttaacgagatgaggagaaagtatagtcatggatcatattcatttatcaaaacggcttcaggccattagcagttttattgaggcaggcgaacgggtagcggatatcggcacagatcacgcttttttgccgatttacttggtacagcagcaacgcatcaattttgcgattgccagtgatattggagcgggaccggtcgcaattgccaagcaaaacgttgcggatgctgggttaactgcgcagatcagcgtccgtcaagctgacggtttggcaagtatcatgcctgacgatgccatttcaacggttgtcattgctggaatgggcggtcagctgatgacggatattcttgaagctggccagccacaactagacggtaccgaaaccttggtactggctcctaatcgacaccaatacgatgtccgtttatggcttgatcagcatggttatggcattatcggcgaggacattgtcgaagatgaaggtcatatttacgaactgatggcagctggtcgaacgcgcccggatgtgccttattcggaagctgatttacgcttcgggccgattttacggcggcaaaagagtccaacttttatgaaaaaaatgcaccgcgaagctgagaaaaccgaggctgtgcttgaaggtttggctgatgcacagatggtgccgctagaaaagattcgcgaacaacaaaaaattttatcattaatcaaggaggaattagacgcacatgacgagcggtaaacagattattaatcgatttgaagactttgcccccctaagtttggcatgggaacgcgatccaagcgggctgcaattaggtaacccagataaaccagttaaaaccgtcctcgtaacattagatgtccggccggaagtggtcactgaagccgaggcgattcatgctgatatgatcttttctcatcatccagcgatgtttcgaccagtgcataacttggatttgcgggttccgcagaatgccatgtacgcccaaattctaaaggatgacttgctggtctatgcagcgcatactaaccttgatcgcgtccaagacgggatgaatgactggctggcagaagcgttgggattaagtcaagttgtgccttttatcaatgaaggtgaaggcgccaacatgggccgaattggcttgttaccagacaaaattcgccttgaggcttttgttgaacaagtcaaagcagcctataacgttaaagggttgcgcgtggttgcccgcgatctagaccggctagttcaaaaagtggctattctcggcggtgatggcggtgatgccttcaacgatgccaagcaagctggcgccgatgtctttatcactggcgatgtgtattaccataccggtcacgatatgctagccgccgacctgcccgtgattgatcccggccaccatatcgagtcgattatgaaaggcaaagttgcgactttgatcaacgaatgggccgatgcagaaggatgggatgttaaagccataccatctaaactatcgactgatccgtttactttcatgtgattgggaaaaattttccagtaaatgcgatttttaaatggaattgacaaagagcaaaccacatagcataggtgcgaaaatcttacactcatgctaaaataaagcaaattaactgtcggcttttgccgccaaaggagcgaataccatgccattagttcacattgatttgattgaaggccgttcaccggagcaactgaaagcccttgtgaaagacgtgacagatgccattgtcaaagatactggcgcacccgctgagcatattcacattgttcttaacgaaatggctaaggaacattattcagttgccggtgtacttgcatcagataaggcttaacgggtggctttgagcaatcagtgccgggtcacagaagggaagggttcaacgatggcagacaccagcgatcaggcagcctcacaagatcaggcttattttgataaaatgaaacagcaaattcttgacgctttggaaaccgtcattgacccagagctcggtgtcgacttaattaacctcggcttgatttatggggttgatttagatgaaagcggcaaatgtaccgttgaaatgacattgacaacgatgggctgtcctttgacagacatgttggatgctgatattaaacgggcactgacaacgattgacgggattaccagcgttgaaattcatttagtttggtatccagcgtgggggccagaacgcctcagtcggtatgccaaaatggcgctgggcattcattaaccggcgtttagacacggaatgcaaaagccgccgtttaaggcggcttttgactgtctttcaggcagtcaacgcgatggatcacgagggtgaacatggactattggagcacattaaatcggctggccaaacaatatgcgcgcattggaccgcttaaatcacaactaactgccatgaaggattggcaagcatctattgcggctggtgtcttgccagcacatgcgttaccttggttgggacttagcacgccgcaaattgatgccgctttaacccagccacaggcgcagctgcaagaactgcttcaactagatcatttattgcataatttccgccgctacattgcctttcatgatggcatgtggtcatttgttcatgaagatctgtttgcgacctggcatcgactttatggtcctcagcggtacttggaagtggcagctggtaatggttacgtgagtgctggtttgcgcgcacaaggcgacaaaacgatcacaaccgatgcgcacacttggacgaaagaaaatgtcactggctgtcagccgcttgttccagttaaaaccgccacagccaacgcggcgttgttcctctacgcccaacaagttgatgctgttgtgatggcttggagcccagataaggatcctaatgatgtccggttcctgcatattatgcaacactattttcccactaaacaattattcgtgatcggcgaacgcaacggtgcaaccaatagccggttattttggcaagaagcccgaaccgttccggatcggcgattattcgcgcttaatcgtgcgtttggtcattttgatgcgattcacgaacgagtttaccgattacaatagtctctgtactgttggcaaatggcttatttgtgcaggacttgaggaggatgacgtgaaaaaattattcttgattgatcttttatggatcggtttagcgatattagccggtttagtatggtcacagcatgatcaaaatgaatatgccagtcagcttgatcacctcggcatgtcggaaacggctcaggaatatgtcacgacaagttcgcgcagcatcaccaccgcgataagcgagctcgataaaactgatttcaaaggttatcaggtccagtttgttgctaaacaagtcgtgtacgtttatcagcgtggcacagttgcgagcctgccactcgatagtggtcagtggttctcggctggcgattttgcctccagtctgccggtgacggtggttggccgcgatcttgccgataaactgtatactggcagtaataatcaacgttatttgcaagtgaatggtcaatatgtcccagtattgggaacggtgggcacacgcaaaggcagcccgctaaataaagttatctttctcaacgcctctgcacaaactaccaatagtaagctgaaactaaagcaggtcaaaatctatgttgacggcgccagtcagcatagcaaggccttaaaaaccgctttcaaagcaaaaaatattcatcgggtccactttagcgatagtaatgcttcgacttggtggcatgcttatggtcaaacggcattgttcagcttattcttattgttgggtgcaggattgctgacgatgctcatggtggtcttaatggggccgttgcaaacagctggtttggatttgaatatgcgggcgcgttacttgcgcggcgttttatctagctgtggtggtcatattggcgtcagtctttttcttggtggcctttttgcaaactggtggttctacttcaccacgcgaactaatatttgggtctttcttgtcgttttgaccatcgctgccattttcttcctccgttacttgattcacagaaaggataaagctagtgcaactacctgaagcatttaaggaaaaatatactcgtttgctgggcgatgaagcagctgcttttttagcgacatttgaagcacctgcggaaagtggctttcggcgtgatccagccaagccgtggccattggacgagtcattaactgaaccaattccttggagtccgtggggttattatggcaaggtcgccggcaacgacattgatcacgttgccggacttgtttatagtcaggagccaagtgcgcagtttgtcggtactgttgcagccccaaagccgggtgaacgggtattagatttgtgtgcagcgccaggcggtaaatcgacccaacttgcttgctatttaggcgacactgggcttttggtcagcaatgagatcaatggtccgcggtcaaaagttttgtcaggcaatctggaacggtggggtactcggcagattttagtaacgaataatgatcctgacacgttggcaaaagcgtggccacaaatgtttgatcgaattttggttgatgcaccttgttcaggagaaggcatgtttcgtaaagatccggatgcaatccagtattggcatgcggactatcctgcgcaatgtgctgagcggcaaaagcagattctcaaagcggctgtgaagatgctagcaccaggcggcacgttgatttactcgacttgcacctttagtcctgaagaagatgagcaaatcattgcctggctattggccaataacgcgttcacgcttacgccgattaagcaatatccggggatggaagctgggcggccagcgtgggccgatggcaatccggaactggccaaaacagtccgactgtttcctcaccgattgcgtggcgaagggcattttgttgctaagctgaagttagcaggggcaccagcatcacatcaaccagcccgtttgccgcttaaaccgctagccaagccggcgaaggatgaagttgatgcgtttgtagcggcaagcctaaccaagcagcccagcggcctattttatcggcatggcgattttctttcaattttaccaacaacgatgatcccgtttgagcacgtgaaagtggtgcgtgccggtctggaactcggaagtttccggaagaaacgatttgaaccaagtcatagtttagcagctgctcttaatccggatgattttcaaactgtgattgaggttgatgcggacggttatgcacgttatcggcacggtgaaacgttgccaagcaaggtaagtggcaaacgttttgttctgctgacattcgagcataagccatttgcaattggtaaattggtgaatggtaccatcaaaaattattatccaaaagggttgcgtgtttgatatttagtaaagaagactcggttcggggcataactcacatccggtgaacgaggctgagccattatttgctcatcggacttgtgaatcattaaattccggatagtcgtaggaaggtgttaggctaatagtcccttgccgtgccgaacttcgcaatctccggccagatggggtggcgacgcgtagctagagcggagacggcgcttcgagcccgcaaagcccgcggtctcgaagtagcctaacaacatcagctccgaaaaccggtcgctgtgttgtttgcacggctgagcctcatctggcctacgattgctccgccttggcactacggtctttaaaatctcagcaactaatctatggataggtaaaaacgaacgactttccgatattaggaaaatcgttcgtttttatttgccgactgagaattgtgttgcaacattattcccttcgaataaaagttccagaagtcaatcatgacttggattgttttagggtcaaattcccggtaagccacgagcctgacgataatgttccaaatcagcacttagcacgattggggcttcttgcagctcctgccaattggtgacgcccaataacgcgtaaagttggcgcaattggtgcagaaagttctgaaaataggccagcgtcgcttcatagccagtttgaattaagtgatgaagcaccataccactcatgccgactgcatgagcgcccagccgcaatgccttcacaacatctaatggtgaacgaacgccgccagttgcaagcatggttagaccgagtccgcgcgcttcaagcaatgattcaaccgttgtctgtccccagtcttgtaaataagcaaaatcgtggcccgaacgacgagcattttcgatcgtggcaaagtttgttccgccgcgaccgccaacgtcaacaaattgaacccccagctgttgtaaggactgaagatcttcacgaataaagccattaccgacctcttttacgacgatagggacttggctagtcgcaatgatgctcttaatgttagcctgccacataaagtcgcgatcgccctcaggcatgaccacttcctgagcagcattgagatgaatttccagtgcattcgcttttaacattgccaccgccgcctcggcagcagtcgcatgatgaccggcgccaacattagctaaaataaacccgtttggatcatgatcacgcagcgttgcaaaagtcgggactagttgcggatcacgcaatgccaccgattgcgatccgctggcaatcgccacccccaaagcttgggcgagctggcctagctgggcgtttaacttgccggtttgtggcgagccgccggtcatggcattgatataaatcggccattgccaattaaacgggagatcaggttttagatccaccgcagccatggttgtttccggcaaagctcgatgcaaaagacgaacctgatcgaaacccgcatgagcaacagattgaaagtatttttcagctagaaaaacatgttcatccttgcgatgcgattgctgactttgtgtcatcaaattgctcctttgtgatgatgctggcatccggaccaaggcgtgtgctcaaaatccgatcaccgaacacagggcgcaaggcggttaataaaatgtccacgtaaggttcagtagtcagaattttgacatttggtcctgcatccatcgtggcaaacgcgggaatacccaaagcccgttgttcttgcactaattgccacgcccgtaatgtttccggcagaaagtaggtgaatggcggttcctcggccataatcgccgcatgcatgcgcatactagacaattctgtcaatttgccgatcagcgctaagtcgtcttcagccaacgcggtaatcattggttcaattaaactttcatttgaggccacccaggcatcatagtagggacttgtggccactgtgttggccatgccttttcgtgaactgaccgcctttttttcagcagataccgtgaccacaagcattcgtaatggcaaactaggttgaatcgcgagtggttcagcgaatgaagaggcgtcgtcatggccgcgatgccagataacggcaccaccaaagatagagcgcgttgctgaacctgatccgcggcgcgctaatcttgatagttcagtcggagaaaggtttagacctgccgcgcggctggcagcagtggccaaggcagcaaaagcagaggctgaacttgccagcccggcagcagtcggcacgtgattcaaggaagtgacttgggcgtacgtgctaatttttcctaagtgccgaacccgatccaaaaagcggctgaccgcaaccgggttttgttcttcaccgttaagcatgaagcgatcatcatttagactaggatcaaatgtcactgctgtgtcagtataaaagtcatttaaagttaaagaaatgctgcttgtggctggcagcatcaacttgcgattggcttttccccaatatttaatcagcgcaatatttgtgtgcgcgcgtgcataagtcgtcataatagcctcatttcgattcaaaatggtattcccacactttagccgcattagcagctttaagcgccgtggtaatcgctaccgcttgatcactggctgctaaagcaatcatgcaaccacccatccctgagcctgttaatttagcgccataagcaccgttatcaatcgccacgttaatgagacggtcaaggtcaggactgctaacgccaagtgcagacagatcggcctgatcgcgattgaacagttggcctaaggtaataatatcatcttgcgccaacgccaatgctgcctggcgaacggtgtcaccgatatccttgatgagcggccggtacattttgggattctgctttaaacgatctgccactgctccaactgcaattttagtttgtccggcaacgccagtatcggcaattagcaacacaccgtttcgtggcatcatgatcgagcgcggcgccttaccacggacgaaccattgcggccgctcagcgctagccgtggcagcatcaagaccgcttggattgccatgcaaagctttttcagagacagcggcccagttcagtaatgtgtcgtgtgatagcgatgtttgaaatgcatcgtaaaaagcgcgaacaactgccacagcggttgcggcagatgagcccataccgcgctcggaaggcaaagcactcgtgatggttaaatgaaatccttgattcttggcgttaaagaagatcaataaacgtcgaataagcatggcaataccggcaaaattggtcaattgaccagcatttaaatttcctgtgaaaaaagaagacgtcacagtttgtctgccatccggctgaggcgtgacgcgagctgacaagccgacactcttcactggcagtgcaatggccggttccccatacacgaccgcgtgttcgccaagcagaataatttttgcataactttttcccgtcccgatttccatataaacacctcgtcaatattctttattaatgatagcgcaaacgcccgtcaggcactacttagatatgctagactaaagcataatgtaacagagcgtgagcagccgcgcttagaaaccggagcataagcggcctcaagcctaaatggctgggttttggccattcaggcttgaggtccttatgtgcaggtttctgcggcagcgaacgcgtttagacagagcgtgagctggcccggtgagaaacccgagtgtaagtgaccttggccgtgatggccgggttttggccattgctgccaaggtgcttacatgcaggttgctgcgctggggagcgcgtttaaggaggtaggtagcgcatggggctgcaattcattttaggagacgcaacaacggaccacgctggcacgatggcgacaatggtccaagctaatctgcaagccgattcacaaaaccaaattttttatttagtccctaatcatatcaaatttgaagccgaagtcgacttgttgaaacggttgcgggcacaagcagcatccgtcaatggtgtatatgcgcaaaatcgagtgcaggtgctgtctttctccagacttgcctggtatttccttaaaaacactgcgctttatcaacagccacgacttgatcgggccagtaacacgatgttggtcgcaaagatactgggtgaaagcaaggaagaattaacgatttatgctggcgaagcgcataacactgggtttgtgacacaactggcggatcaattaagcgaattagtgaccggtcgtatcacagcagaagatctgaatacgacagtagccgctttaacaccaggcgatcggcaccgtgctaaattgcgagatctggggatcattctggatcattatgaagcggaaatcggcccttatgccactaatgccagcctactaagtgggttgcaacaggtgatgcgcaatcaggacctgagccacacattcatttatctcaatgacttcaacgtcttttcagcttcagagactggattggtcgaaacaatgattgaaacggctgctgaggtgaccgttagtttagtgctggacaagccatatccggctgcgccgccagtggcacctaatttattcttacctgcaggccggttgtatcaccgcctttatcaaaaagccaaaacgatgaaagtaccgatccggctagatcgttttgctaaaccgcgtccgctaagcgaaggcatgaagcaccttgctgattggtggcaaacgagtaccaatttacaaccacaggcgcctgcacagacagcacagaacaaagaagttgagttggcagtggcgactgatccatatcatgaattacggacggttgcccgtcaaatctatcaagccgtccggcaaggtgcacgttaccgcgattttctgattttagcccgtcgcttggatccatacgcagcggtgattccggccatctttgaagaattcaacatccctcaatttactgatctcgaacggccaatgaaggatcatccgctagtcgtactcattgaaagtctttttgccatacaagaccacgattatcaatatcaggatgtcatgcgccttttgcataccgagttgttactacctgagaatatggatatcgcggcttttcgtgatgctttagacacaacagataaccatcttgttcgcactggcattaccggcaaaaaacggtggacacagaccgacccatggcgctattttcagcgcaatcctaacgctgacgattcgcaacttgatcccgaggcagataaaactgcccagattaatgcaatcaagactttggttgcggacacggttccgcaattgctgcgtcaatggcagactgccaaaactggtcgcgaagccgcggccagcttatatcaatggctgcaaatgactggtgtgattgatcagctgaatgtgtggcgacaaaccgctaacgctgacggtgatttaagtcgcagtcaagccaacgagcaggcttgggataccttcacccaattgttaaatgactatgcgaccattttaggagaagctgacttcaatcgtgatcagtttcgagaactgttggcggccggctttgctagtgccacctacacgcagattccgtcgacgctggactcggtggttatttccgaaacgggtttggttcgtttggccaaggcaaaacacgtttacgtgattggcgcaacaaacaccgcgatgcctgatgtgcctaacgatagtggtgtcttaaatagcgaagagcggcaactgttggcggctcagcttccagatgaccgttttttacctgaacaaggtccgaccacaaccttaggcgatccttttatcaattatcttggatttatggcagcttctgaaaaactgacacttagttaccccatgcaaaacacgcaggaaaacagtgaaaatcaagcctcgccgtactttagacaactagcccaagcactgcaattaacgcctgctacttgggcaccggctgggttggggacatctctaaaagcagttctgggtagtcagcgggccatgctcagtgattttgttcgcgcggctggtgaagctcagcatcagaaattgcctttgagtcgaagttggcaaggcgttttggccagtctcaaacaaaccacactggcaccgttagctcagaagctagcaggcagtttgacctatcaaaatgaccctggacgtcttgatccgacattagcagtccaattgtacggtcgggacatgaatgtctcggtatcgcgattagagacgtattatcgtaatcagtttgaatactttttgaagtatggtttgcttttacagccgcgacctgaatttgagttatcgccagccgatactggtagtcttttccatgcggtgctggatcaatatctgactcagttgcgcgacgccggccagacattggccgatgtcaccgcggcagatgtagcggcggcggtcccgccattagtcgcggctatcacgaagcgcccgggttatgaaattcttggcagtacccatcggatggcttatttgacgagttgcttaagtcggttattgattcaagtgctgacgaacatgcgccagcagcaacgccggaccgggttccgtccgatgcgcactgagttgcagtttggccgaattggggataccaggggcttacctggcttgtcttggccgctgccgcatggtggtcgcgttaatgtacgcggcaaaattgaccgactagatgtctatcgagaatcagatgcgcagcgatttatggttgttgattacaagagcacgcaacatcggttcgatgacagtgacgcgtactatggcattgccttacagatgttgacgtatgttgaagcaatggcaaatgtcccagctgatccgccatttgtgccagccggagcactgtattttcacttacaagatcctaagttcaaattcagtaccgatcttgacctcgatattgatcgactaaaagcttttaaatatctaggtttcttggtagctaaagatggggcagacttggcggcggtagacaaaaccatttcagcagaaaccggtggacgcagcatgatggtgccacttggttttaaaaaagacggtgccttcaattataatcagtcaaacattctgacaccagaagatctaagtgcctatcttttgcacaatcaggcattgattattgatgctgccagtcggattttagccggggatatcgctttggcgccgtttcaatatggacaggaatccaccgttatcagcaacagcgattatcaaagtattatgctgttcgatccggcaaccgggtttgatcattacaatcatgtgccaaagttgaaacgcaaagaggtgcttggccgcgtcacaactgatcccacacaaattccgcatcatcgtcaggaggattcgcaagcatgacccaatttacaacctctcaacaagcagcgattacccacgacgggcatgacgtgctggtttccgcctctgctggtagcgggaaaaccaccgtgttggttgagcgaattattcaaaagattctcaaacagcatgccgacattacccggatgttgatcgtgacatttactcgtgcggcaacagccgaaatgcgaaccaagattcagacggctttgaagaaggcactcgccgagcgacgacatgagcttagtggtgaggatcggcgtcatcttgccaatcaaattgccatggttaatgcggctaaaatcagtacgctggatgcctttagtttgcaaattgtccaaacttactactatgtcattgatcttgatcccggttttcggttgcttacggatgaaactgaacgctacatgctgcaagagcgcgtttgggacgatttgcgtgaacaattatatgcccgtgacgaagcacctgcgtttgaacaactcacggctaattttagcggggatcgagatgatagcggtttgcaagacttgatgtttgagttgatccgccaagccggtgcgacaactgatcccaaggcctatttggaaggattggcaacgccgtatgcaccggaaaaatgggaagcgacctttagccaacaaatctggccgcgagttaaaggccaattgctgcaaatagccaccagtttgactcaggcgtcagcgttagccaatcaactgccaaacccaatttggtatcagcaaattcaggctgatcttgccccattgcaaacactattagaaacaaatgcacccacatacgatacagtccgcagtgtcttgatttcccatgaatttgctgcttggtcgcgcatcagtaaaggactggatgacgcagataaggacactaaaaacgcggcaaaagatctacgtgatgctgcaaagaaaacttggcagaacaaactggcaccaacttttgccttagctgctgagcaaattggcgatttgttgcgggaagctcaacctttagtggccacattagctaatgtggccttaaagttcgaagacgcgttgaccgctgaaaaggccgctcggcatgttcaagactatagtgatattgcgcataatgctttacgcattttgcaacaaaaagatccacaaaccggtgcaccaattgccgataactatcgcgcgagtttcgatgaagtgatggtggatgagtatcaggacattagtccgttgcaggaggctttacttgccgctgtcagcaccactacgccaggtgatcgattcatggtcggggatgtcaaacagagtatttacggcttccgactggccgatccgcaactatttattcataaataccaaacatttcaagatgcaccgaccgatcccgccgcgccagaacggattattttagctgagaattttcgttcgaccaaaaatgtgttggcgtttaccaatctgattttcagtcaaatcatggatccggaagttggcgatttgagctatgacaacgcagcggctttaaagtatggtgcgcttgattacggtgatgcgcatccggcagtgaaagtgttgttgtatagcaaagcaacatctgatgaagattcttctgatgcaagtgagttaccgggagatgctgatgataacgagccagtggacattgcgactggccaaacgcagctagtcttggccgaaattcagcgattaatcaacgatcccgatgcgcaactatgggatcgtcaggcgcaggagtatcggcgcatccactatcgcgatatcacattactgacgcgtcaaaccagtcaaaacagtctgattcaaacacagtttgctgcagcaggagtcccattgtttgtggccgataccaagaattttttcaaaacgactgaattgatggttatgctggcgcttttaaaagtgattgataaccaaaaacaagatattccgttagtggctgtgttgcgttcgccgattgttggtttgtcagctgatcagttggcactgattcgtttagcggcaaaacaggtgccatattatgatgccgtgacagcatttctacaagccgaaccaaaaacgccacttgctcagcggacgcatgacatgctgacgcacttcttcaaccagctcagccattttcgcgacttggcccgagaaaatgacttggtcactttgttgtgggctatctatcaggataccggatttcttgactatgttggcggcaccccagggggcagtcagcgacaggcaaatctccaagccttgattgatcgagcccgcacttatgaagcgggtggcttcaaagggttatttgcctttattcactttattactttgatgcagaagcaggatcaagatttggcaatgcctgcccaagtcgatccagataatgatgcggtgaagttgatgaccattcacaaaagcaagggtttggaattcccggttgtctttttgatgcaggcaaacaaacattttaatatgcgcgatcaaaccggcactgccattttgacaaaacaaggtatcggtattaaatggctagatcctgaaactcgcgttgaatatgaattaccccagtatcaagctgccaaagctgcacggcaaaatcagaccttggctgaagagatgcggttgttgtatgttgctctgacgcgtgcgcaacagcgactttacgtggttggcgcaacgatgagtggcaatcagctgacgtctgctgataaaacggtcgaaaaatgggctgcggcggcggaaggtgaagcgcgtgttttggcgccgcaagtccgcagtggggcaacgagctatctcgactggatcggaccggccttgatcagacatccacaggcccgtgggttagccgaaacaactatcaaacctgcgctcgtcggtgatgaaacggagtttacaattgaaattgacgtgaatccgcaagtcacaccgactgcaactccggaaaaagtttctgacgattcaggaacaatggtcgacttatctgcgtggtttaaaaaggcctatcctttccaagcagcaacaactacgacaggttttcaaagtgtttcagaaattaaacgcgcatttgatgatccagataccattgatctggtcaatgcagatcgtttcctcggtcccaagccaccgatgcgggatttaacggcgccagcgtttctgaccgaaacccctagtggcatcagcccagcagctattgggacggcaacgcatctattgctgcagctagtggatctcgccaagccgatcaccatggccagcttgagggctttgcgcgatcaattgaccaccacgcaggtcattgcggtcgatgtggcaaagcacattgatttgacggcacttattcgcttctttgaaactgatttaggtcggttgttattggctaagccgcagcaggttcatcgtgaagttccgttttccatgctgctgcctgctgaccaagtttttgaagcattggccgatgacccaggcgaggacgtcttgattcacgggattattgatggatacgtgagtgatgaacaaggcgtcacgctgtttgactacaaaactgatcataacccgaacacggccgttttagtggatcgttatcgtggacagttaaacttatatgcacaagctttgcaggatttacaacccaaaccggtgctgcatcgctatctggtctttttgcgcaccggaaccgttgtcgatctggtagcatcaggtgctggtaaatagtatgatatgaacagtatgtttagacgggaatgtttaaaatgaatgctgagaccatttttgctgtggtcgatttagaaacaactgggaccagcgtcaaagacggcgaccggatgatccagtttggatgtgccttaatgcagcacggcaaaattatccagacaatttctcagttggtgaatccggatcggtcggtaccagtggcaattcagcgactaaccggcttggatcccaatcgattagtcgcggccccttattttgaagaaatcgccaaaacgttgcatcagctgttgactgatacggtttttgtagcgcacaacgttaatttcgattatccttttttaaatgcggaatttgagcgagtggggctgccaaagctgcaattagctgcgatcgacacggttgaattggcgcaaattttattgcctgagattagcagttttcgcttgcctgatttaacaagttacttacaaattgagcacgataacccgcatcaagccgatagtgacgcgattagcacagctaagttgttgcgccagctggcggctcgctttcaggccttgcccagtccgacgcaacaggcgttggttgcgcgcggcagtggcttgttgcgggaaaccggcaattatttgaaggcaattgctaaaccgttgaaaccgttaaaacgcgggtttgttcaagttggcccgttggtcttgcgccgagtgccgacagcaactcaggagacgtttgcgtcagcagcttatccggcaacggatcttgaaaaacggcacttgctccaaccgcgctatcgcttccgcaaggcccaggcgcggatgatggatgcggtttttgcacatgcacaagagggtggtccccagccacttttcattgaggcaggaaccggtcttggcaaaacgcttggatatttgctgccttatgcttatgtagcaaccgccgaacataagttagtggttgcgacatcaacgcttgttttgcaaagccaactaattcagacggccattccgactttagccgctgttttaggcagagacttgccagcagtcgaggttaaaagtccgcaacattatattgatctcaacaagttcgcggctagtttgcatcaagaatcaccaagtcggcaaacgcagctattgcaaatgaaattgctggtttggttgacacaaacaaccacaggcgacctcgatgagttgcacttaacaacttatcgggcaccattgttcatgcaaattcggcatactggtgattcaggcacaccatttatcaacccgtattacacacttgatttttatcggcggctgcgtgcttccattgatcgggcggctatcgtggttacgaatcacgcttttctgtcacgccacgctgatttgttggaccttgaggcgccatttctggtcgttgacgaagcgcaacattttgctgataataccgccgctgcctttgcgcaacggatcgacttagcgcagattcggcggcagttgcgacatttgtggcgattgagtgatcccgatgaagatcgctcattggttaacgtctatcaaaatgatcggcagatgctgcctgtgttggcgcaacttaacgctctaacaacaacggcccaagaaacgattgaaatcctgcagcaccaaatatatcggcatttctttaacggcaagacaacggctgatcaagggtttgtgagtctgagcttggatcaagctgctattaattggttagtcacgtcccaaacagacaatattaagacattgatcaaagtcattggtcgcattcaggtcattgcgactaaactagatgcagatttcaatggccggcaacatttctttttgaaaagtgacggtcaacgatttcaagccttagccgcgttgacagtcaccctgatcgatcaacgtgaccgcttgaaattactgttagcgcgcttgccagaactggttgccggccaaactgccgtagcttctttgacgttgcggcaaatgcatgatgttagcagtcttggcctaagttgggacatttttcaggttggatcagccattcagcagttgctacagcggtttacggcaccggtgtttgtcggggcgactttaaccactgaccgttcgtttgactttttaaccgctcagcttggttaccatgacttaccagagacagcttttctaaagttacgcagtccttttcattatcgtgatcaggcaaaagtacttgtcgccacggacgctcctgcggctggtgcggtgagtgcagaagcctatgccgattatcttgccgcggcgattgagttgttggctgataaccgacaccaaacgattgtattgttcaattcactggcgaccattgccgcggtttaccaacgccttgctcatcgaccgattgccgatcataaagagttattggctcagggggtgactggttcggcggaaaagatcgccaagcgttttgcggtcggtgatcaaagtttattgctcggtgccgcaagcttctttgaggggattgattatccggatcggttgctcgaaatggtgatcttgacccggttgccgttcgatgcgcccgaagccgctatcaccaaagctcgatacgaacgacttcaggcagcaggccgcgatccatttactgaggatgctttgccacgcgcaaccttgcgattacgccagagttttgggcgcctgatccgaaccgaaaccgatcgtggtatcttcgttgtcctcgacccccgattcatcaccacacgctacggtcgaaaaatgcagaaatccttaccaaatattaagccaatgacgttgccactaactgacatgccggggtacattaagatgtggctagacagagcgtgagcaggcgcgtttagaagccggagcataagcggccttgaacttaaatggccaggttttggccatttaagttcaaggtccttatgtgcaggtttctgcgcctgcgaacgcgtttcagacagagtgtgagccagtccggttagaaaccggagcataagtggcctcaagcctaaatggctgggctttggccatttaggcttgaggtccttacgtgcaggtttctggactggcgaacgcgttttagccaaaagttgcgagcaggccatccgtaagcgccagagctcgatggccgagaaaactttggtcattactttcaaagcctgatatgcaggcttttgtgccagcaagtgcttttttagaaattttaattaccccacgtatctcgtcagctatcaaaaatcatctgaccatacttcgaaaggaggcaccccatgcgtcatcgtcgatttgactgggttaagttctttgtgattactggattgattgttttaattattggtgccattggcgtctacgcgaaaagcctctcaccttatcaacaactacgtgggcaagctgagaaaatcgcgacaaaccgcgcaaatctgaaaacgattaacggtttttggtggtataaccgcgacaaaagttatctgactgttgcgggtaataccaagaaaaatcaagccgtgtacgttgtgattcaagaaaaaacgggcaaagtcaatattttaaaccagaaatctggcatcactcggcagcaagcgttgcagcaaattaatcaaagtgcttcgccaaagaaaatcttgaatgcttcattaggaaaacgtgggtcagaattcgtttgggatattggctatctgtcaaagtctggtaaactaaactacgtgacgtacagttttcgcagtggcgaacagctgaacgcgatcaaaaacttataaataaagtatgattcggcagcgcaaacaactgccggaactgtaggaggcgcagtcgtgcatttagcaaaaagaatcctcaacgtcgcaccatcagcgacgcttgcattgagcaatcaaactaaggctttgaaggcaaaaggagccgatgtcattgatctgtccattggtcaacctgattttcagacgccgaaaacgattgatgaagcggccattgcggccatccaagccgggaatgctagtttctatactgccgcgactgggatcccagaattgaagcaggccattagcgaccgcattttctcgcaagacggtgtgcgttatccagctagccagattgtggcgacgactggggcaaagtttgcgttatatgctttgtttcaagtttacttaaacccaggcgatgaagttttgatcccggtaccatactgggtttcttacgaggaacaaatcaaacttgctagcgggacgccgcatttggtcatgccatcggaaggccacaaagtcagtgttgatgatcttgaggcggcgcggacggacaaaacgcgtgccttaattatcaactcaccgcaaaatccaagcggggttgtatacacgcgaacggaactgacattgattggtaactgggcactgcaacatcatatcttggtcattaccgacgatatttaccgcgatttaatttacaacggcacaaccttcacggcaatgatcagcatcaaccctgacattgtggccaacaccgttttgatctctggtgtttccaaatcgtatgcaatgactgggtggcggattggttatgctgccggaccagaaaaactcatgcaggcgatggcgacctttatcagccacaccacctcaaatccagcagctgtgtctgaatatgctgcagtggccgcattgacgggcgatcagcagattgtcgaaaccatgcggcaagcatttgaggaacggctcaaccttttttatgatttattagccgaaattccggggtttgacatgggagataaaccacaaggcgccttctatttattcccgaacatcaagcgagcggcacagttgagtcattatggtaccgtcgatgactttatcagtgcgttgcttgcggaaaccggcgttgcaatcgtgccaggccgcgcatttggtatgcctgaccatgcgcgtatcagttattgcaaggatctagacagcttacgcgaggccgcacgacgtattcgagaatttgtgggcaagtaattatttaaattagaaatagggagttaacgcatgacggaacagattcgcatcattgatgccaaagaacatgtgaacgaagaagttaaaattggggcttggttgaccgacaaacgcagctcagggaaaattacctttttacagttacgtgacggttcagcttattttcaaggagttgtttcaaaagctgatgtcccagaagaggttttcagcttagctaaagaactgcgccaagagtccagtatgtggattacgggtgtgattcatcaagacagccgcagccactttggctatgaaatcgaggttcgtaacatcgaactggttggtgattcgcacgactatccaatctccccgaaggagcacggcatcgaatttctgcttgatcatcgccatctatggttgcgttctaagcgccaatttgcgattcaacaaattcgcaatgaaatgatccgagcaacgttcgagttcttcaataacgaagggtttatcaaaatggatccgccgattttgaccgattccgcaccagaaggtacgaccgaacttttcgaaaccgattattttgacaaaaaagcttacttgagtcaatcaggtcagctttatgctgaagcaggggcaatggcttatggcaaagtcttcacctgtggtccagttttccgagctgaaaaaagtaagactcggcgccatttaaccgaattttggatgattgaaccggaaatggcattctgtcaccaagaagagagtttgaaggtccaagaacgctacgttgcctatctcgtgcagtccgttttggataattgcgcctatccgctgcacttgcttgatcgcgacccagaagtactcaagcaatacaccaaattgccatatccgcggatcacatataagcaggccattaaaatgttgcaagatgccggtatggacgtcaagtatggtgacgatttcggttcaccggaagaaacctacctgtctgatcaatttgatcaaccggtgtttgttttgaactatccgaagacgatcaaaccgttttatatgctgacagatccggaagatgatcagcaatatgtttgtgccgacatgctggcacccgaaggctatggggaaattatcggtgggtctgaacgtgaaaccgactatgacacactgaagaatgctatcgaacatgctggacttgatttagacgaatacgaatggtatctcgatctgcgcaagtatgggagcgtgccacattcaggcttcggtcttggacttgaacgggcaattacgtgggtctgcaagctggatcatttacgtgaggcgattccattcccacggatgatcaaccgtttgaaaccatgatgacaatcaaaagtcggacgcctgtgcgccggctttttttggagggcaagcaccatgacggatttcaaaacttatcttgaggcagggcagttcagtctgtcgaacctgctgtttgatcactacgccaccttggggttaacccaaaccgagttcatgacttatttgttcattgatcagtggcaggcaagccatcatcaggcaccggatttgaaagtgttagctgcccgaatgaacgttgccccaaatgcgatttatagtgccattgagacgcttattcaaaaacaagccattgctttggaaagtgtcccggatggtcatggtcggatgcgtgatcattatgatctcagtccaatattggctaaactgccaacctcagctggtggcacaccaaccccggcaacttcgcaagcaaatgttgatgcgcaaaccaatgtattcaaccaaattgagattgaattcggacgaccactatcgccaattgagcaagagacgattcgtaattggcttacaaccgatcattatctaccggaagtcattttactagctttacgagaggccgtattgaactcggcttattcgctaaaatatatggatcgcattttgttgaactgggaacgccgcaatcttaaaacgccacagcaggttcaggcagatattagacgtcatcaggagctgtgacaaagccgcaatgacaagcgccaggaaaaccttatatgaaaattcacccatcattagcccaagaggaggcaccatttgtgaccgatgctgaagccaaacaactatttgatcagatcatggcactttatcctgatccgcaaccaaccttgcacgccgaggatccatttcagattcttgtagccgtcatgttatcggcgcaaacgaccgatgtggccgtcaatgcggtcacgccaaagctttttgcggcttatccgacgcctgctgacatggctgcagcgccggttgaggcgatcgctgcgatcattagccggctaggcctttatcgtactaaagctgcgcatttgaaagctttgagtgatattttggttaaggaatatgcaggtaaggttcccaacaaagcggctgacttggtccgtttgccaggcgttggcaagaaaacagccaccgttgttttaagtgatgcattcaacattccaggtgtggctgtggatacgcatgttagtcgaattgtaaaggggttgggactcgtcccgcaaaatgcgacaccggttcaggttcaggcgcgactggaagccttgatgcccccgtcagaatggattaaacttcatcgcagcctaattcgttttggccgggagtatttgcgcgcccgtgatccgcaagtgccagcagggacgcaatgggcgtttttagaaacacattatttacctttagggggcaaatcatgacagatagcattgtgccatccaaacgaaccgttcatcgggaaagttgggatcagtattttttggagttagcggagaaggtctcggaacgatcaacctgtgagcgagccacagttggggctgttctggtgcaagaacatcgtatcattgcgactggctataatggtgccattagtggcgatccgcactgtgatgaggctggccatttgatgcgagacggccattgcattcgcacaattcatgccgaaatgaacgcgattatccagtgtgcggctaacggtgtcagtacccatggtgcaactgtttacgtaaatttttttccctgtcttaattgcaccaaagccttgattcaggccggtatcaagcgcgtggtttatgcgcaagattatcgtaacgatccatacggcgaagccttgctaaagcagcatcatttggatgttgtgcgcctcagccaacaataatttccataaaaaataagcctcatccgcttcttgcattgccgtcgttaggcaggtgcaagaagcggatgaggctattttttagggtttactgaagcagcttagtcgttatcaggggttgttactaccaccgctgccgctaccagaacccgaaggcgtgcttggttcgcttgaactggcacttggttcttgatttgaaggttgagaggaggcagaggctgatactaccggctcagagctggaaactgaacttgagctttcaatactttctcgtgaagaggaactaacagaactgcttgagctcgaggaagaggactcgactgccgctttgcggctgcttgggccgtgtccgcggacgtagagttctttagtcgtatcaccagatccgccggtaatggccgttcctggattacttcccttgagaatattataagactcaactgtatcaggcttggtccaatcacgattggtcagactctgtgacgtataagtcattagtgctttgtatatttcttgtgaaatggtctgttcagcatagttaatcccgtgtgaagtcggtttatcataaccggtccaaaccgaaatgactcggctacgtgtataacctgtgaaccaggcatctttggcaatgccagttgcgttcaatgcggggttttgttggagttcggcatcactatagtcagtcgtcccagttttaccagcttgatacagtccagaaatagccgccgaggtcccggttcctttggtcagaacgccttttaacatgtcagtaattatataggcggtactggacttcatagcccggctgccttgactattgaaggtttgggtattgccatcagcggtgacaactttgctaacatagtacggtttatagtacgtgccgccgttggcaaaggcgccataagcaccagcttcttgaacggtattgacagaagcaccgatcgcacttgagagatattgttccgaacttggcaaattgatccctaaaccactgaggaatttaaccgcattcgccatgccaacagtactaagggtcttgaccgctggaatatttcgtgattgttcaagtgctgtccgcatagagatgcgtccttggtacttcttgtcccaatcataaagtgaaatgctcgtgcccggatacgtgtacggttcatcggtcatctgctcgtaagtggagtaattcagatattcgattgctggtccataatccatcaacggtttcatggtagacccattgctacgtgtattttgtgcagcacgattataggccaatcggacgtcgccagtttttcgaccgccgatttgtgcgagaacctgaccattgtttggatcggtcatcgtgacaccggtctggaaggcatcatcagggaagttaacgtattcgtcagtgttaacaatgtcataaagccgacgctgggcgcccatatcgatattagtataaatatccaagttgtcggtatatggattaaggccggtctttttcttaacttcggcaatcacttgagtgaggtaagaatcaatcactttgtcattggttgcggtattagtttgctgctgttttggctttaagccatcagtgattggtgttgctttggcttgtttagccgccgtcgcggtgatctttttatcacgcaacatggcatcaatgacggcattgcgccgttgagttgctttttgcggatattcatagggatcataaccggctgggctttgcggcaggcctgcaataaacgcagtctgcgcaagcgttaaatccttcagtgacttgttaaagtaaaacttagcacccgtgctcatgccatattgaccatagttcatgaaaactttgttaatgtaatactctaaaatctgatccttgctatatttttgttggacctgcatggccaaccaagcttcttgtgctttacgccgaagggtttggtcggaggatttggtactgaaaaccgacaatttgatcagttgttgcgttaaagtcgagccgccctgtaaaccatcgctagtgcctgttatattattaaacgctgccccgatgattcggacaggatcaacccctaatttctcatcataaaagcgccggtcctcaatggagacgacggcatcttttaattgttgcgggatttccgaggccttcacataatcccgactttccaaaccaagtgtcgtaatttcattgccagatcgatcataaatggtactggaaccgcctgactctaattttgcctgagtcacttctggcgcgtctttagcgtaccaggaaaacaggccaacgccgagaatgaaaaatgccaggatcgcgagcaacgtccacttaagaattcgccgccataatcgttttggcggtttaggggcagatcctttcgtgaacttatcttcgcggcgtcgggccattcgcgacatattttgattatcagccacgcacattacctactttcgtttcaatcaaccagtcaaccccatcaagaaaggggatgaccggctgtagttgtggatgaagctcgaatccgtttgtgacaatatccttcaatggaatcgatttgcgaccgccgtctggttgtcggtcccaacagtcaatcagtcgaccggcagggaaaacaaagagacgtttcagggttgcaaaccgaatgaccacaaaacagatcccgctttgtttcaaacagcgccgaaaatgctcaatctgatgctgatgaaagttttttagcgggaagctcgctttatttttagtttccttggcttcaaagtcaaggtaaaatccacgataaacaccattataatctgttgttgacggcgttttaaaataggcctcgcgaatcacagcctgacttcgcttagggtagtcaactttcacaatctgaactggggtcggtttcttgtagacgaccgctttatcaatactgcggtaatattgattactgatgttcaattcttcttccaacgtcataccgcgtccaccatagatagttggacgcgaaatagcttgtgatgaaaattgcgtcccgtctttgtatggattaccattagggtaatgaatggtcatgcgatcacactccttgtgctattataccaatatcagccgctttggcctaataatcggaggtaagtcatggttggaaaacgattatgggtcacggggtaccgtgcctatgagctcaacgtttttggcagtaatgacccaaaacttaaggtacttaaaacttcattaaaaaatacgctcatgcagtttcttgatgaaggcttggaatggttaattactggcgggcaattaggcgtggagcagtgggcagtcgaggttgctttaggactcaaaccattgtatccagattttaaaattgcgatgatggttccattcacagattttggcaagcagtggaatgaagataaccaaggtcaactggcggccctacgtggacaagtggacttttctgatgcggtttcgcaagcaccgtatcaacaaccagcgcagttgcagggctatacccggttcatgaccatccatacagatgcagcgctgctggtttatgatccagaatttccaggtaaagctaaatgggattaccaagcagcagaggcgatggctgaccgtcgtgattatccagttcagctcattaccatggatgatttagaagaaacagcgcaagcaatggcagaagctgaaaatgagcattttcaaaatgattgagatatggtaagctaattagtagtttggttccatgaaaacaatgaggtgtgtcggaatggatagtaacaaagagacaaagtttagcatccagtacgggcctaaggatattttggacaagaagttcaaaaacaaggtccgcggttatgatcctgatgaagttgacgaattcttggatggtatcatccgcgattacgaagctttcaccaatgagattgatcgactgaaggaagaaaataccaagctgtttagccgggtcgacgagctgaccaaacagctgagtgtttccaagaatgtcagtgcgcagacgccgcaaaccaatgcggctgcgacaaattatgatattcttaaacgtctgagtaatctggaacgtcatgtgttcggctcaaagctatctgatagcagtgttgacaatcatgatgacggcaaccattccgacgttgaccaatattaatgatcacatgtaggtcctgagtgatcgcggtctgcttttgcaggctgaggaaagtccatgcccgcacaagctgagatgcttgtagtgttcgtgctaagcccaataagcttaggggccgtgtaaacggctacggcggccaaacgcgctaaggcgtcagctatgcgctagtaggtctgaaaagtgccacagtgacgaaacgatcagggaaacctgagcggtggaacgggtaaaccccgcgagcgagtaacccaaacttttggtaggggcgttttgccaagcaaattgaagcgacggcaatacagcggtaacgctgagatagatgatgactgaaggagcttgtgcctgaacaagttctggaacaaaacatggcttatagggatctacatgcaggcacagcccggggaaacccgggctgtttttttaagagcggaaacaaaagcgtttagaaaccggaatgtaagtcgccttgaccctaatgaccttacgttggtcattagggtcaaggtccttacgtgcaggtttctgcttttgtttgcgcgtttcggagagccaacagagcttttccacacgggggtgggcattgtcttgcttcaagagcccttacacgtcaatttctgcggctttttgcgcgtttaaaagaaccacgaattttttaccttcaaattccttacacaaaaattcctgtgatcatcacgaccactttctaatcaccaattcaagtaccattttcccccaaaccatctcaaaaacttgtaaactaaaactaaccactaaaaacgctgcatgaatgaaaggaaaacccatatgagatatcaacttgttgccacgatggctgccggacttgaatctgtgacaactaaagaattgaaagcccttggcattcaaacccgaacagaaaatggtaaggtttattttgaaggcgatgataagacaatcgcgctaaccaatgtttggttgcgtagtgccgatcgaattaaaatcgttgttggtcaattcaaggcgctgactttcgatgcgctttttgaaggcgttaaggcgttaccttgggatcactacctaccgcttgacgcagcgttcccggttgagggccgagcggttcgttcgcaattacattcagaaccggacgttcaagccatcaccaaaaaagcaattgttgaaaaaatgtctgcggtttatcatcgcacgacgcggttaccggaaactggcgcgacttacccgctggaagtttcgattttaaaagatattgcaacattgacgcttgatacgactggatcaagtctgtttaaacgcgggtatcgaattgccaaaggtgaggcgccgttgaaggaaaactttgcggccgcgttaatcatgttgacaaactggcatccggatatgccgtttgtcgatccaaccactggttccggcacaattgcgattgaagccgctttgattggccataacattgcaccgggtctgcaacgccaatttacttttgagaactttggcttttttgaccagccagtcttacaaaccgtcaaagatgaagcgatggatcaagctgactttgatcgtgaattagatattcaggcaagcgatattaacggtgacatgattgatatggccaagttgaatgcgcaacaagcaggcttgctgcatagcattcagtttaaacaattggcggttaaagatttttcgacgagcaaagaagacggggtcattgttgccaatccaccttatgggaaacggctcaacgatcaggccatggttcgacaattatacgcagaaatgggccaagcatttgcgcctttaaccacttggagcaagtacattttgacaagtgacatgggctttgaaaaggcttatggcagcaaggcaaccaagcgccgcaagctgtataatgggactatccgaaccgatcttttccaatattggggcaaacctaactggcaccatgatagagcgtgaccaggggcggttagaaaccggagtgtaagtgagcggccttggctgtgatggccgaactttggccattggagccaaggtccttacacgcaggtttttgcgcctacgtacgcgttttttgaaaaggagtgcgacatgatgaagattctaaacagctttagtctgaagccggagcagcgccaaacacttgaagcagcgggacacagcgtcatcgatgctgacaagcttgatgatgccacggctcaacaaattgacgtggtttatggttggaatgctgcggctacgcgcgtgaactttgaccgacttcagtttgtgcaggcgatgtccgctggcgttgattatttaccattggctgagttggctaaacaccatgtcttgctggctaatacaagcggcattcacgccgaacccattgcggagtatgtgcttggcgtcttgtttacgatcagtcgcggtattttgccagccattcgagcagatcgcgacatgtggacattacgtcaagagcgaccgccaatgacattgcttaagggcaaaacagcagtcatttttggcaccggtcatattggatcaacgattgcgaccaaactccaggcattgggcttgcatacgattggcgtgagtgcacatggccgtccagctgcaggatttgaccaagtgatgacggatgtggcgacccatgaggcagcagggcgagcagatgtcgtcatcaacgcgttaccattaacgccagatacaaaacacttttatgatgaagcattctttgcagccgctagcaaacaaccgcttttcattaacattggccgtggtccgtcagttgatatggctgctttgacgcaggcattgaaaaacaagcaaatcagtgctgctgccttggatgtggtggatccggaaccactgccgcaagactcaccattatggggcatgacgaacgttttgctcacgccgcatatttcgggcacggtgccgcaattacgcgacaaagtttttaaaatatttaatgataacctcaaaaccttgatatcaagcggccaattggcaagccatcaagttgatctcacgcgcggatactgaaatttttcgacacaaccgttatactgaagctgtaaccgatttcagtcactgcatcgtcgctgactgatgttcaccgcggctagcagcgatgcgcattgagacatctgcggacaggtttttcgctcgtctgctcttagatgaaggaggaattgcttatggcacaacgcccggaagaaattaccaacttgcttcaagatgcattgcacacgcagcatgaggtcgcgatcaatacgattgatcgccatcggctcaagggacgcgtggtcgatattgaggccgcgactgtcaaaccttataatgaacgcggcgtgatcaccgtggcaacaggtcggggagcgaaaaggattcaggcgtacgccattagtcaaattaaatataattgagcgatcaatcgctgatcgatcgaaggacagcctgttaaaggttgtcctttttgcatgaaaaaaggcggcacagcatttggccgtgctgccttaagttctaaaaactgatgcgattatggtacgagcaggttaaccacatcgtccttaggaatattggtgaagtactcattcgtgttgatggcatctaaagtgtctttaatggctgctgacgtgtaaggcttgccttttaacgcaccggcaacatccgcaacatccttaggaccaaagaaatcaccatagaatttgacgttagcaattttgccttccttgacatcgaaacgagcatcaatcgtcccatagtcaaaatgcttccgcttcttggtggtgaattccgggctatggccatatacccaatcccagttgttgtaaacatcatcgtaaatctttttaatttcgacttcgtcttctggggtgacgtgatactctttgtctttgatttcagcgatgtcatcaacgccgaacaaccgagtcaaaagaatatcgcggaattcaggaacagtgaggttttgatactttttatctagataaggccgcaagttcgtcacacggctcttaacagatttaatgcccttactcttgatcttgtcttctgggacgttcaagacgttaggaatcacactcatgtcaacatccagcatcaaagtaccatgggagaacgtcttgccgttacgtgtatacatagcactgccagagaactttttaccgtcgaccagcatgtcattacggccagaaacttcagcgctagtcgcccctaaagtatgaattgcatcaacaatcggctgtgtgaaggacttgaagtcaccaaattcttcagagtcactgtcaaccacaaacgagaagcacaagttattgagatcatgataaactgcgccgccaccggataaccgccgcgtcacaacaatgttatgatcctccacgtatttttgattcaactcttcaagcgtattctggtttcggcccacaatcacactcggcttttcatagtagaacagcagtaacggttcatcaaattgtttcgagttcatgagatattgttctgttgccagattctcacgaatatcatgagacttcataatgacataatacattttcaatcctcctgaatgatgactgccattgacgactagccatcgatttgacttcatgctccattttagcgggttaatcattaaaaagaaagcgatttcgattgtgaacaattgacttaatcagttcttcattgttctcaactaaaaggaatatggctgaaaagcgattcaaccgtgcacgcaaatgagaagtgcgttaagattatgacatatctgttcatattgaaaggggctttttaatgactagtgaagtgcgctaccaagatgatctgtaccgggcagttaacggggcttggacggatcaggcagtcattcctgatgacaaaagcagtactggcggttttcaggaccttgccgatgaagtcgaagaaaaaatgatggctgatttttcagcgattgctgacggcaaaaaaacgacgccagacaagtattttgcatctgcggtgacgctgtacaaacaagccaaggatttcaagacccgagacgcagcgggctttgcaccagccttgccgcaactacatttggttgctggcattaaagaccttgcggattacaatcaacgggcagccgaactgcttcaggagcatctgattgacccgccatttaatttctacgtagatgctgacatgaaagacaccagcaaaaatgtgattaatttgatgggtccacgaaccattttgccggataccacatactacgccaagggcaatcaaaacggcgaacaattgatgaccattttcaaagatatgatggctaagcttttagcttacacagatcttgacgctgctgcgcaaaaggcaactttagctggcgccttggcctttgatgcagaaattgcgaaacatattaagagttctgaagagtgggcagattaccctaaggcctataacccgatgccgacagcggaggttgttgaaaaactcaagccattcaagtttgctgacttcttacaaaagatctttaaacaggtgccagaaacggtcgttgtgaatgatccgcggttcttggatgagtttacgcagttgttcaacgaagctaacttcagcaattatcgcgactggttgtatgtcacccggctaaacagtcttgttagtcttttaagcgaaccattgcgccaattaggcggtacttttagtcgtgcgctatccggtgcgcccaaagcaccggatcaaatcaaacacgcctaccgattagccaacgctttctttagcgaaccaattggcatttactacggccgcacttattttggcgaaaaggcgaaggctgatgtaacacaacttgtccaaaaaatgattgccacttacaaacggcgactcagcaactctgattggctatcacaaccgaccaaggacaaggcgattcttaagctcgacaagatggtgctcaaaatgggttatcccgataaacctgaggacgtctacgatttgctgcacgttaatccggataagtcactgatcgataatatcaacgcgatgcaacttgttgagcttcagtacaacttcgacaagctcaccaagcctgttgatcgcaccgtctggaatatgccaggtcacttggtcaatgccagttatgatccttccaagaacgacatcactttcccagccgccattttgcaggcgccgttctattccctgaaacaaagtgcttccgaaaatctgggcggtatcggcgcggtcattgcccatgaaatttcccatggttttgacaataacggtgctcaatttgacgaacttggcaatatggtgaactggtggcaaaaggctgattatgcccactttaacaagctcaccgaagccatgatccaagaatttgacggtcttgaaactgaagccggtaaagttaatggcaaactcgttgtttctgagaacatcgctgatgctggcggcttggctgcggctttagatacagccaagagagaaccggacgttgatctgcatgccttcttcatcaactgggcaagaatttggcgttcaaagtctcgcctcgaacggcaaaaaatgctactagcggttgatgtgcatgcaccacacgaattgcgggcgaacattcagccacgcaatcttgatgattggtacacaacttttgatgtccaaccaggtgatgggatgtatttgccaccggaaaaacgtgttcaaatttggtaatcctttagcatcggctcatttgcagccggtgctttttttgaatcaggctgggatcttttgcaagagatgcgagtgactagatttaaataaattacccgtggcgagcgtgacttacaaaatagttgcgtcctgctgtgtgaaagggaatacaattgttgtcggatagggtataattgttataggaagccgtttgcgataaacaaggctgataggaagtaggggagtttatggaactgcagacgttgcgcaacttcattgaaattgctgaccacggcagtattaccgcggcggcacgaacgctgggcatttcacaacccggactatcgcgccaattaaaagacttggaaaaagagctcggcgttaaattgctagttcgtggtaatcgacgtgtgacgctaactgaagatggtacctatttgttaaaccgggcacgtgaactcaccgcaattgccgagcgcacaaagaataatttgcaaagtaaacatgcccttggtggtgacctttacattggtgcaggcgaaaccagcggcaaacggttggttcttcatgttgcccaagaattgcgccatcaataccccagtttgcatgttcatgttacctatggctccgatgaagggctggtggccaatcttgaggccggcatgtatgatttcatactgcgacctggcaagcagcagacgcagtatgaaagtttgctactgccagttcgtgatgcttggggtattttgatgaccagtgatgatccgttaactgataatttattgatgacaccaacggacattggcgacagtgaattaatcctgccgcgggccacgcacgcacgcaacacctttgaacactggttaggccaaggcatggatccggcttacattgttgggacttatgacctgaccgtcgatgcgcttgggatgactgctgtcggcttaggacgagccttgtgtcttgaatatttggccacccaaagtcctaacacatcattgaccttccgaccattagcaccagcattagcggacccagtagcgcttgtctggaaacgtgatcgcgagttgtccagaatcgcgcaacgttttcttagtatgatgaagcaaaccattaaagacagtgaatgatcatcgtcctaatcagaccaaaacaaaaaagccaccgcaaagcattgcagtggctttttttgttgccgcgacggctttatttgtcgtggtcttcatcttcagttgagaactgataatcatcatcttgcatcgcttcaacttgacccagccggtaaccattaccaacttgtgagaagaagtcatggttggcggtagacgttgaaatcccattcattacgattgggttgacgtcatcagccgtgtcaggaaaagccgtttcctgacctaaattcatcaaggctttgttggcgttataacgcaagaaagtcaaaacttcatccgtccagttggtcttcgcgtaaagatcgttagtgtacttttcctcgttttcatacaaatcgaacaacaagtcgtacatccaatccttcaatgtttgttgttcagcttccggcaactcgttgaatccgagctggaatttatagccgatataagtgccatgaacactttcatcacgaataatcagcttaatgatttctgccacgttagttagcttattgttgcccaagtaatacaacggggtaaagaagcctgaataaaacaagaaggtttccaagaaaacactggcaatcttcttctgcagcgccgaaccgttatgataaatatcattaattttgttggctttgtattgcagatgctcgttatgattggtccaatcgaagatctcatcgatttctgctggtgtgtttagcgttgaaaaaatcgaagagtaactctttgcatgcacactttccataaactgaatgttgttcaacacagccgtttcttgctgggtgcgaatattctgccgcaaacttgccatgccgtcctgactctgcagggtatccaacaaggtcaagccaccgaacacgtggccgacaacccattgctcgtcatgattgagagatcgccagtcgtccaagtcgttggacagcggaatccgggtgtctaaccaaaattgttccgtcaatttttcccaagttgctttatcaacttcgtcttcgatcgcgttccaattgatcgcaatatactgttttgccatgtttacgctcccttatgtaaaaacaggggaaactccccctgttaaaagattatcagattgagcagctttcacaagcgttgctgccgatttcttcttgatcatccgtgtaagtccggatgtagtaaatcgacttgatgcccttatgatgtgcgtaattacgcaaaatatttaaatcacgggtggtcattttatcggttcggccatctttccaaggataaaggccagccggaatggtactgcgcatgaacaacgtcatggccattccttgatcgacatgctgctgggcagcagcgtaaacgtcaatcactttacgcatatcaatatcataggcactttgatagtaaggcatcgtgtcattagaaaggtctggagcagggtagtaaatcgtgccgatcttcttttcttgccgatcttcaatgcggttaacgatcggctgtaatgatgcactggtgtcgttgatgtaactgatcgacccatttggcgcaacagccatgcggttctgatggtagagaccatctttcatgacactggtcttcagcgcttcccaatcagcctgcgtcggaatgtgaatgccatcaaacagcgcgcgaaccttgtcatacttcggtgcccatacttgctcggtgtacttatcgaagtagctaccgtccgcatacttgctgttttcgaagttgtggaagctttcgccgcgttcctgggcaattttattggatgccttcagggtgtagtaattcagcaaaaggaagtaaatattggtgaagtccaagctttcaggcgaaccgtagaacatatgattcttcgcaaaataagtgtgcaagcccatcgcaccaaggccaatgctgtgagcctggtgattaccgtgctggacggaaggtacaacgtcgatgttgctgtggtccgtgacataagtcaaagcacgaaccattgcttcgacactgcggccaaagtcgcggctatgcatcaggttgggaatattcgtgctacctaagttgcaagatacatcagtacccagcacttcatattcctgtttattgttcaacttggaaggcacctgaacctgcatgatttccgagcacagattactcatgatgattttgccttcgattgggttggcgcgatttgccgtatcaatgttgataatataaggataaccagattcctgctgaagtttggagatttcgttttctagatcacgggccttaatcttgtacttcttaatggccggattggcaaccatgttgtcatattccttggtgatatcaacataagagaacggcttcccgtaaacccgttcaaccgagtaaggggagaagaggtacatatcggcattagccttaatgaggtcataatacttatccggaacgacaacgccaagactgagtgttttaacccggtacttttcgtccgcgttttccttcttggcacctaagaaactgatgatgtcaggatggaaaacgttcagatacacaacaccggcaccttgtcgctggcccaattggttgctataggaaaaagagtcttccaacagcttcatgactggcaagacgccgctagcggcaccttcaatgcccttaattggggcaccggcttcacgtaggttggacaaggtgaggccaacgccgccaccaattcgggataattccaaggccgaattgatcgcccggccaattgaattcatgtcatcagtgatttgcaacaaaaaacatgaaaccagttcgccacggcgggcccggccagcattcaagaaggaaggggtggccggttgataacgttgatgaatcatttcatcagcaaggtcaactgccaagtcctcgttaccgtctgcaaagaaaagtgcgttggcaaaaacccgatctttaaaatcttctaaatactgggtaccgtcatcggttttcaaggcatactgtgcatagtatttgtaggcggccatgaaggatttgaactgaaaatgctgcgctgaaagaaattgatccagtttttccaaaaaagctggctgatacttgttcaaaaagtcggcttcataatagtggttatcgactaaatacttcagtcgatcagccagcgaatcaaattgcatcgtatttggcgctacattttcggtcaaaaatgcctgcaacgcttccttgtctttgttcaacggaatctggtcattcacaggaatgttgatctcgttgttgagcgcgtaataggtgacttgatccggactaattgtttttaatgacatgctaaaccctgctttcgctgcgttttataatagctggttgcgttgtgatgcgataaaaaaactggctgatcaaacagccagttgcttcaaggcgtccggtcggaacccggagaatgaatcgagcccatccgcttcaagaacaggaacctgctggaaccccttttgttttaagtaatcaatgtattgcggttcttcgttgatgttgtgctccgtgaatggaattttatgggtgtcaaggtagcgcttggtcatccggcattgcgggcagccattgcgtgtgaataaggtgatgttacgcataggtatcatcctttctcgttatcttatgtagcttaggatactcaatattggggtgtctgtcaattaaaaataccatatcttggggctatttttttgaataccccaagtgtatggtattggctgacacttttgcttacttttagtataccaagttcgtatggcgaaaaccagtcgcaaccgtcaactatttgttgaagctgaagagcaactttgtatcaacgtcacggtattgacgaaaaaacctgaccaaaaatatttgcgataaaaatcagttgagaccgtgaaaaaaagcttaaaaaaccatgagcatatcttatcgggttttttgctacctttgctatactgtagcaaacgctttcgaggaggccttctttatggtctttgatgaattatttctcgatcgggaagagcgagatcgcatcaatatctacagcacgttgtgggaggccccagggcaccggctggatattgctgccaccgccataacccgtggtgagagttaccgccaactccgacgccggatggaaaaaattgccgcagacttggtcacgatgcagtcagacgctgcaccattactgcgacgcggcgatggtaatatgattgcaccaccatcaatcagtctagatcgttatcgtatctttctatataggcggtccttgccgggacaactattgattcagacgctgaagcggcctcaattgacactgcagatgcttttggatgaaaccgggttttcacgagccgcctttttccgccgaatctcggctttgcgcctttatttgcggaaagccggcgttaccatcagcctaaatcctttagcgcttatgggaccggaagcccgcgttagacaagtttaccggcaattattgtggcagtttgtcgactttgcccatcccttgttttcggaaattttgccgcagtcgcgtcaattaatgcgcgaactcgacaaagctggtctgatccaatcagatttttcgcgggcacagcttctattcgcagctaatgttcatctacaccgattgttagcgaatcactccatcgttggtacccttgattttgacgaattggcacctcggccaacactaactgcagcactaccgagtgcgtttgataatctgccgagaaaggctgctgaggatgaaacatggcatctttttttaactcagtggcgcgtacctcggtttcactcggaacaacaatttgatgccgctactctagttggctatcacgcagcgcgtaatacacctgcatggcagttagtcgagaaaatccgcaacgagttcagtcgaacagttgtcgggattgccccgacagtaacaacagatctagcgttggcagggaatctcttgaagattttaatcagcgagcgcattttccccggtggcgcctatattgatctcacgcgaacagcgagtccaatgcgtgctttttatccgcgattagaagctgccttggaggcttttttcgctcgcgaagcgccattggaaaatgcatcaaaagagatcattgacgggttctatcaactgctgtggccatttatgacggacagtgcgattgctgataagctcaaggtagcacttgatcctttaatgccgcagccgttatatgaaaccgttcgtctcaacttgactcagcctgcgtatattcggctagtgacgactgagcaacagcctgatcttgttatctcggcgcaaaatcttgcgcctggagaagaacctattgtaccagatacaccagtcttttatcttgccagtgatcggtttgaaagctggtcacaactttatcaggaattattcgcgcgttcccgtaaattaatagcccactgaaataattgatttttgaaatgttcaagtttgctttgatgcctagcaccagcctgactacttttgatagctagtagcacatagcaaaggcactacgaccagctttaaaaaatggattagcaggcgcatacttgttttattgggagatgacaaaatgaaacgagacaagcaagccgatgaagccgccgttgtggatatgaatgacacgctcatggactatgcgcataaacgtcagccgcatgtcgacgatttggccgaagaattggctacacgggcgaaagataatatcaacgcgattgacgattatttaaaagatgatggtgaggcgcgtaaagagtatcaggcgattgccaccggctatttgcgtgataaatatgaccttgaaggtgacgatctcaccgctgcccgtgacgaacttgttcatgccgcgattcattacttagtcggccacaccaaagtcttggacgactggcaacgttaatgaagctttatatagtaaaaactggcgctttattctgacatcattcagaataaagcgccagtttttacttaaagaataggtgataataaccgcgagaagtcttgtttaaaccgaagccaactgctttgtttggcgattagctcaggcgtcagtaagtaactgcgcgccatatcagcctcgaaaatctggcccaagctactggccactttacgatcataaataaacgcattaatttcaaaattcagcttaaaactacggatatcgaaatttgccgagccaacgctggcgatggcattgtcgacaaccaccgttttcgcatgcataaagccgtgttcgtaatggtagattttcacgccagcgcgagtcagataattcgcatagtattgtgtcgcgcggaaaatgaacgggtgatcaggcatgtcaggaatcatgatgcgaacatcaatccctgacatggcagcggatactaaagcgtcgatcacagtatcatctggcaccaaataaggactttgaatccaaacagatttggtggcactggtgattaacttggtgtatcccaacttaatttgttgcgttgggcggtcaggtccggaagcaacgatctggataggcgttgcaccggctgtcaaactgtcggcagtgacactatcggcactatcttgttcaacactataagcaatttcgtcttttttgctgactgttgcattccaatccatggtgaagcgaatttttaaagcgtaaatcgtattgccgataatgcgcaaatgtgtgtcgcgccaataaccgaacttaggtttgcgggagacgtattggtcaccaacattaaacccgccgatatacccgacgtggtcgtcaatgacaacgatcttgcgatgatcacgatagttcaaacgaaagtcagtgatgggatgcttggaactaaagtaactttcggcttgcccgccaacgtcggtcagccggcgccaccactttgctgtagcgcccatggaaccccaagcgtcatataggacctttacaacaacgccttccttagctttcttgatcagcagttgctggaattgattgcctaattcatcattgtaaatggtgtagtactcaacatagatataatctttagcggcctcaatatcgcggaataacgccgcaaactttttctcgccatccgtgtaaagttgcacttggttatgggcaaggaccggtgcttgcgcggtattcagaaaaaaggcggttaaagccttggccgctggcgtgtaatcagtcggtggcaataacttattccgggcgttttcgtgcttttgtagtgagacaaatgcttttacgccagactcatattcgtgttgaatccgttgcaattttttcgttgataagccgcggccagcaaataaataaaaaccaaacccgacgatcggtaaaaaaataagcactagcaaccacgcccaagtcgttgagatatctcggacctcgcgtagaaccgtgaagattgccccgaaggtgtttaaaaccaaaataataagaataagccaggtaatcagcgacataccgcacctccaagaagaataagttcattgtactcaagcgaagcgaggctgtcacgttggaggggcaaataggaggatttgcgaaatatttgggtaggaggaaagaaaatgtcgatatttggggtttacttacttttagtcagttggtagaatgatacttgttttgaaatgcgtctgcaggcgcagaaacctgcgtgtaagaatcttggcggcaatgaccaaaacctggccatcaccgccaagactgcatacacgccggtttctaactgcgccagcgcacgctttaatttataaaaaggtggttttctcgtgaatcaagacttactgaatcttttaaaacaacgccggtcaatttatgcacttggcaaagatgttaaacagaatccggatgacttagtggatttgattgaaaccgtcattcaggagacgccgactgcgtttaattcacaaacgacgcgcgctgtttttctgtttggcgagcagcatgacaagctgtgggatattgtcgtgaagcggctggagagtgaagtgccgactgagcaggcttacgaagcaaccaagcagaaaattgccagctttaaagcagcttacggtaccattatgtatttcaccgatactgacgttgtaaagcaattggagaataatttcccattatatgcggcaaactttgcgacttgggcagaacaggcgcaaggttccgcacaacttaacacatgggtcaccttggcgaacaatggcatcggcgcgaatctgcagcactataatccaatcattgacgatttagtgcgtgaagcctttgatatcccgaccaactggaacttacgggcacaaatgccatttggttccattgaaggttcagcaaaagataaagattacatggatcgaaaagatcagtttaaagttttgaaataagcacccatcagcttaatttaaaattgtcgtgatgagacgacaaagttgggatattattcacaaccattaataaaggcaaccgtttccgtctacaaggaaatggttgccttttcttttctcagaaacaagcttttgttgaacttaatgatcacggcgccagtaccgacgagagtggcgtctggcaagaaaaattgctttttgcctcgattgttctagtcatgacgcaattttgccgaaaatttatattttagtttcagattggcgcaacccttgctgagctaacatatgggcgccgcgattggcccggtcaggcagccagtttggcaatactaaaggaaattgaccgattaaggtcagcaaacggcctgctaggtcgggatagtgcttagcgtattgcttttcaatcgcctgaatcacaagcttggaatcactgtagaaggcgaccggtgttgtatttaagccggcttggctcagcagttcaaaaccagcgattgcggctgcaaactcggcttcatgattactcattgctggcagtgcagcatgtttttgaatttgatggggcaagccactgaccaagatgccgatcccagcgggtcctgggttgccttttgtcgcgccatctgtgtatagtttaagcataatttctcctaaggaagtgtcaaagtgccagaataccgaactcattatcaacctgcctggatcgattttagcatgttttggagtatgatcgtgatcgggatcagccttgccacgattgttcagttagaaagtaccaagccatcgctgctagccattggcattgccgtagtgacagtgcttgttgcgatcattcaagtgctgcttcatcgtcttgttgtccatgaacaaggcctaaaactggttagtctttttaagagtaacaccttggaaatgacttggccggaaattgaggggtttacgtttggccatttgacagttattcttaaaaccaaacgatatggtcaagtgacttttgttttgttcggtaaaaaaagaaaacaaaaagtagtgtcgttgatccaaaaagggctgaaagagtccgccaaataaggagtgtgttgtatgtctgatattgaaattgcacaagccaatgaagcgacggcaatgtggccgattacgaaagttgcggctggtttaggtttatcagaagatgatcttgaactttatggcaaagccaaagccaagcttagttttagtgcacttaacgccttaaaggataaaccttttggcaaacttgtgctggtaacgtccatcaacccaacaccagctggcgaaggtaagtcgaccatcaccgttggcttaggggatgcgctgcaacaacgcggtaagcatcctgtgattgctttacgcgaaccgtctttaggcccggtaatgggcatgaaaggcggtgcgacaggcggcggttatgcgcaagtagttccaatggaagacattaacctgcattttacaggagatatgcatgcacttaccacggcggtggataccctagccgccttgattgacaatcatttgcaacaaggcaatacgctcaatattgatccacggcggattttatggaagcgtgctttagatatcaacgatcgcgctttgcgtcatgttacgatcggtttgggcggtcccacaagcggtgtgccgcgcgaagatggctttgatattacagttgctagcgaattaatggcagtgttgtgtctggcggaaaacattgccgatctgaaggcacgtatcggccgaattgtcattggatacacttatgaccggcagccggtgaccgtggccgatttgaaagtcaccggtgcgattgcgatgctattgcgagatgccttgaaacctaacttggttcagacattagaacataccccggcattcatccacggtggtccatttgccaacattgcgcacggctgtaactcggttttggccacgcgtacggctttgcagctcggggacatcgcaatcaccgaagccggcttcggtgcggatctcggcggtgaaaagtttatggacatcaaaacacctgtactcggcaagacgcctgatgcagtcgtcattgtcgcaaccgtgcgtgccttgaagtataacggcggggtcgcgttaaaggacctgcaaacggaaaatgtcgaagccttggcccaaggcttcgacaatctcaaacgccacatccacagtatgcaaagttacggtgtgccggttgtagttgcgattaaccgattcactagtgataccgatgccgaaattcagtttttaattgatgcttgtgcgaaactaaacgttaaagccgtcaccgccaccgtttgggctgacggcggacgcggcggattggcggttgcggatgctgttttggcggcacttgatcaaccggcgcattttactcgcttatatgatccgcaaagcgatgtcaaaaccaaaatcaagacgattgtgcaaaagatttatggcggagctgatgtcgattatgaaggcaaagcaaacagtgccttgcgcacgatcgttaaaaacggctggcaggatttgccagtctgcatggctaaaacgcaatattcgttaacggataacgccaaaacgttgggtgcaccggaagggttcacgattcacgttcgcgacatcatccccaagttaggcgccggcttccttgtcgtcatgactggctcggtgcttaccatgcccggcttgccaaaagtgcccgcagccttgaacatggatgttaccgacgatggcaagatttccggcctgttctaattttgtgtggtttttaatcagctcatgcgtaaccgccatttttaagatggggtttttctttgaccgcggtacactaggaaacaaacgcttttactcagggggaacttctgtgcttatttatctcatcatcgccgctgcgctcgtattaattgattttctgattaaggcgtgggttactgctcacattccattaggcgaaagccaacaactgattccaggcgtgattgatctcacgcacattcgcaatactggcgcagctttctccatgtttgaaggcaaacactggtttttctatatcacaaccttactcgcattcggggttgttgccatgctgtggcgcgacagtttgcacaaaccgatctatcgcctaggactaaccttgattactgccggggccatcggtaatttcattgaccgcttgcggtttcaatatgtgacagacatgtttcaccttgagtttttggatcagtggcgcttcaatgccattttcaactttgcagacatgtgcatcacgtttggggttattttagtgctaatttttatcctgttcgatcatgacaaggcggtggcgtgatgactagcacctttacgatcacgaccgagcaggggcgcatcgataaggttatcacggcgcatgaaaccactcacacgcgcagtcaggtgcaaaaatggttgcaagatggcttggtgacggtcaatgggcagccaaccaaggccaattacaaagttgctagcggcgatgtgattgctatctcaattcctgaagccaagccgctggaagctattccggagccgattccgctcgatattgtgtatgaagacgaccaagtcattgtcgtcgacaaaccgcagggcatggtggtacatcctgcacctggtcatccagatggcacactggtcaacggtttgttatatcatactgatttgccgggcatcaacggtgtcattcgtcccggcatcgtgcatcgcatcgacaaggacaccagcggactactgatggttgctaaaaccgaaaaagcgcaactaagtctctccgcgcaattaaaagccaaaacgtcgattcgtgagtatttagcacttgtccatggcacgttcaaagaagatgaaggcacaattgatgcaccattgggtcgtgatcctcgcgatcgtaaacgtcaagctgtcgtggcagacggtcgccatgctgttacccatttccaagtattagagcgttttgaacattacacgttcattaaatgcattttagagaccggccggacgcatcaaattcgcgtgcacatggcatacattcatcaccctgtggccggggatccactttacgggccaaaacgcaccctgcccggcaaaggccaatttttacacgcggctaaactgggattcgttcatccgacaaccggtcaattgctcgtcttcgaagcaccagtaccgccaatttttgaaaaaaccttagccgatctacgtgcaggcattgacaagacccgcaacgttcggtaatcttaatgcaatcaaacaagcacctttaactaagtccagtgaggcttagaaggtccattccgctgcggcggattattcaggctacggtcgccttctatcccaaattggattgaaggcgactttttttgtagagcgcgagcaggagcgcttagaaaccggagcataagtggcctcagatctaaatggccaaagaccggccatttagatctgaggtccttatgtgcaggtttctgcgactgcgagcgcgtttaggaaatgccagcatcggagcgtaacacccgcatcactgttcacttccaaagcaccaaaaccgcaatacatataagaaagggtggcacatcaatggcacagtcaaaacaagttgtagacgaggtaaccatgaaacgtgcattaacacgcattagctacgagatcatcgagcaaaacaagggactcaacgatctcgttttagtcggcatcaaaacccgcgggatttatttagcccatcggatcgccaagcgtctcgaacaacttgaagggttacaggttccggttggcgaattggacattcagttttaccgcgatgacgtccataagattgatcatgatcatcagccagatgttgaaggcgcacagttaccggttaatatcaccggcaaacatgtcattctggttgatgacgtcatcttcaccggccgcaccattcgcgctgctttagatgccttgatggacgaaggccggcctcgcaagatcagcttggctgtcttggttgatcgcggacatcgcgaattaccaattcgtccagattttgtcggtaaaaacattccgacctcattagacgaacaaattcaggttcaagtttctgagcttgacggtaaagacgggatcagcatcgaaaggatggagggctaagatggcatttcacaacgacgaagccgttttagatatcggcgacaagccaaaattcggtcaatgggttggcctttctattcaacatctgtttgcgatgttcggctcgacagttcttgtgccgatcttagttggactcgatcctagcattgcccttttttcaagtggggttgggacgttaatgtatatcctgatcacacgcggcagaataccggcttatatgggatcaagcttttcttttatcacgatcatgcaggccttgatgaaaggtgctggctatccggccatcgctcaaggcaccatcgcggttggggttgtgtatctcattgtggccttgatcgtagcgcgcagcgggtcagcatggattgaccgggctttgccgccagttgtggttggcccgattgtgatggttatcggcctatctcttgccggcactgctgccactgatgcaacgatgcggaccatcagcgccaccaagagcgtttatgacttacgttacttcgcagtcgcaatgatcactttagcctctgtcattatttataatatgtacctcaaaaaattcattagtctgttgccaattctactaggcattatcactggctatcttgttgctttgctctttggcattgttgatttgacaccagttcagcaggctgcttggttcgacctgcctaagtttgaaattccttttatcagttatcagccgcaagtttattggggcgcgattctctccatggcaccaattgcttttgtcactatgaccgagcatatggggcacatcatggtgctcaacaagctgactaaacgtgacttcttcaaagatcctggtttaaaccacaccctagccggtgacggtaccgcatccattatcgccggtctggttggcggcccacctgtcaccagttatggtgaaaacatcggagttttagcgatgaccaaggtccatagtatctatgtgctgggcggtgccgggttcttcgccatcttgtttgccttcatcggtaagcttagcgccttgatccgtagcattcccagtccagttattggcgggatcagctttctgttgtttggggtgatcgcttccaacggcctgcgcgtcttaattgacaacaaagtcaactttgatcagaagcgcaacctgatgattgcttcaaccattctcgtgatcggcatcggcaatgccagcctacagttctccgggtatcaattctcaggactggcgctggcaactgtgatcgggatcttcctgaactttgtcttacctgaacacgccgctaatgaagaagaggcagaaaaaaatgaccttatctaatttcacagatacatcctttcaagattttgtttccgctgaacaagttgatgacaaaagcgccatggctttgatcaatcgcgccgaagattttaaagctggtcaaaccgtccattttccagagccgatatacgcagctaacttattttttgaaaacagcacgcgcacccacactagtttcgagatggctgaacgcaaattaggtctgactgtcatcccatttgatccggcacatagttcggtttcaaaaggcgaaacccttgaagacaccattaaaacgattggggcgatcggagtcaacattgcggtgatgcgacatgcacaagatggctactataacgatcttttaggtgcatggccaacgacagcgattgtcaatgctggtgacggtgccggccagcatccttcccagatgatgctggatctgatgacgattcacgaagaattcggtcattttgacggcttgagtatcggaattgttggcgatttgagtcacagccgagttgcgcgcagtgatatgcagatgctgcataaactcggagccacgttgcactttgccggtccagagcaatggtacgattccagtttcgatcaatatggtgatttcatcaccgtgcctgaattggtcaagcaggtggatgttttgatgctgttgcgcgttcagttggaacgcttcaacgccgaccaccgtcaggctttctcaaaagaaacctaccatgcaaagtacggcatcaccgatgatcttgctaagacaatgaaacctggcgcgattttcatgcatccggcgccagtcaaccgcgatgttgagttagccagtgatctggttgatggcccgcagtcacgcattttcactcagatgcaaaacggcgtcttcatgcggatggccatgcttgaggccgtcattaatgcccgtcattttggagaggagtaacccatgctcatcaaacacgcccatattgtcagcgatactgaatacatggctgacatccaaattaccgatcacattatctcggcgattggtcaatcgctggcgccgcgcgatcacgaacaggtgattgatgcaactggtgccatcgtcatgccgggattaattgatgtccatgtgcattttcgcgaacccggctttactgataaagagacaatcaaaactggcgctgcggcggctgctcacggcggtttcacaactgttgtcgccatgagcaatctcaaaccggtaccagacactgtcgaaaccttaaaaccactgcttgagaaaaatcaaactgatgcgaagatcacggttttgcagtttgcatcgattacgcatgacctgcattctgatcaggtcgttgatatggcagccttacaagctgctggagcgctgggcttttccaacgacggggtcggggttcaggatgccgacaccatgtatcaagccatgcaacaggctgctaagttgcatgcgcctatcgttgctcatattgaagatgcaagtctgatgcatggcggggtgatcaatgccggtccagttgccaagaaactgaatttaccggggatcatcaatcaaaccgaaagcagtcagttagcgcgcgatcttgaacttgccgctgcaaccggcgtgcattaccatgcttgccacgtgtcgactcggcaaagcgttgacctaatccgcgaagctaaaaaacgcggggtaaacgtcaccgctgaagtctcaccgcatcacctgctattggatgagaataacattccgggcgacaatccaatgtttaaaatgaatccgccgttgcgctcacgtgccgaccacttagccttacttgaaggcttgcaagacggtacgcttgatatgattgcgactgaccatgcaccacatacggctgctgaaaaaaccggttccttcaaaacagcggcatttggcattgttgggtcagaaacggccttttcaacgctctataccaagctggttaaatcaaagatgttcaccctaaaacagctgatcgcacgcatgagcacgattccggctgagaaatttgatctgccaggcggccatatcacagtcagtggacctgccgatttaaccattatggatctcgatacgccttacaccattgacccagccgactggttctccaaaggcaaaaattcaccttttattggcgataaagtcaacggtcaaacactgtacacgatcagtcaggggcaaattgcttacgcaagagcgtgaaccagcttgggcttctagctggcaagcacgtttaaaagagcgtcagccagcccttaagaaagtatgaacaaacgcgattagcattaggcaaacgggtttaagcaaagcgctcaccagatcggcttctgatctagtgaacgcctttagaggaggacaagcatgaagcgctatttaattcttgaagacggcagcgttttccctggcgtcggtttcggtgcggaaaccgttacaacgggcgaaatcgtctttaacaccgggatgagtggttatcaggaaaccatcaccgatcaaagttacaacggccaaatcattaccttcacccagccactgataggcaacgtcgggatcaatcgtgacgattatgaaagtatcgatccaaccgcaaaggggattgtggtacgcgatgttgcccgagtgaccggcaattggcgcagtcaaatgaccttagatgaatttctgaaacgcaaacacattcctggcatcagtggcgttgctacccgcgccttaactaagaagattcgtgaagttggggcaatgaaggctagtattgtcgacgcagccgatgagcacgcattcgatcaattgaaagccctcgtgttacctaaaaatcaagtccagcaggtttctacccaacaggcttacccagctcctggcacaggccgcaacgtggtcgtcattgatttcggactcaaacatagtatcttacgcgaacttgccaaacggcagtgcaatgttaccgtgctgcctgccaccaccaccgcctcaacaattctcgaattagcgccagacggggtgatgctcaccaatggccctggtgatccaaaagacgttcctgaagcactggacatgattcgtggcgtggaaggcaaaattccgctgttcggtatctgcttagggcatcaactattcgcactcgccaatggcgccaacacttttaaaatgaagtatggccaccgcggtttcaatcatccggttcgtgaaattgccaccggccgaattgattttaccagtcaaaaccacggctatgcggttgatcctgacagcattgatccagatactttgttgatcacccacgtggaaatcaacgacggtacagtagaaggtttgcggcaccgattgtatcctgcctttactgtccagttccatccagatgccgctcctggcccacatgatgccgatcatctttttgatgagttcatggaaatgatggatgcattctcaaatcgcacgcagaaaggataatcatgccaaaacgtcaagatattcataaaatcttagtgatcggctccggtccaattattatcggtcaggccgcggaatttgattactctggtacgcaagcctgccttgctttacgcgaagaaggttatgaagtggttttggtcaattccaatccagcaaccatcatgaccgacacggaaattgccgatcgcgtctatattgaacccttaacagtcgaatttgtgagccagattctacgtaaagagttacctgatgcgattttaccaaccatcggcggccaaatcggcttgaatttagcgatgaaactcagcaacaccggcattttggatgaactgggtattgaattgctaggcaccaagttgacggcgattgatcaggccgaagatcgcgaattattcaaaaacctgatgcaaaaactccatgaaccagtacctgaatcagccatcgccaataacattgaagaagcacaacaatttgccgataaaatcgggtttccggttatcattcgaccggccttcaccatgggtggcaccggcggcgggattgcgaacaacgaaaaggaattggcagaaattgcggaaaacggcctcaacctaagccccgtgacgcaggtgttggttgaacgctccattgccggctacaaagaagtcgagtttgaagttatgcgcgatgcagcggattctgcaattgtcgtctgcaacatggaaaactttgatcctgtcggtgtccacaccggcgattcgatggtctttgcgccaacccaaacgttgaccgataaagaagtccagatgttgcgcgatgctgcgttgaaaatcattcgcgcgttgaagatcgaaggcggctgcaacgtccaatttgccttggatcgtaacagcttcaagtactacgtcatcgaagtcaatccgcgggtgtcgcgctccagtgcactggcttccaaagctactggttatccaattgcgaaaatggctgccaagatcgcagttggcctgcacttagacgaaatcaaaaatccggtcacgaaaaaaacttgggccgaattcgaaccggctttagactatgttgtcaccaaattgccacgctttccgtttgataagtttgaaaacggtgatcgcacattaggcacccaaatgaaagccactggcgaagtcatggcaattggccgaacgcttgaagaaagtctgctaaaagcggtgcgctcattagaagttggactaattcatccagaacggccagcttttgccaagttgagcgacgatgaactgagcaaacagatcattcaagccaacgatgaacgacttttctatctcgctgaagctttccgtcgcgactacaccattgaagaagtcgccgagttatcgaaaatgaacccattcttcctcgacaagatcaaacatattgtggaattagagcgggaactggcggcacataaagctgatctggggttgctcgccgaagtaaagcggtacggttttgccgacgaagagattgccaaactctggggcctgcacgctgaccaagtgcgacagatgcgcaaggaacaaaagatactaccagtttacaaaatggtcgatacctgcgccggtgaatttgccagcgacacgccgtattactacagcacctatgaaagtagcaccgaaagcgttaaaagcgacaagccgagtgtgctcgtgattggctcgggtccgattcggattggtcaaggggtggagttcgattacgccactgtgcacagtgttaaggccattcaaaaagccggctatgaagcgattatcatgaatagtaatccggaaacggtgtcgactgacttttcgattgctgacaagctgtactttgaaccattaacccttgaagatgtcctcaacgtcattgatctggaacagccagaaggggtcatcgtccaatttggcgggcagaccgccatcaacttggctgaaccgctggcaaaccgtggcattaagattcttggcacttcagttgaagaccttaatcgggccgaggatcgtgacttgtttgatcaggtgattaaatcacttaagttaccacaaccagagggcggtaccgccacggataaagccggtgcgttagcggtcgctgataagattggctatccggttttggttcggcctagctacgtgttaggcggccgggcgatggaaattgttcacgacgcaactgaacttgacaattatattgatcgggcggtgtccgtttcacatgatcatcctgtgctgattgaccactatctagtcggtaaggaatgcgaagtggattgcatctctgatggtgacaccgttgttttgccagggatcatggagcatatcgaacgcgctggcattcatagcggcgattcgatggctgtttatccgccgcagacctttagtcaagacattatcgatcaaatcaccgatgccacgattaaattgtcgcggacactaaactgcattggcttgatgaacgttcaattcatcattcacgatggtaaagcctacgtcatcgaagtcaatccgcgggccagtcgaaccgtgccgtttttgagtaaagtgaccaacatcaaactggcacaagtcgcaacattggcaattcttggtttaagtttgaaggaacaaggttttgaaacaggcttgttgccgaatcagtcaggtattcatgtcaaatcacctgtgtttagtttttcgaagttgaatcacgttgatagtctgcttgggccggaaatgaaatcgaccggtgaagtcatgggcagcgacaccacccttgcgaaggcgttgtacaaagcttttgaagcggctggcatgcacttgccacaatttggccgggcattgatcacggttaaagacgctgacaaggctgaagcaacggcactagcaaaacgattccgcgaagttggttatcaactagtggcaacaagcggcactgctaaggcctttgagaaaaccggtatcacagtgtcaacgattgagaaacttgacagtggccaggagacgattcttgaagacattgccaatcggaaaattcaattagtgattaacactatgagtgcagataagaaggtttcaagtgacggtttccgaattagagaagctgccatcgaacatggcgtgccattgatgaccagtctagacacagctggagccattttgaaagttctagaattacaagcattttcaatatcgccgattaaaagttgagcgccttgccatacaaagtgattttttcaacactatctaggtatgatcaccatcaaaatgctcgttgcgttattaacgctgctattttagcttttatagcatgacgggcacgctttaacgcacttgcagtcgcagcagcctacacataaggaggtaccacatggccattcaattaccgggtttcacgatgaaaaatccgttaatgcccgcgagtgggacgtttggctttggcgaaggttacgccaaagagtatgatctcaatttgctaggggcgttagtcacaaaatcgacgacactcgcaccgcgcatcggcaatcaagggactatttttgccgacggccctgacagtactttgaatgcagtaggtctaaagaatcccggttctgatgtcgtgctgcacgaaaagctgccatggttggccacgcagtatcctgatttgccgattatcgctagtattgctggggtggatgttgccgaatacgcagcagtggcgaaaaaattgagtgccgctcctaatgttaaggcactagaagtcaacatctcctgtccgaatgtcaagcaaggcgggatggcgtttggaacagacccagaagtcgctgcggccgtgacgcgtgcggttaaagccgcgagctcggtgccgattttcgttaagctgacgccgaatgtgactgatatcactgccattgctaaagcagtcgaacaagcgggagccgatggtctttcactgatcaatacgtttgtcggcatgcggctggatattgccactggcaaaccgcttctcgacaatgtgactggcggcgtttcaggtccggctttgctgccaatggcactccacatggtttatcaagtggctcatgccgttcgcgtcccgctgattgggatgggtgggatcagctctggccatgatgcagcagaaatgttggcggccggtgccacggcacttgcagttggttcagccaattattatcaaaagcgagccattccgaagatcgcggctgaattggcagccatacaggaaggacagacagttttatgacgcctattatcgcactggattttaaagataagaccacaactcttgattttttaagccaatttccaaaagaagaacatttgttcgttaaagttggcatggaacttttctatgctgaaggcccagcaattatcaccgagattcaacaagcccgaccggtgtcgatttttctcgatttaaaacttcacgatatccctaacaccgtggaaaaagcggcgtggcaattgggtaaactaggtgtggcgatgaccactgtccacgcagcaggcgggaaagacatgatgatcgcagccaaacgcgggctattggctggcgcaaaggcagctggtcatccagcaccaaaaatgcttgcgatcacgcagctaacttctacagatcagacgatgctgacaaatcagctttcgattgagatcccgatcagtcaagcggttcagcatcttgcagccatcgcgcaggcaagtaatgccgatggtgtggtggcaagtgctttggaaacaccactcattcgaagtgtgacgcgacctgattttctggtagtcaccccgggaattcgaccgtatggtgcggcagtcggcgaccaaaaacgagtcgtgaccccgggcagagccaagcgtttaggcggttcagcgattgttgttggccggccgattacgcaggctgatgatccggtggcggcttatcaatcaattaaggaagcgtgggaaacagcacatgactaaattagaaacacaaattgccagcgacttactccgtattcaggccgtcaccttgcgtcctgatgcaccgttcacttgggccagcggcatgaaaagtccaatttataccgataatcgcttgaccattggctacccagacgttcgcagtaaaattgcagctggtttggcgcagcaaattgtggctcactatcctgatgttaccgcgattggcggcgtggctactgctgggattccacatgcggctttggtcgcaaacttgttgaacctaccgctggtttacattcgcagtaagcctaaggatcacggtcaagggcggcaaatcgaagggcatctgccagccgatgctaagctggtggtcatcgatgatttgctctcaactggcggatcagtcttaggcgcggttgcagccgctcaaaaagatggtgctacagttttaggcgtcgctgcaatctttagttatcaactagccgcggtcaaaactaattttgccgatgctggcttaccgttcttcacattgacaaactatacggctttgatccaaacagccgaggcacaaggcgccatcactagtacgcaactcgcttcactgcatcaatggcgagaagatccggtcaagtggggcgcacagtttcaataagccgcaccaattgagtcccatgtccaaatcgaaaaagccaagcacggttacttcaaaaaatattttgaagtaaccgtgcttttttgtccttgccgatgacgtgaagctgcattcgttaatttatcgaaaccaagtcgcattggtgagcaatctaagcaagccatgaggaaatgagaatttcagaatatgatcgttgattcacatagtggcaaataaaaaaattattttgactgatattggattaattaagcagtaaaatccattttaaactgatttattagaaaatgatttgattgcatttatatgcacaatgcgttgaattcaggtttcatcaaaatagcttcatgagaattcaggaaaatcgagccgcgttttcttgctgtatcgacaccaattgttatactacagataggggcaattaaagcttatatacttattttcattaatttatgagtaaaatttatggaaaatagacgtcatccggttaattgttatacaacagttgttcgcaatttaaatgtccactggcaagataccatttatcaactttggaggtgaaaggatgatcacagttgctattccaatgggttcgcaaccagacatattaacccttgtaactcgtgctcgcagtgagctcgcttcgaccttggcggacaaactgcaatttgttgtgtttgatagcggttcgaacgttgaccaagcagacacttggacgtttcatcaggcgcgcgatgaagcggacgcggtgacgcaagcggttggtttagtcgctcaaggtaaggccgatattttactaaagggcattgtgcaaacgcatacattactgaaagaactgcttcgtcctgactatcaactgcggcttcagaaagttttgtctcatgttgcgattattcatctgccacaactaaaccggccgcttcttttgagcgatgctggtatgaatattgatcccgacgaagacaggctggccgccattgtcgaaaatgcagtaggcgttgcgcatcaaattggtttgccaaagccaaaagttgcgctactcagtgcagccgagaactttaatccgaaaatgccttcctcagttttggcgcaggcggtcgcaaaacagtttgaaacgcgctcagatgccgtgattgccggcccaatctcgcttgatttggcattatcaccagcatctgtggcgcataaacattatgaaggcgtgattcaaggtgatgccgatgtgttaattgtcccaaccattgatgttggcaatgttttatataaggcgttgatgctattcacgaatgctcgctcaggcggcacgattgtgggggccaaagtgccgatagttttaacttcgcgcagtgattccgttgatagtaaactaacggcgctggcattcgcgattgcacaactgaaaggcggtgcctcatgaccatgcatccaaaacgcgatgttgtcatcgtgatcaatcctggctcaacttcgtccaaaatcgccttatttaaggctggtaaaatggtcgccgaacgcacacttaaccactccttagccgagctaagtcaatttgatgccgttattgcacaaaaagattttcggatgcaagccattcaagaatttttagccgatcaggacttttcagcaagcgaagtgctggcagtcgctggacgcggaggattgttaaaaccaattccgagcggtacgtatgctgtcaatgaggcgatgctggatgatttaaccgcagccaaacgcaacgaacatgcaagtaacctcggtgcaggactagcacagcaagtcgctgatcaatatggcgtcaaggcatatgtggtggatccacccgtggtagatgaattgcagccgctcgctcgtatcagtggtttaaaaggaatcgagcgacacagtgcggcccatgttttaaatcaaaaagccatggcccgccaagttttggctactatgggcaagacctatgccacaagccgtgtgatcgtcgcgcacatcggcgggggtctcagcatccatgcacatgaaaacggccgcatgattgacggcaataacggcattgatggtgaaggaccgtactcaccagaacgggctggttcactgccgctagttgattttgttgccaaggtattagctgagcggctgacgctagaccaagtcaaaaaattattggctagtcaaagtggtttgcgctcgtacctaaacgatatcagtatcaaaaacattgtcgctcggattgctgagggtgacgaaaccgctaagttctacttagatggcatgatctatcagattaaaaaacagatcgccgaaatggcgggcgttttaaatggtcaggttgatgtgattattttgactggcggcgctgcttatgccactgctgtgacagccccgctgcaacatgatttagcctggattgcaccggtggtagtgcgaccaggagaaatggaaatgcaggcactctatgagggggtgatgcgcgttttgaatcatgaagaactcgtccgcgtttatcaatcagacgcgtcaacaatcaaagggggaactggcagatgacaatgaacacagatctggtggtcctgggtggcggacccggcggttatgttgccgccattcgggccgcacagttaggcatgcaggtcgttttggtagagaaagcaaaagtcggcggcatttgtttgcacaaaggctgcatccccaccaagtcactgttgcatagcggtgaaacactgcgactgatgcaatcagctgcgacatttggcgggatcatcgaaggcaaagtcggcattgattttgctaagattcaagcgcgtaaagcaactgttgtggaccagctttaccgcggggttcaaggattgatgaagaaaaataagatcaccgttcttaacggaactggcgcggttttaggcccatcgattttctcaccggtatctggaactgtctcggtaaccttcgatgacaaaagcaaagaagacgtgatgatcgtacctaaacacgtcatcatcgcaactggctctagtccaaagactttgccgagtctgccaattgacgaaaagatgattttgacctccaacggcatgctcgaactcacggctttaccgaagaaagtcgcaatcatcggaggcggtgtcatcggcgtcgaatgggcgtctctgcttaatgactttggggtggatgtcaccatcgttgaatttttggaccaattggtgatcaacgaaagtcaaacgattgcccgtgaattacagaaacaactcgaaaaccgcggcattcacatccaactcggcgccaaagtggaacatgcaacgatcaaaaataagcaggtggcactgaccatcgctgaacaaagcgatcccttaatcgttgacaaagtcatggttgcgattggccgccagccaaatgttgaaggcattggactacaaaatacctcgattaagtattcggcaaagggcatcacccacaatgcgttttatcaaacaacggaagatcacatttatgcgattggcgatgtcatcgataccctccagttggcgcatgtggcgatgaaagaaggcatcatcgcggtggaacacatggccggtctaccagttgcaccgcttaattacaatgatgtaccgcgttgtacgtacaccgatccagaaattgccagtgtcggctatacctcatccaattatccgcaagatcgcgacgtgaaaattggccggttcaactttaatgccaatgctaaagcgatcattttgggcgatacagccggttttgtcgaagtgctgcgagatgtgataaccgatgacattatcggcgtcagcatcattggtgcccacgccaccgacatgattgccgaaatgagtgacgcgatgtacctcgatgcctctgctacagagattggtgatgccgttcatccgcatccatcactatcggaagccattcaagaagcaactttagatacccacaagatagccattcacaaataagaaagcgagtgagtctgatgcaaaaaatgaaaacgacagggaaactgaaaacgacaggattgagtcgcgagaccattcttgacgtctataaggccgtcatgcgtggccgccgcgtcgatgaacgtttatggcaactgacccgaattggtaaattctcgtttaacatttccggacaaggcgctgaagtcgggcaagctgctatggcgttggcgtttgattatgacaaagattattttctgccttactaccgggatctcaccgcagtgctcatgtgggggatgacgacaaaagatattatgctggccggttttgggaaagaagccgatccagcttcacatggtcgtcaaatgccaagtcattacggcagcaaggcgcataacattgtgagtcactcctcgccagtcagcacccagtatccaatttccgcggggattgcctatggtgctcagatgcgtggtgaagactatgtcaccgtggttaccactggggatggctcctttagtcaaggtgaatgtgcagaagccatgaacatcgcaggcgtgcacaagatgccagtagtcttcgtcgttgaaaataatggatacgctatttcggtgccagacaaagaacaatatgccgttgaaaagttagctgatcgcggcccggcattcggttttaatgggatacgagtcaacggcagcgactttgctgaaacctatctggctttcaagcaagcagtgacggatgcccgtcaaggcaacggtccgaccttgattgagatcatggttgaacgactcaccagtcattcttccgacgatgatcagcgagtataccgtagtgccgaggaacttgccgaaatcaaagaaaacgatccgatgaagcttttccaacaacaattaatcgacgaagggtacctgaacgaagccgacattgatcgcattgaaaaggaacttgaaaccgagattaaccaagcaaccgatgaggcagaagccatgcctgatccagatccagccaagatcaccgaccagttgtacgcagaataggagagcgcgaactgccacgggtaggaaccggagtaaaagtatccttggacgtggatggtcggactttgaccattgcgaccaagatacttacacgcaggtttctgggctggtgaacgcgtttaaaggaggatgaagaaccatggctgaattaacttatttagaggcgatccaacaaggtattgacgaagaaatggcgaaagatgaaaacgtccttattttcggggaagatgtcggcggtgacaaaggcggggtctttggcgtcacgaaaggcttggctgccaagtatggcgataagcgggttttcaacacacctttaacggaaattgctattggcggtatgggtgttggccttggactggttggcttccggccaatcgccgaattccaatttgctgattatattttaccagctgtcaaccagctcaattccgaagcggcccgcatgcggtaccgcagcaaaggcgactggaccgtgccggcagttttccgcgctccatatggcggcggcgtgcgcggcggcttttatcactcacaatcaacggaaaagatctttgctgggcaaccaggtttgcgggtcgtcaccccgtcaaatccatacgacgcaaaaggcatgattaaaaccgcgattcgtagtgacgatccggtgattttctatgaacacaaacgtctatatcgcttgctaaaagcggaagtgccggaaacggattacaccgtgccaattgacaaggctaatgtgattcgcgaaggtgacgacttgaccgtgtttgcatatggggcggtgctccaacatgccttaactgctgcggagaagctggccggtgaaggcgtcagtgcagaaatcgttgatgtccgctcactttatccacttgatcgggaaaccttagtcgcagcagcaaagaaaaccggtaaagtcttattaatcaccgaggataacaaggaaagcaccatcatgagtgaagttgcagccatgattgccgaggatgcccttttcgatctcgatgcaccaatcagacggttagcaggacctgatgtgccggcaatgccatatgctgttgggctggaacgagcattcttagttaacgaagaacaagtttacaacgaaatgaaagcgctcgcagcatattgatgaagggggaaaatagcatggcgatcgaacaaatcttactgcccggtttaggcgagagtgttcacgaagcgtccatcattaattggctggtcaaaccaggcgatcatgtcaaaaaatacgataccttagctgaaaccgtatcagataaagtgacgaccgaaattccatcgaattttgctggcgtcattaaagcctatctcgttgaccttgataaagaggttccaatcggtacaccgatcatgagcatcgaagttgaaggcgcagcaagtgcacctgaaccagctgccgccaccagttcaccggctgcacaaccggcatcgccaccagcaccagtaccaattccggcagcgccaagcaaacctagtgccactggcggcaagcgtttttcaccagcagtgttggctttagctgaagaaaaaggcatcaatcttaatgatgtcatcggcaccggtaacaatggccgaatcacacgcaaggatgtgctcaattacacgcctagcgccagcgcgccaacctcagcgcctgagccacaacccgtttcggatgcggctcaagcaaccacccaagtgccaaccgcaccgcccgcatcagcaataccggaagcaccaaagccagcacctgaaacgatcaactttgaacctgggattcatgatcaaattgtcccggctgatggtattcgtaaaacaattgctcgtcacatggtgcaaagtgccaccgaaattccgcatgcttggatgttagtggaagcagatgtgacgaacatggttaaactgcgtaaccgcatgaaggacaactttaaacagcaggaaggcatttccttatcttacttcccattcttcattaaagccgtcgttcaagccttgaagaaacatccgaagatcaacactagctggcaagacgggaatattgtttatcatcaggatttcaatatctcaattgccgttgcaaccgatgattatctttatgtacccgtgataaaacatgccgaccagctgtccatcaccgggattgccaaagaaatcaaccgtctagcgcaactcacgcgcgctgggaaactgacgtcggctgatatggcagatggcaccttcaccgtgaacaataccggatcgtttggctcagttgcctctatggggattattaattatccgcaggcagcgattatgcaagtcgaaagcatcaacaagaaactggtcgtcaccgatgacggcattaagatcgctgacatggtcaatctgtgtctgtcgctggatcaccgtattctcgacggcctgcaagccggacgatttatgaacgatgtcaaattgaacttaagtcaatacaacatcgagtcggatctttactaaagcacagtacgacatgtttgcgttgagaacattgaatttccacagattttcaaaacagctgtagagatgtgccatgacaggaggaaaaagatcatgaaaattacaattgctggtgtcggggccatgggtggccgctatgcattgatgctcagtcgcgcaggcaatgatgtcgacggtattgacggctgggctgacaatgtgaatgctatcaatgagcatggcctgcaggctaacttcgatggcgaacaagttgttgctaagatcaaagcctatgaacaaaccaaaattgatccaagtgcagtggctgatctcgtcatcctcttcccgaaatccatgcaactagacggtatgatgcagtcattaaagccggtgatcactgaccatactaaaattctgtgtttaatgaatggtatcggtcatgaagaaatcatcgaaaaatatgtcacacgcgacaatatttttattggtaatacgatgtggaccgccggaatggaaggaccaggcaaattaaagctattcggcagcggttcagtcgccttgcgcaacgtcgaagacggcgaagcagcaaccgcggctgcaaaaaagatcgtgaaattgttatcagacgctggactaaatgctgaatactctgataatattctgtatacgatctacaagaaagcaacggtcaatggcacaatgaacggcttatgcacgattctggactgcaatatgagtgaatttggcagcacctcaaccgctgaggacatggttgtcgcaatcgtcaaagaattctcggcagttgccgcaaaagaaggcattgatttgaatgtgcctgacacggtggactacatcaaaacaacctgggatccaaacacgatcggccatcattatccgtccatgcatcaagacctgattaccaatcaccgcttgactgagatcgattatattaacggtgtgattgatcggcgcggtaagaagtacggtattccgaccccatattgtaccttcttaacccaactagtccacgccaaggaacagttgctgcacgcaaaataataaaggggtgacacatgatggctgattcgacgaacaaggagatgacccatgcggctgcagatgcacttgtagacgaacaaaaggggaaagcaggcgggcttgttgaagacaacaaaacacctgaaaagtcccagaaaatgacgccacgcgtttttcttaataaggttttatcaggaacggccttgggcgttattatcggcctcatccccaatgctgttctatccggcattctgaaatacttcggcaccaacacatttgcggtcacgttgacgcaaattgccgtgatttttcaacttgcgacaccgttgattattggcggtttgatcgctttgcaatttgaattcaatccaatgcagatgatggtaacggctggtgcttcctttgttggttcgggggttgtgaaatttaatcctgccatgaaagcctatgtcggtgccggtaccggtgatttaattaataccatgatcaccgcctcaattgctgtgttggttctgatgtgggtcaaagataaattcggctccacagcagtggttgccatgccgatcttggttgggtgcggggtcgcctatatcggggtcttactgttgccgtttattgcagcatttaccgcagcgattggcgatgtaattaacagttttacgaccttacagccgattttcatggcaatcttaatttgctgctccttcgccacgattatcattagtccaatttcgactgttgccattggcctagccatccaactgaacggagtttcggctggtgcagcggcgatgggggttgcagcaacagcacttgcgcttgtcgtttattcatggaccgtgaacaaatctggcgtgaccttggcaattgctttaggtgccatgaaactcatgatgccgaacttgttcaaatatccgattatcttagtaccgtgcttgttcaccgcgatcatttcggcaattccagttgcactgctttctatcagcggtacgccgcaatcttctgggttcgggattgtcggcttggtcggaccgctggcatccatggaggctggcctagcgatcccgctggttgtcctttgctggatcgtgattccagttgcagcagccttgctaagtaagttattgtttgaaaaaatgctcaagcttttcgatagcaatgttgtgtttaagttccaaggttaaacagcatcaaaaaagctcacgttttgcgacgtgagcttttttggtgccgtcagaacaagttattcaagatgtttatggccttgcgcatcatacacgcggtggtcgttaatggcgactttcttgtggacggcttgggctaaatcaacatctgtcatctcggcaatgccaagtagataaatggtgatatcagccaattcttccgcgatgttggcgtgatcgtcctttaataatgccgtcgttaattcagccatttcatggtaggccaataacatttcgaaatttgtatcagtggtgttccagccatgtttgatcttgttagctaatatatgcgcctgaacggttttggatgaaggaatgtctgatgctttcatcgttctgattgccccctagacactgacatcaattgaacgtgacgattacttggtaggcgggttgcgtaacttgtcgaccagctcgacgtcaggcgtgacagcgaccgtcttttgcccttcataaaccacaaaacctggcttggcgccattgggtttacgaatctttttgacttcgatccagtccaccggtacattagcactgtcacgggctttcgaaaaataggcggccaacttagccgcttcgagcaacgttttctcgcttggctgatgactatcgatgataacatgggagcctggtatatctttcacgtgcagccagatatcggttttcttagcggtgtgcaaggtcaattgatcattctgcaagttattcttgcccacccaaattttggtgccatcgctggcataaaattgatcaggttttgcgaccttttggcgtttagccccttttttgttggtcttttgcttgcgtaaatagccttgctgctgcagttcgagccgaatatcggccaaatctttcgggctagcgacgtcgatctgggccatgataccttcaagataatcaatttcttcctgattttcctgcatttgttgatggacatgggcaacggcattacgcagttttgtatatttagcgaagtacttctgagcatttctagacggcgtcagttggttggatagtgtgattttgattggccgattatcatcatagaaattaggcagctcgatgctggtcatgccgcgttcgacctgacttaaataagtcgtcaacacttcgccccgaattcggtaatcatcggccttttccgtttcctctaaggtccgctgcaacttacgctgttttttgcgatctttatcaaggacgttcttgatgacgtggatcaggttcccaccttgctgcaagacgcgatcgtgttcggccttttgttcataataagcatccaacatcgtgctgagggtcggatattggctttgctcaccagtcaatgacacgtaggggattgccgtgaaaacggcctttttgccttgtgccgtgatggtcggcacgggtgtcgccagtgcggcaaagaaaccatcccagcctgcatcgccttggttgagtcgtaacgcaagctcagtagccgaatctttagctaagccttgataatgctgttgcaacaacgctgcgcgacttaaggcgggcgtgacctcgcgttctaatgcgtggtaacgccggtctggatcgtgaaaaggatcggttttgtcttgcttaggcggttcaacgtaaggggcacctggcatcaggggacgataacgattttgatcggccgacacatgccgaatgagatcaataattttaccagtacgttcactgacaaggaaaatattgctgtggcgacccatcatttcgatgatcaaccgcaagccgagttcatcgccgagttcgtcacgggttgagaactcaaagtggagcacccggtcattttgcacctgatgcacggcagttaaggtggccgcattaaaatacttccgcaacgtcatggtgaatgttgcgggaacatcagggttcgtgaatggaatatgcgtgatctgaacccgcgcatattgagggttggctgacagaaggaggggatgattctttcgtcccgctcgaatagtgatcacaacttcattttcataaggttgttgaattttagcaacacggccgccgcttaaagttgcatttagctcgttggccatggcatgggtaaagattccgtcaaatgacatgttgatccgctcgctttccaattgtaccaatcattttaccggtttttgggtggcatagcaaaaagcgggtggtgggggactgcgcacccgctacatttttgttttttatggtatgatgtagacaatcatttttgaaaaagtgggtgtctgtacatgaaaattgctatcgtgacggatagtacctgttatctgccgcaagccgaaattgacaaacatcacatcactgtggtgccgattccggttattcttgacggcgcggtttacgacgaaggcaaggatatcaccaccgaagaattctatgccaaattaaagactgccaaaacgttccccagcaccacgcagccgccgctgggcgagatgctgaagctttacgagaatcttgctaatgaaggctatgacactatcatcagtattcatctggccagcacaatttccggttttgtgaatacattgaaaggtgccgtagatgaggttcaaggcgcaaaggtttatgtttatgattcacaaattaccgttattttgatgggttggctggttttggcagcagcacaaatggccgaagccggtgatgatcctgaggcgatcttggctcgattagataacttacgcacaaccatgggtgagtattttatcgttaatgatctgcaaaaccttgttcgcggcggccgactcagcaatgcctcggcttttatcggtggcatgttaaagatcaagccattgttaacgtttgacgatcaaagtcacaagatcgtggcaatcgaaaaaattcgctccatcaaaaaggcttactctcgcgttgagactttgtttcaagaagaacttgatcgagttgattatccggttcgcgcggttgttatccacgctaatgatccagacgaggccaatcgttggttagcagatttacagcagaagtttccaacagttccattcgaactatcttactttggcccagttgtcggcacccacttaggtgaaaaggcaatcgccttagcttggatgaaggattttacgaaagcataatcagaagtcgcgtttaggcgcggctttttcaattgaaggagatgcctatatgttttttgatcaaccgctagcaaaaggaaaaattctgagcgaaaccccgcattatcatgggccgattttcgatgttgtgacgcaacatattaaaacgcctgatggcctcacagttgagcgtgacttgattcgccacgccaatgcagtggccatgttggctatgaccgatgatgggcgcgtgctagtcaatcgcgagtatcgagttgcggtaaacagtgaagtttttgggctaccagcaggcttgatggacccgggtgaagactggcaaaccgccgcaagccgggaattgcgcgaggaaaccggctacgtgacgcacgatttgcagtggatgaccgctatccgttcaagtgaagggatgacggatgaaaccgtcaatctggtgttggcacatcttgatttggctgataaaacgaagcaagatttcgaccaagacgaatttgtaactagccgattagtcccattttctgaattagttgcgggtgtcaaagctggcaaaatccgttcggcgcaaacggtatcggctgtaacttactatttggcctttcttgccaaagattaaaatattgattagctgttgggactgagctgtcattcttgcatagaatttgtgattcactagatttcgaataatccgggaaaaatctaggctaagggttctttgccgtgccaaactccgcaatctccggccagatggagctggaacgcgtgacggcgcttcgaggccaaacccacggtctcgaagtcgcctaacaacatcagcgacaaagaccggtcgctatgttgtttgcacagctgagccccatctggcctgcgattgctccgccttggcactgatttcttcaaattttcaataaaaattatctatgtggaaaaggtcaacgtttttcctttgtatggaaattgtggcctttttttgatgacttcgcgttatggtttaacctgattatttgcttaagaaaaactactcagcttaattaaaataactaggtttctccgtgcttggtcagcaatagcaagccaatactttgattcgacgcttgtcttatgaatatttatgcataatatatttacttttcaagcaattgcgcgtacactcgaaagcaattaagaaagcaggtggcgtgatgttacgcaaaagtgttgccaagctgccggactatgtttcggacagcacaccggagcgactggcgaaagcagcgggacttgccaagatgacgcgtttgtcattcaatgaaaatccggttggcacatcgcccaaagtgaaagaagcgctcgcaaattgggcgttttcgcaaggacgcaattatcctgatccagatgcactgccattacgaacagccgtggccgaacgactacacgtaaaccccgaccagctccttttttccagtggtttggatgagatgattgccttgatttgccggacatttttggaagtcggggacgaaagtcttcaaccgtggccgacttatccggaatatcaactacaggcagctatcgcgggtgccacaacggtgaatgctgccgtaaggccggcaaccggacttattgatcttgatgatttagccgcgcacattacggccaaaacaaaggtgatttggttgtgcaatccgaataacccgaccggtacttatttaccaatttctcagatcgcccagtttatgaagcgggtgcctgctgatgtgctagtagtggttgatgaagcctatattgattttgtcgccgacgttccgaatccgtctgcgctgtcactggttacgcaattcaacaatttactagtcatgcgaacattttcaaaattgtacggtctagctaattttcgcgtcgggtttagcatcgtgccgcagcgagtaattgctaaaatgcagaatgtgcgcttgccttacaacattagcggtattagtcagacggcggcattagcagcttggcaggatcaagccttcactcaaaccgtgaaacagcaactattgacagcacggcagcaatggtcagctttttttgaggccaaccacattcagcactatgccagtcagaccaactttatgttgtatcaagtcgccgatccccaagcgcttggcgcctttttaaaacagcatggctacttggttcgcgacagcatggtacccggctggattcgccaaagttttggaacacctgcgcaagatgcagagatgcgacaattactactgacgtttcttaaaacggatactgaggtccctaattagtggactgattatgcaaaaaaatgtttactttcaaaataataatttgaccaaatattcataaaaaacatcattgatgctggctgcgcacctttttatgccacaacttgtggtggcattatccgcgccgaattaaaaaaaggttgacaatggcaaaatgatggctattatgaaagtcacattaacaaacatgaagttgtgattagaacaagtaagctgatcctgatcaacagagagcgtctattgctgaaaagacgcgattagccagctgaacacacatctatgaacttgacggctgaactaagtaagctgtcacgcatccgttgcgttatcactgctgccaactgctgttcgcaattgctgacagttacttggcaggtgaggtttaggtcgcaagagctaaacaaaattgaggtggtaccgcggtcaaaaatcgccctcggaaacgttttttcgttttcgagggcgatttttttttaggcgcgaccaggagcgcttaggtttctgcgactgcgagcgcgttatcgcaagcaccaagccaaacttcatgtcaacgaaaggagctaactcatgtcaaatcggcatctgcctattggcacacgcgacgaattcgggccgcgggccattcgcaaagagaatctcattcaaaccattagtcaacaattcattcaagccgggttcgagcgggtcaaaaccccattgttggaatatcgagatgtgtttaaaccgttagctgtcagtggcgaacaaccttatcaaatgctcgatgatgctggcgaatcagtggttatgcggcctgatctgactttaccgcttgcgagattgcttagtaccacgagtatcgtgccgccagtgcaatggtggtatgtcggcgacatttttcgagttaagaaaagtctaagcggtacttataatcagatcacccaagcaggcattgagcttattgggtatcgctccctcaaagccgagtgggtatgtctcagcgaagcaggaaaaatttgtcgcacgctaggattgacacatctcacgttagagttatctgatgcccagttcgttccgcaaatcttacgaacgcttcaactgaatgatgccgcggctgatgcatttcaaaccgctttctttgctaaagagctaagcacctatcaagacctgattgcgccgcttgctacaaacccgctttatccatttcttcaacagtggccatggctttttggcgatagcgaaacgatctttgccgaattgaaacggttattgccgtcgaatgtgattacggatcgcttagccccacttcaacaaacggtggcctttctcaaagaccaatttccggaattgcgcgtgacgatcgatctcaccagccggccaccacaatcttattacaccggcatcttcttccatgcttacgttgatggcggtcaccaatatctttttagcggcggtcgctatgacaaattgctggcaagttttcaacaagaattgttgccagcggttggcttagcttttgacattgatgccgtgactgatcaattgccgaatgcgcctgaccagcccctcacatttgtctatggcctgccatcgcaatggcaagccgcagcagcgatggttgccaccaccccgaatgcaagactgtgtctggtcgatactttggcagaggctcaagctgcagcgacaaaacagcatgctaacttgattgatctttccccaaaggaggcgatcctatgacactcaccattgcgctcactaaggggcgaactgaaacgcaagtcttacccttactcgcggctgccgggattcactgtgaggccattcaagccaaaagcagacggttgatttttgccgatgatccgagttttcactttattttggttaaagccccggatgtgctgacctatctcaatcatggcaccgtcgatattgggattgtcggttcggatattctggctgagcaagggcatcgccagtttgacatgttggatctcaacactggtcgttgccgcttcattcttgcttcaaccgcagactttgatccaaagcagacgaaacgtaaactcatcgcgaccaagtacccgcacattgcacaacagtattttcaaaagcaaggcgaggacgttgaaatcatcaaaattgaagggtctgtcgaattagcaccactcactggtatggccgatgccatcgttgatatcaccgaaactggcacgaccttacgggaaaaccacctcaaagtgttcgccgaactcgcgtctgtctcgacacatctcgttgtcaatcgcttggccctgaaacaaaaacgcacagagatttatcagcttattcaatctttacaaaaagttcgccctcaggaggcatcgttatgaaaattttaaccggcacgttaagccagcttaagcaacaagtcgacattcggcgcaccgccgttgcccaaaatacagatgtacaaacgattgttcaggcaatcatcgcgaaagtcagagcagaaggtgactcagctttgcgtacttatagtaataagcttgatcacgttaccgttaatgactttcaggttgaccaagcgctcatcgatgccgcgcccgcacaactgccggcaaaactattgaaagctttgcagttagcgaaggccaatatcacaagttatcatcaaaatgaaatcgaacgcggtttcgtcgatacgccaaaccctggcatcattcgtggacaaaaaatcaccccgttggctgcagtcggcctctatgttcccggtggcacagctgcttatccgtccaccattttgatgaccgctatccccgctaaattggccggtgtcaaaaagattgtgatggtgacaccgccgcagccaaatggccttaatccagttgtactagcagcggctaatctcgctggcgtagacgctatatatcaagtcggtggcgcccaggcaattgctgctttagcttatggcaccgaaagcatcccccgcgttgacaaaatcatgggcccaggtaatcgctatgttgcggaagctaaaaagcaggtttttggcaacgtcgctattgatatgatcgctggtccctcagaaatcggcatcattgccgacgagtccgccgatccgattcgattagctgccgatcttttatcacaagccgaacatgaccccaatgcgcgcgcgatgatggtaaccacaagtgaaaaactggcttcggcagtcagcgaacagatcgatattcaattgccaaccttacctcgagaatcgatcgcgcgagcagcaattgaaaatcaaggattcattgcgattgtagcaaccataaacgaagccttttcattgatgaatacaattgcacccgagcacttagaagttcagttgcctgatccgatcacgtatctagctcagattcaaaatgccggatccgtttttcttggtcaaaatgctgctgagccggtcggtgattatgtcgcgggacccaatcacgttttgcctaccgctggatcagcacggtttttctcaccactgggggtctatgacttcgttaagcgtacccagttcattcagtacagctcagaagcactagcaagtcaggcagacgcagtcgtcaccttggcacaagcagaagggctagatggccacgctgaagccatcatcaaacgtgtccctgccgcaaaggaggtttaacttatgcgtacagctaccattacccgaactaccaaggaaacaacgattacgatcagtctcaaccttgatcagcaaagtggcattcaaattgctactggcattggtttttttgatcacatgctggatgcatttgctaaacatggtcgatttggcttaactgtcgatgcgcaaggtgatttggatgttgatccgcaccacaccattgaggataccggcattgtgttaggtgaatgttttaagcaggcgcttggcgataaagccgggattgagcgtttcggcagtgcttttgtgccaatggatgaaagtctggcccgagcggttgtcgatctttctggacgcgcgtacctcgtttttgatgccgaattgactaatcagcgattaggcggctttgatacggaagtcacagaagatttcttccaggcggttgcctttgctggtgaattcaacctgcatgccagagttctgtatggccgcaatacccatcataaaattgaggccttattcaaagcactgggtcgtagtttacgggctgcagtcgccattaatcctgaagtgcaaggcattccctcaacaaagggtgtgatttgaatgattgtgattgttgattacgatacaggcaacacccgcaatgttaaaaaagcacttgattatctgggggtcaacaatcagctctcagccgaccccgcgattatcatggctgcttccggtttgattttgccgggtgtcggcgcttttaaagaggcgatgaaagccttaaatcaacgacaactggtgcctgtcattcaagcgtttgctgctactggcaagccgttgttgggtatctgtttagggatgcagttgctatttgatcgcagcttcgagttcggcgaaactgccggtattggcctcattcccggcgaagtcgttgccatcccgactgactcgggattagccgtcccgcacatgggttggaacaccaacagcctcacgcaacccgatttatttgctgcggtgtttgctgatcaagcaacttattttgtccattccttctatgcaacaacgctgccacaatttacgttggcaaccactgattatggacaacctctgactagcattgttcgtcgcaataatgtacttgggacccagtttcacccagaaaaaagtggcgcgattggcctagccggcttgaaaaagttcaaggagatgaccgaagatgaagttctatcccgcgattgatttgctcaatggcaaaagcgttcgcctcacgcaaggtgattacgaccaagtgagtttaactgaagacccgctctatcaggcacagcggctgacagatgccggatttgcccatttgcatctcgttgatcttgacggcgcacgggcacaacgtccgatcaatcgaacggtcattactcgcattcgtgaacaaacctcggcttttattgaacttggtggcggcattcgaacactggctgccatggaaatttatcttacgataggcattgaccggcttattttaggatcggcagctgtttccgatcctgatttggtcgaacaagctattgcgagattcgggtctaatcgaattgcggttggcattgatacccgcgccgggaaagtggcgacaaacggttggttaaccaccagccagcagacggctaacgcccttctaaccgccatgcaacaacgcggcgtcaccacatttatcgtgaccgatattgccaaagatgggatgatgcaaggcccgaatgcccagttacttgcggacttgcaacaggcgatgccccaagccacgatcatcgccagtggcggcatcagttcactagctgacttacaccgcttgcaaaccgctggcattcaagcagccatcatcggcaaagcatggcaaacaggcgctattgaattagcaatgctcaaacaaatggagggttaagatgctgacaaaacgcattatcccatgtctagatgtagatcacggtcgggtcaaaaaaggcatcaattttgtgcagttaaaagatgtcggcgatcctgtcgctattgctaaggcttatcaggagcaaggcgcagatgaactggtcttcttagatattaccgcgaccaacgaagcgcgcggcaccttggttcaaacggtcgaagcagtggccaatcaagtctttatgccgctgacagttggcggtggcattcaatcggtcgcggatatgcacgctttgttgcgagcaggtgcggacaaagtctcattaaactcagccgcagtcgccgatccaagtttgctcacagccggtgccgaaaaatttggtcgccaagcgattgttgccgcgattgatacacgttggcaagctgatcaaaatcgctatcaggtcacggttaacggtggccgaacgccagtcgatctcgatgcgatcacttgggcgaaacaagcagttgccgcaggagcaggcgaattactcgtcacttcgatggatgcggatggcactgaaagtggctttgatttgcgattgtatcaacaactcactgccgccgttcaagttccgatcattgcgagtggcggcgccggttcgacagcagactttgtccagttgtttacgcaaaccacggtgtcggctggcttggcagcatctatttttcacttcggcgaattaactgtcccgcaagtgaaaaccgctttaaaacaagcaaaggtggcggttcgatgatcacacttgactgggaaaaagccaatggcctgatcaccacagtcgttcaggatgcaaccaccaaacaagtgttgatggtcgcttatatgaatcaagaaagtttggcaaaaacgatggcaaccggtgaaacttggttctggtcgcgcagtcgcaaaacattgtggcataaaggcgccaccagtggcaacattcaaatggttaaaacaattgcagttgactgcgatgcggacaccttgctcgtcaccgttgatccggccggtccagcatgccataccggccacatcagctgtttttatcgtcattatccggaagggaaggatcttacatgacccaatcaaagcaaagtattccagctctatatgatttcatcaaagaacgtcaagcaaatccagttgccggttcgtacacggattatcttttcaccaaaggactcgataaaattttaaaaaaagtcggtgaagaaagcactgaagtgattgtcgccgccaaaaatccagatgatccggcgtttatccttgaagtggccgacctcacttatcacgtcctggttcttatggttgaacgtggtatcacggttgatcaaattgccaccgaattggctagtcgcgaaggaaagaagagccgactgcaagaacggtcaaaaatcgagaaatattaatgccttgaagagggcatcgttaatagacaaagcgtgaacaggctagttccgagccagcaaactcttttaaggaggacgccaacatgctaaaacataccgtcactcatttacaaccttacatccccgaaaaacccttggcagatttggcgcaagaacgcgcattgccgcatattgttagaatgtcagcaaacgaaaatccttttggcactagtgacaaggtacaaacagcaatcaaaacctgggacttcacccaaagccgtgactatcctgatggcaatgctagccgtttacgatcagcggtcgcagctgaactgggcgtcactgaaagccaacttgtatttggtaatggtttggatgaaatcattgagctcattgcccgtacttttttagaggctggggatgaagtggttgagccgtggccaactttctccgaatatcagttgcatgcccagattgaaggcgccaaggttgttaacgtaccggtacaagcgacgaccggagcatttgatctcgaggcgctcgctcaggcaattacccccaaaaccaaactgctttggctttgcaatcctaataatccgacaggcaccttgctgtcactgactgagctagaacagttcttacagcaagtgccaccaagtgttttggttctgattgatgaagcctacattgaatttacagacgattatccggctaccagcgcactcaaattgttaccaaactttgctaatctggttgtcttgagaactttctcaaaaatatacggcttagccaattttcgagtcggcttcgccgttgtgcctgagcaactggcagcgaccatgcaatccgtccgcctgccatataatctgagcagtgtggcccaactagcagctttcactgcccttggcgaccaaacatttgtccagacaacccgtgaacaggttcggcaggcacgagaggactgggaacgatttttaacgaaggctggtctgccacattatcaaagtcaaacgaacttccaattttttcaggctccgcagaagcaagcggccgctttgaaggaacagctcttgaatcacggctttttggttcgtgatggcttaaagccgggatggttacggatcacttttggcaccacagcgcaaaatatagccgtacaacaaatcatgactgcgtttcagcaagcaaaaaaataacgacaacgaacccgatccgaccctttcaagcatgtgcatcaccaccaagggatcaaatgcttattgacctaccaattttttcaatgctgctattaagcgcatcgttgcggtcacgaaatgacattagcgacaactaatcatggactaagcagaaaatgtcaccgcttccattttccacataaaacctataccattttgaaaaacagctaggaaagcgcccacatttggcgtattctgaagatgtccaaaaaatctaagaggtgaatttgatgttggaaaacaataattttgatgaagttgtccttaaacgccacaccgcccgtgaatttgatccggaaatcaccattagtaaaggcgagttgttacaaatgattacttatgcgacaaaagcgcccagtgccttgaatatgcagccaacgcggtttgtcgtcgcacaaagcaatgcggccaaggaaaaaatcgccgcagttgctggcaccaatgcaccggaaattttatccgcgtccgctgtggtacttattggtggcgaaaccgacttgggaccatttgaggaggatctgttcaaacgggcggaagcggctggtttactgactgatcgggcgattgagcatcaaaaaccaatgattgaaaatcttgttgccacctttaaagaaaaccaacaagcattacgcgaatttattattcaaaacagtagtcttgcggcaatgtcgttcatgttggctgcccgcgcctatggctatgaaacaggtgccatgacaggtttcgatcacgaaaaaattattccggcacttgatttggatccgaatcatttcttgccgacattgctgattgctgttggtaaaccaaagagtgcaccggactcactgtatcggataccagcaagcaaaatcactgttttcaaataaagtgctacaacattgcacaactcaaagatgatcgccgtcaatgatttcagcatcaagtggatgcgtgcgtcatcacaaactattttgctggacgttgccatgattaccaaaaaggccgcttgtttacgcggcctttttggtatcgtcaacgctagtcattgctttttagtttgagaaatgccacagcgaaacaagttttcacaaaaaggagttgggttgattgccctataccattaaaattaatgcaccgttaagtgttcaacaggtccatgatttgtatcagcaaacacatttcaataaaccgatcaacgatccgacccgcttgcaaacgatgattgacgaaacaccccttgttttgagcatgtgggatggcgcaaagttgattggctttgcgcggtgtctgacggattttgaatattgctgttacctaagtgatcttttaattttgcctgcctatgaaggtcatcaccttgggcgtcagctcatgacaactttgcaagcttatatcggtccgcgggtcacgctgtcattgaaggcagcagattcggcgatcggcttctatgaacgcatcggttgctaaaagccgataacatgtttcgaattggcagggagggatgaccatgattaaaattgcaactagtcaggccattaccgctgaccaattcattcatgtcctaacagcatcgggcatcaaccgaccgactgaggatcgcggccgcatgcaacgcatgctcaacaatgccaacgttttattaacagcgtgggacgatgaacagttaatcgacgttttacgcggcgtgtcagatcgctcctattgtacatttgtgtcagaattagctgtgacgaaggattatcaacatcaaggcattgccaccaagttacttctccaattacggacaatgcaggggccaaatgtctcgatcatgctgttatcagcgcctagtgccatgactttttatccaaaagtcggctttgaaacggtgccaactgggtttaaggttcaacgccggtattaatcggccgactgaggatgtgcatcacgggcagcgaccatataaaaaagaatgattggccgtctttaggaaaatcattctttttttcttgtctataatctaataggacttaaggatcgtcatggcaaggcagagccgtcgtacgccagatatagctaaaaatgtcgacgtttggcactgatcttgttttgaattttggcccattagcgctgctagcggcaactaaagaacagaatggcttaccacgaaagtttgcgcagccggtgccagaaccagtaagcaacaccaatgagcaacaagcctgtgaccacaaaaatgcggccaattggcacctgatctgccagtggtccatagaccaacattgctaatggataaattcctgtcgataggatggcccaaagcgaaaatacacgacctaacttatcagcagggacattttcctgaagataaatggtttgaccggcttgaatcagtgggtaaaaagttccggaaacaaacataaacagtaaatagaagctaaaggattgcggcagtcccatctcggcaaaggcaagcccactgccggcaaacccgatggcaatcaagccaagttgatcgcgaaaatgtttgtgacgggcgatataaaggccgccaagtcccgcgccaatggtccaaaaccactcattaaacgtcaaatgccaaacttctgatccaaatgtccgattaacatacaatgttgataattgtgatgaaggggcaacgaggataaacgccaacccagtaaatagcatgaaggccagcaaaatcggtgttcgtctgacatattgcaacccggcgagaatcccatcggcgcgtttggctgctcgatcatgactggcactcggcgttggtacgtgcaccacactcaaaaacaggatggccaacgcggcagataaggcgtctaccacaaaaatccaaaaaatcccaaggtcacttaaaatataaccagccaacagcggcgacatcacgagcatggccgccatcaggatttgattgtaaccatttacccgcgtgagatgcttggcagggaccagttgtggcaacaaggcattcgccgcgggattttctaaaccgttgccaaaactacgaatcacagcaatcacgagcagcaaccaaagatcttgcgtcataaaagcaaagatagacgcaactaataatgtcagtaaggtgacaacagccgccgagagcacaattaacattttacgattatagcgatcggccaacacgccagccgcgagcgagattaaaatcgctggcaacgcggtcgccagcgagacataggtcatccatgcccctgacgacgtttttagcgcaatatcccacaacacagcatagaacacggtcgaactgccaaaaacaaataaattttgactgagaagaaacgctgctgtttgcgcttgccaacctagatttttatgtgacactctcaacacccgaaatcagttagaatagaaactgtccttagtgtaaatcaaagtgatgtaaaaacctatgatctaggccagacgaactattagcacatttgaatggcagtttctgactcacaaaacaagttgaagatacccaaggggatgtatacgagatggcacagaaaatttttattgtcgaagatgacgcggtgattgccaaaacgattagtgattacttaaatcgctgggcgtttgccgtcagcacggtcaccaagtttgaccaagttgacgcggaaatctcagcggcggcaccagacttagtcatcatggacatcagtctgccatattttaatggctttcactggctaagtgagttacgcaaacatagtaaggtacctgtcatctttttaacaagttctggggatgatatgaaccttgtcatggcgatgaacttaggagccgatgactttctggctaagccgattgaattgccggtgttgctggcgaaaattcaagggatgctgcggcgcacttatcaatatcagcaaatcgacaccaatttatcgcacggcgcctttacgctcgtgccgaccgataatcagctaaaaacggctaagcaggttgttgctctgacaccgactgagacaaaattgctgagtcttttgttcagcgctgacggtgaggtggtgtcgcgcgaagcgatgatcgaaaagctgtgggaaggcgacgattttattgatcgcaatgccttagctgtgaacatgaaccgtctgcgcaagaaagtcacttcaattggtttggcgcaactaatccaaacagtgaagggtaaagggtaccggttggcaagtgaggggacaaagccatgatgaaagcttattgccgctcgcgttgggcaatttggttattgctagcgaccttactggcaacaggttttttggcaagctggttgttggccaactcctttgagattgtcctgaatatgtggttttttgcgacagcgccaccggcagtgattgtgagcattgattattggcgttttcgccgtgaatggcagcaactgcaagacgatcacccaattgatcctgtgcagatcacggatccattaagcctggcttattatcaaaaaatccaaacgctgacgcaaaagctgcgcacaaccagagatactgcccacgaacaagaacaagaaacgctcgacacgctgcagctatggacacatcaaatcaaaacgccgctgaccgcgttagatcttctattgcaagtcgaacctgttaacgccaaagatgcccgacttgaaatcagcaaaatcgatcggtatcttgcggtcatgttgaactatctgaagttgacaacattaaataccgatcttgttttaacggaactgccactcaaaccgttagtcaatgagaccgttcgtgacttggcgaagctgtttatcgccaaggacctgaccgtgactgtggggccattgccaactgttattagtgacagtcaatggctgcattttatttttgaacaattgctcaccaatgccattaaatataccccgcacggttcaattaagatttatgccaaaggggatgctgtcatggtggccgacaccggtatcgggattttggccgaagatttaccgcggatttttgaacaaggttattccggctacaacggccgcgcaaatcagaaagctagcggtttggggctatttttgagcaaacaaatcgctgaaaagcttggcttgacgctaactgtcacctcagaaattgggcaaggcagcacatttgccattcattttccccaaacgcggtggcaagtggagtaagctaccttaccagcttgtaagcaactacgagtcactgtaagtaggcatggggcatcatccccgctaagctaataaatgaaaggggacgatcacatgtcaacattacttaaattaaaaaatatcgaaaaaacttataccagtcgcggggctcagccggtgcgtgccttgacgaacatcagtttcactgttgaagccggtgaatttgtggcaattatgggtgaatcaggttctggcaaaagcaccttgctaaatctgattgcaacgctggacgatccaaccggcggcgatattagtctaaacggacaggatctgagcaacgtcaaggaaggtgcccgggctaagtttcgtcgagaacacctcggtttcatctttcaggatttcgacttgcttgacaccttcaatgttcaagacaacatctttctcccattagtccttgccaagaagcctctcgaaattatgagaaatcggctaactaagctcgcaccacgactaggcattgatgccttgctgaaaaaatatccttacgagctttccggcggccaacaacagcgcgtggcggcagcgcgcgcgatgatcaccgagccagaaattttgttggctgatgaacccaccggcgccttggattctaaaacttctacagaactgcttgatctgctcacagatgtgaatgccgaaaaccggcaaacgatcctcatggtaacgcacagtgctgtggcggccagtcacagccgacgagtattatttattcgcgacggtcaaatttttcatcaactttatcgtggggatctcgatcaaccagcctttctaacccgtatcagcgagacgatgaccgccatgctgacaaaggcaggcgatggacaatgaaattctactttaagctcgctgcaagtaacttgaaagccgatcgccgcctgtttgttccgtttgtcaccaccactagcttcctgatggccgtcaacctaatcatgctgaatgcttacgccagtagtgatgtcttgtttaaaaagctgggggcagccgctagcaagtcactgttcatgttcggcacagatgtcatcgtgattatctctgtgattctcgccatctacgcaaacaattttctgcgcaaacagcgtattcgtcagttaggactttacaacatcatcgggtttggcaaaggtgaactcggcaaaatgatggcagtggagaagctgctactgttactaaccactttactgttcggtggtattctcggtaccgtcctttcccgcatcagctaccttgcgctcgccaaaatgctcaaagttgaccacaatcttgactttgggttaagccagcaagccttcagtatcgccgggatcattaccatcggcttattcgttgttttgctgttagttgatgaactttggctcattcgcaaacggccaatcgaaatcgtgcgagcacaacgagcaggtgagcgggagcccaagacaaagtgggtgacgctaattgttagccttatcgccttaattgccggctactatatcgcggtcacaacaactaatccactacaagcaatgagtatgttttttgttgccgtgatcttagtcatctgcggcacttatggactgttcaccgccggatcggtcttcgtcttaaaatggttgcgaaaccgcaaaaattactattacaaacccaagcattttatcaatgtagctaatttactctatcgtatgcaacaaaacggcgctggtcttgcatctattgccattttggtgacgatgaccttgattacgctcgccagcacggccacgttgttcttcggtatcaatgaagtcgtcaatacgaatacgccggttgatttgtcatatgttctcaaggcaaacgacaccactgcacccggcaaggtggcacggatggccagcgcgaatcatgtcatcatcaagtcgcaacacacttttgttggaccgtccagtacgatggctttacttgatggcaatcggcttgaatcgcaggccaatgtcaatggtccgttcagtatgggcaatgcccgctcggtgcaattgatgaccattgagagctacaaccgctttaccgggcatcatgcccgcgttaagtcaggggaagtgttgatctatacatccaaaaattttcctagcaagaccattcgcattggtcaaaagacttacaggatcagaaaacgtgcaggtagctttccaaatgcacaagcgacttttatccccaatctttttattgcctttcctgaagagaagcaaatgatcgacgccatgcagcatctgagaaatgcacgctatcaaaacgcgtctgatgcgcaagctgatatcaccacaagtcaagatgtgatgttgcaaggaagccatgccaatcagcttaagctctatgaagcggtggtcaagagtcgtatcgctgaatcggcctcagttcaatcgaaagccgtgaattacgatgagaccatgagtatcatgggcagctttcttttcctcggcatcattttcggcgtcaccttcattttggcaaccttattgatcttgtattataaacagttatctgaaggctatgccgatgcccgccgctacacgatcttacaacgcgtcggcttaagcttgcgagaagtgcgcgcaaccatcaacagccagttactaatgctgttttatctgccattactcgtggcagggattcatgtcggatttgcattgccattcattcaacgcatcatgatattgtttggcttaccgaattggcagttcttcctgactgtctcactcatcacactagggatcttcgcgatcatctatgtcctcatgtacaagctcaccggtaacgtgtactatcgcatcgtctcgcgtcgccaagctaccagtcgcagctaacgaaaaaaagcgtcgaaacgccagtaaaaatactgtcgctcgacgctttttttcgttgatgccagcaattaagccggctgcagtgccttgatttcatcaatgatcttcaacaatgtttgctcagctgtttgatagtccgccattttatcggcaaactgctcgtcaaaaccagccaacccgccagcagcaaaggcatactcataggcatacaccgcttcgtaggcggccgcaaaccgctttagcaaatcatgatattgttcgccgccaagttgcagcgccatctgaatcacgcgaaagtccgtatacgccatctcaaattgaactgcccatgcccgcataaaatcatgtcgggcctgaatatgcaggaaatgatgctccgttgtccatgctaatcggttcactgaatctttaacatctaacacaatcaatcccaccttcccgtttcgatctgactcgattataggccggtctggcgaaataagctttcaaaagactcgatgatcaacttcagtaaccatccctcgtcaattaagcttggtcatgcccgcgatcagttgcttttgcggccgtttcagaaacctcacgcaaggcttctttaccgcttttatcactgagattgatatacagatctgtcgcacttgtggtcgtttgcccgagctgatccgcaacctgctgcacatccttggtgaccgtataaatattggttcccaaagtgtgccgggccttatgtggtgttgatggccgaccataatcggttgtataacgcttgaaaaaggcttcgattgtattttggcgaatccgattgattttttggccgacaactgtcacaaacaggggagaagtcggcttttgataaccaataatagccgctcgctgcgttaagtaagcctgaacatacggatcaatccagtctgcaaaattgacgcgatcctgaaagttgcctttgcgaacaacttggaccgtatgccgatccatgttcaaatcttccagattcatattcaccaattcgctgactcgaacccctgagccaaacagtaaggcaatcatggccaagttgcgcacttttgtcgcctcaaaatagcgccgcggcttggctggcagttgttgcgcataactttgatccaaccactgtaaaaacttagcatcttcaccgtccacaaacagcatttcctgtagcttgtggtttcggtaactcgcagtttcagtatgggttttaagttttaccttgttccagacattccgatagaaataaggttcgccatctgcatggggttcactttcctccgtcaaaaaccgataaagcgccttgatcccgactaagcgcaaagcaacactgcgacgcgtcattcgcttgttgtggtgcgtcttggaaggccgttcaagcaaatacgccataaatgcctgggcatcacgcaacgacaaatgttctaacacggtcagcgggacggtttgcggtgaggaagcggccgtcacaccactgttaatcagccagttcagaaactcttgataaaaatgtaaatactgatagagcgtcgaatcggcgatcgggatcgctttttgactctgataatagtcctgaatgtaatccggcagggcaggtagcattgtatgaattaatttcgaataattttgtgtcgacacagatttcacctcgaacgtatgttttcttttagataatgttagtatacgcgaaaacaactgtccttggcgagggctagtgttgatgaaaaatgaacggtggtgctggttcagccattgttctgccatgtgaagcagaattgaataaagttttagctttatccaaaggtgagcaaagatgtcagcaaacgcctgttggtcagacaaattttagctcacataattctggtatgaattcggctattaaatgagttcacttcggtcaatcattcagcaaacttattttggccattggtcaataaaataaatttgctgaatgttgcgtgaccctcaattgttgttgagtcaatttcaaactacacaactcaaaaaatcatcagtcaactcgaagccggctaactgacgagaatctcacaacatcatgaagcttgaattgatatgcatttttctggttttggctggcatgacattttcaatcaaacaaatgcatgcaacacagcgcaaacgcaacgtcccaagtcataattgattgccttggtaaaaagttcaatagccaccacagccaccaccaacattacgtccgaaccacaaatttttgacagccatctgaaagaggggacacccagattcgcagatcaagtgccaaagccaattatttatattctagtttacataatatatattatgcgaagcagtgtttgaagagacggcatcgtgccattctcgcaatatttacgttggcgattatttgattcgcaatttcatccagcacccgatagtcgccgcatttttttaaccgctgcttgcagccaagtctttaaaagcttctacaatcattggaaatcattcgatatttttttgcttgagttttttcgttaagtcaacaactatcaagttgaattcccgaactcgtctcagaatgcgtctctcaccatgcctcaaaaccatccaaaatgacccatgacaacttgctgttgattcgacccgcgaattactacacgaatttcaaattcacgcatcacgagttgctagtcagctttatatttaacagatttcgcaaaaagatggctagagactttttgcaaacaaaaaagccgcaactggctagctgcgactttccttagaacaattgtgtgcaattaaagatgaaagttaaccttcaaacgtgctctgcattggcggaacgacctgctttttgcgggaaacaaccccaggcaatgccaaacgcgcgtccttgtcgaactgttcgttaaaagcactggcgattttatcgcggtcagcaccgactgcgaaaccagttgaattgctgtccaagatgtcagtagcaatcagcaggaaatcgtcgtagcctttcgcctgcgcctctttggtcatggcattgatcaattcgtcctgacgtgcgtaaatgtcgttcagatcgacggtattgacctgtccgatgcgaatagacttgccgcccatggtgaaactcttagcatcgccttcgataatgtccatatctgacttggcggccaaattagtgcctgccttcagcatggcaagaccatatgactgcaaatcaattccggcaatcttcgccatttctggcaaaatcttcttatccttatcggttgcggtcggcgacttcaacaacagcgtgtctgaaatcaaaccagaagccatcaaaccagccaatgttggcgaaatcttgaagccatattcctggaacatctcaaaaatgacggtattggtgctgccaaccggttctgctcggtaaaacagcggcgctgccgtgtggaagttagcgatgcgatgatggtcgacaacagaatcaatcgtcacgtcttcgatatcactgacactttgttgaaattcgttgtgatcaaccaacatgacatgatccgtctcgttggctgccgtcttgataacccgcggtgcctgaaccttgaagtgatcaaggacgaacttagtttcatcgttcggttcgcctaatgctaccgcctcaacatccgtgttgcctgcctgtttctgaaattctgcccagctcatggcactcgtaatcgcgtcggtgtccgggttctgatgcccaaaaatcaaagtcgtcatcttatctgatcgctcctcaactgaataatttacttatcaagtttaacacggttttcactgacccgcgacaagtaatctttttccttcagataatcgtcaaaggtctggaagaagttcgagatccgcggaatgtcagctttctctttgcgataaacaaaagaaatctcaaagcgaatggccggatcaaacgcaatagcataggccttgatttgatcagcgcgtgcccgaacaaaactggttggtaaggccgtgttgacccctgacaagttaacgaattgggttaactgatatggcgtggtgaaatgtgcgaccacgtgcgggaaatcaaccatttgattcttgtacgcctcacgcagaagctgtccaaggaaatagtcgtcaggataagttgcccaaggttcagctaaagtatctttgaaatggattcgcttacggttagccaaggcgtcatcgtggtgcaagaacagcaattgttcatcaataattttcttgctggcgtatggtttccagttcttaatggtttcatctggcagattcatgatagccaaatcaatctggttgttttccaatgattcccaaatttcgtgacgggtcatcatccgtagcgttacttcaacttcaggattcagttgatagtaatgagcaatgaacgcaataaaggcgctatcctcgattgagcttaataacccaatattgatttttccgacggttgcactggttgtttgttgaatttcgtcggttgtctggttcaagatctcgtagatctcatgggttgactttaacatggtctgaccagcgtcagataaatgcagtttcttcccgacagaataaaacagcggtgcccccactgtccgttccaatttcttgatctgctgtgttaaggctggctgggtaatgccaagcaattgggcggcttgggtgtagttcatggtttctgccaattgcagaaaataagttagtgtctttgaggaaaaaatgcgctcttgtttcgttttcatagggcggcttccctttcgtttattatttaataatatcgttcaaccatcatcataagtggcaatgaaaaaaaacgcaacgaatttgccgcgtttttaatcgttacgttaagttctagctaaaaattcagttgctcgcaactggtttcggacgccagctttgccatccggtataatccttaacgtgcagcagattctctgcattcttaacgcgatcggcagacggcggttcgatgccttcaagcgggtacgtaatgccaagctcgtgatactttttaacgcctaacgtgtgatacggcagaatctcaactttttggaccacgtttttgtccaatgtcgcaatatagtcccctaatcgtttgagataagggtcaaagtcagtgcgttccgggaccagaacgtggcgaatccacatgtcatcaccatgcgccgacatatactgcaccatatctaaaatattttcattaggaaaaccggtgagctttttatgctcggccgaatcgatgtgtttaatatcaactaatgagatgtcagtaacagccatcagcttttcaaactggccaaaccacggttggtcacgcgtgaaggggccgcctgacgtatcgaggcaagtcgaaattcccagtgccttagccttggtgaagagttcgagaatgaaatcgatttgtaccaaactctcaccgccactgcacgtaatacccccttggtcaccccagaatgctttatagcgctgggcatccgccaaaatttgatcggccgtcatttcttcaccaaccccaatgttccaggtgtcagggttgtgacaatactggcaacgcatgcgacacccttgcataaagacaacgaagcgaataccagggccatcgaccgaaccaaaactttcgaccgagtgaacataccctttgatcgggccatcatgatcctgaccaacttgttctaagatatttaatgggctttgtgactgatcgatgagtttcatcttattgcctccactacaacatcatgtgtcgttttcaattgattttcatttcattctgccaaaaaacggcaacagcatcgttgccgtcttttggcaaaacaggaatggcttcctgtcttgagttaagctgcttacatttcttcgaagaaggtccgagcaatgacatcgtcttgttgttccttggtcaaatctgcgaagtagacgcagtagccagaaacccgaacggtcaatgttgggtattcttctgggtgcttctgagcatcaatcagggtctccttgttgaagacgttgatgttcaaatgcatgccgctgttttccatatagccgtcaaccatgtgaaccaaggtatccttacgagtttcatcatcgtggcccagtgtgttcggagtaaccccaaacgtattactaatgccgtcagttgcgtaatgatacggaatcttggcggtggacatcaaggatgccaatgcgccgttcttttctgcgccgtatgccgggttggcacctggtgagaatggttcgcctttttgacgaccgtttggtgttgtccctgtattcttaccataaaccacgttggaagtaatggtcaggacactggtactcaacttcgcgccgcgatacagatgatgcgtgttcatcttgttatagaaggtcttaaccaaccacttagcgatgtcatcagcgcgatcatcgttgttaccataacgtggatagtcatcattgtcagcaacgaagtcaactgcaacaccgttttcatcgcgaattgccttgacatgaccatacttgattgcactgatggaatcaaccgcgtgtgacaggccggaaatcccggttgcgaaggtccggttcagttgggtatccttcaatgccagctgtgcagcttcataataatacttgtcatgcatatagtgaatcacattcaaagcattgacatacgtgtcggccagccagtccatcatcttgtcgaacttattcatgaattctttgtaatcaatgtaatcgctggtgatcggtgcatattcaggccctacttgcgcttcctgaatttcatctttaccaccgttgatcgcatacagaaccgtcttagctaagttagcacgggcaccaaagtattgaacgccatcagcaattggttgtgccgagacacagcaagcaataccgtagtaatcggtaccccattcattgcgcatcaggtcatcattttcatattgaatggttgaactttggatggatacttcggttgcatagcgtttaaagccttctggcaagcgttcgctccaaagcaaggtgatgtttggttctggtgctgcgcccatgttgtccaaagtcttcaggaaacggaaagccgtcttggtaacgtggtgacggccatcattgcccattcctgccaatgacaaggttgcccagattggatcgcctgagaacagtgagttatattcttcagtccggatgaaacgaaccatccgcaatttcataaccaaatgatcaatcagttcctgtgcctgttcttcgttcaatttgcctaagcgcatatcgcgttggatataagcatcaataaccgtatcgatccggccaacggacattgcggcaccgttttgagtcttaacagcagccagatagccaaagtagatccactgaacagcttcttgcgcattagctgccggacgcgagatgtcatagccatattccttggccatcttcttcatgtcgtttaaggcacgatattgttcattgatttcttcacgcaatttgattacttcgtcagtcatttcgccgtcgccggtcaagttataatccttgaacttctcagccattaaacgatcgatcccgtaaacagcgatccgtgggaaatcagaaacaatccggccgcggccgtatgcgtctggcaagccagtcacgatcttgtaatggcgagcctttcgcatatcaggggtataagcatcaaagacaccttggttatgggtcttacgatattcattgaaaatcttgtgttcttgaggatctgtcttgaagccataagattccaatgcatcttcagccattcgaataccgccaaatggcatgaatgctcgtttgaatggcttgtcggtctgaacaccaacaatcttttcaagatctttgttcaaataaccagggccgtgtgaggtgatcgtagatggaatattgttgtcagcatccaaaacaccgccatttgcacgttcttgcttctttaaatttagaacctgattgttcaggactgttgtcgcttcagtggggccagcaaggaaactttcgtccccgtcatattggttcaggttatgctcgataaaatcgcgcacattaatttcttcttgccagtcgccgccgttaaagccttcccaataattaggaactttggtttcgtcaagctgtttcatagttgtttgcctcctaaagtggattacagatgtgacagttcttacaaacacagtataacacgccgccaaatctatgcaagcgcttcattgcccatataataggcgttatattgttttttaagtgtgcttcgtcgcttcttttcgcccatgatttcggcattttgttaaattgtgcacaactggtctgtcctataataatcaaaaacgccaccatctgtattagtacagacggcggtgtcaatgatcaccatttattcgacttgatctgctggttcttctttggtttgaacaaaaactggcttgccaaggacatcagtgtcaatgacaaacgaaccattcgaatagcggtcacctgctggatgctgtgccggattaagggtcgttaccttacccgtatcggtcaaaacattcaggcgggtagcgtcatcgactgacatcatcgcgacaatccgatgcggatcacgcttaagctcacgcaagaccagtaaaccacgacgggcacgactcatttccccgacttcgcttaaggccatctttttgaaggcgccacgttgggtcaaaataccgaccttagccgtagttggatccttcactagaatgaaattgacaacctcatcgtctggctttagatccatacttttaacgccggttgcccgggcaccgacagttgacacatcgcttaacgggaatgtcagtccgtaagcgtggcggctgaccacaaagacatcctgttgctgatcagtcgtgaagtatgcattggtgacaatcgcggctgggtctttcagcttcatcgccatcatcggcttactcttgtacgtccgttgcggctgcaaatcacttaaggcagtttgtttgatgtacccgtcacttgaccctaacacaaaactgccagcgccatcgagttgatcaaaagcaaacactgccaagactttttcgtcagtgccaaggccaactgtttggcttaagtgttcgccggtgtctttccaacgcgcatcactaatttcatgcactggtcgataaatgacatttccggcatttgtcacgatgtaaagatgctgcaacgtactcagttcgccagtgaaaatggcaagatcattggccttcaaaccattgtcggccggatcaaccgcctgataactgcgcagtgaactgcgtttaacgtacccatcacgagaaacctgcaccatgacggtttcatcagccaccgtcaccgttgtcgccacttcaagtgtttcaattttggcttgaatgctgctgcgacgatcatccccgtactccttggcaatccgcttcaactcgccttcaatcacccgatcgcgggcagcggggcgggccaaaatatcttgatactcggcgattgctttcgccaattgtgctgcttctttctgtaaagccgtgatatcggtattggtcaatcgatacagctgcaaggaaacaatcgcttccgcctgagcttccgaaaaatcaaacttcttgactaagttacgcttagcatcccctttatccttggaagcacgaatcgcggcgatgacctgatccaaaatcgatagcattttgatcaagccttcgacaatgtgctgtcgagcagcggccttgttgaggtcaaaacgcgttcgccgagtgaccacatcgcgtcgatgctcgacgtatgcttccaacatggccttaagtcctagcaacttcggctgcatgtcggcaatagcgaccatgttaaagttgtatgcaatttgtagatcggtatttttaaataaatagtttaagatgccatgtgcatcggcttctttttttaattcgatgacaacgctaagcccaaaacggtcgctttcgtcacggacttcggcgataccgtccacttttttgttgatgcgtaattcatcgatttttttaatcatctgcgctttattgacatcatacgggatctcagtgaccacgatcttctcacgaccgccacgaatggtttcgatgtgtgtccgagaacgaaccacgattttaccgcggccggtttcgtaagcttgcttgatgccatcaagcccttgaataatcccacctgttggaaaatcgggacccttgacgtattgcattaaagtatctaaatcagcagtgggatgcttcagcaagtataagacggcggcaataacttcccgcagattgtgcggcggaatttcggttgcataaccggcagaaataccggtggcaccgttcaccagcaaatttggaaacccagctggcagcacagtcggttcctgtgccgtgtcatcaaagttcaacaccatatcgacggtttccttatcgatgtcggccagcatttccttgctgattttgcttaaacgcgcttccgtgtatcgcattgcagctggcggatcaccatccatggaaccgttattcccgtgcatctgaatcagtggggcccgtaacttccaatcctggcttagccgaaccatcgcttcataaatggagctgtcgccgtggggatgataattacccatgacattcccgacacttttagccgacttgcggaagcccttatcatacgtattgccatcttggttcatcgcaaataaaatgcgacgctgaaccggtttgaggccgtcacgcacatcaggcagcgcccgttcttgaataatgtatttcgagtaccggccaaaccggtcgcccatgacctcttctaaggtcagttcttgaatctgattggccaatggcttttactttcctttcttgtccagttgtttgacgatttgcttggcaccaaactgtaatttttcgtgattagcagtcggggtttccaaaatactgccgtcgtcatccatatcaaacttgacgttatgctcaatccattcacgacgcggctcaacgcgatcacccatcaaagtggtcacgcgtcgttccgccagctgagcatcgtcaatccgaacccggatcaaagtccgcgtctcaggattcatagtcgtttcccaaagctggtcggcattcatttccccaagtcctttaaatcgggtcaatgtgtaacccttgcccatggccttggtctctttggccaactcttcatcggtccaagcataactgatcttggttttagcaccagcgcctttttgcagccgatacaatggtggcaaagcaatgtaaattcggcctgcgtcaatcagcggccgcatgtagcgataaaagaaggttagtagcaaaatctgaatatgcgcgccatcagtatccgcatcagtcataataatgattttgtcgtagttggcctgctgcagatcaaaatccgcaccgacaccagcgccgatggtgtaaatcatcgtattgatttcttcgtttttaacgatgtcctgtaacttggccttctgggtattcagtactttccctcgcaatggcaagatcgcctgaaactttcggtctcggccttgtttagctgaaccaccggcagaatccccttcgacgagatacaattcgttacgcttagggttcttggtttgcgccggggtcaatttaccggaaagcaaaccttggtccttcttgcgcttgcgtcccgtccggctatcgtcgcgcgcttttcgagccgcttcccgcgcatcacgggctttgacggctttacgaaccaactcttgcgactcttcaccgttttccatcaaaaaagttgacagcttgtcatagacaatcccatcgaccacagtgcgggcttgcggcgtacctagcttgccctttgtctggccctcaaattgcaaaatttcttctggaatgcggacacttaaaatacctgcaaaaccttcacgcacatcactgccttcaaggttcttgtcgcgttccctcagcaagccgacttttcgggcaaattcattgaatgctcgcgtcatgccgctgcgcaagccaatttcatgcgtcccgccatcaccagtgcgaacgttattaacaaacgaaatcaggttttcagaatagccatcgttatattggccggcaaaatcaaccacgataccgtcctttttgccttcaaaattgatcacctgtgacaatgcgtctttgccttcattaaggtatttaacaaaactgaccaagccatcaggatagtgataactgtcgtgcttaccggtgcgttcatccgtcagattaatcgtaatatttttcagtagaaaggctgattcgcgcaagcgttcggccaaggtatcataactgaagacggtggtttgaaaaatagtcgggtccggcttgaatgtgatggtcgtgccattaggttcattaactttgcccaacttctgcaaactgccatcaggatgaccgccattgataaaatgctcctcaaatgcgtgtttatcccgcacaactcgcacagtcaatgactccgatagggcattgacgacgcttgagccaaccccatgcaaaccaccagaagttttgtaactattttggttaaattttccgccggcatgtagcacggttaaaatgacttcaatcgtcggtttaccactcgggtgcatccccgttggcatccctcgaccatgatcctgcacggtcacagagttatcggcgtgaatcgtcacattgatctcatccccaaaccccgcgagcgcttcatcgacagagttgtccacgatttcatagaccaagtgatgcaaaccgcggccatcggtggaaccaatatacatccccggacgcttccgcacagcttccaagccatgcagcacctgaatggatgaatcattatatgcttgcgttgctttatccatagtaaactcccttttttgaacaactaagttatagaatacaccacgcgttgagatttcagaaataaaaaataagagcgcgagccagcccgattagaaaccggagcataagcggccttgggtgcgatggttgggctttgaccattgtgcccaaggtccttatgtgcaggtttctgggctggcgagcgcgtttcaatagagcagcccgattagaaaccggagcataagcggccttgggtgcgatggttggactttgaccattgcacccaaggtccttacacgcaggttgctgcgagtgcgtttaggcatcaacaccatcaacagcagacctcaacgtattgctctcaggactcctgttttctcctcaaaatcgacccagctggctaataccatcattgttcatttaaattttattagccgtgtcaatgtcccaaagctcagcagaaaaccgcacttccctaagcatggcacataactatgacttcttgacgtgaaattcatcgcccgctggcaccatatctacgctgtgccccgccatgatccttgcgcaagacaacaccaaatcgcgccacaacccgcttcacaggttttattcgaatgtacgttcgttttattctactgacgtatcactcaaaagtcaaaaatgctaaaatagtttctagtttgagaggaggggcacatttgatacttgtgctttgttttatactcgcgtatttcataggcgccatcccgtttggtgtggtcattggtaaactcttttatcacacggatatccgcaaaggcgggagtcacaatattggcaccacaaatgcctatcgcatgttagggccagtcggcggctcaattgtcttggtgctggatatcttaaaaggcacgttggctgccagcttacccattctctttggcatcgagcatcattggctggtgctgatcgtgggtttagcggccgtattcggtcatacattttcgatctacattcgctttaaaggcggtaaggcggtggcaactagcgctggcattttacttgcatataatccgccattttttgtcattgcatttgccatctggttcagtttgatcttgctaacgtccatggtcagcgttgccagcacactgggtatggtgttgatcacagcttggtcgcttgtttaccatgattggttgctgacaactgttgcctgcgggttgctggttgtctttttgatcaaacatcgggcaaacttcaaacgcatcaaggccggagatgaaaatatggtgccctttggcttaggccaatatcttcgtcaacaccggggccgctcttagtcaccttttgatggcaaccaaaaagacatccgaaactggatgtctttttttcatgtacctaatcgacaaactgatgacaccttagaaaatgctgatcatgtaacccttctcaaatgccgtgccaggttcaagtcgattgatcccgagtttgcgcgtcaggtcgccagtgctgccaatcgtgtcggcgatgccccaccaaggttcgatgcagacaaagtcgccagtggttggatacggactccaaacgcccagatatggggtatcggtcatggtaacgctgacaccatgtttcgtcttgtcagaaaccaagttgaaggttgtcttaccaagcaacgcgaaaattaaagcatcatgatcaaatgtttcgtgcgttaaggccaaattggcatcagttgcagccaaggtccggtgcgtgtaatcaatgccttcaccagcaaccaatggaatctgaacaagcgacttacgcggtttgaagttcaaataataatcggagaattgagtatccggcgtcattgggaccttgaagcccggatggccgccgatgctaaagaacagtggctcacttttgtccggattgtcaacgtgatacgtgacatgtagattgttattttctagtgcaaacgtgatgattaaacgaaaagcgaacgggtacatcgcccgcgttttgtcatcatccttcagaacgaagctcgctttaaacggtgtcgcagagagcaccgtgaaatcacgatcacgggcaaaaccgtgctggcccatgtggtaagtcttgcctgcgtaatgatattgattgtcagccagcgccccaacaatcgggaacaagaccggggcgtggcgaccccacaccgcaggatctgcttgccacagacgctccctgcctgtcaggttatctttgatactggtcagttcagcaccatgccgactgattttaactgtcaaaaagtcatttgcaatcgttaccatacatcctcatcctttacctacaacattattgttaactacaaaatataccgcgtcatgtttgaatcagccgcaatatggccaatcttgtcatccacatattgctgggtgacggtcacactgcccatcgccatatctggaccttcataaagtacgtcttcaagcagtttttcaagaatggttgccagtcgccgcgctccaatattatcagtgtcgtggttgacctgagtcgcaatctctgcaattcgatcaaccgcttccttcgtgaaggtaatcttcacgccatctgcaccaatcaaggcgatatactgcttgatcaaagcattgtctggctcggtcaagatccgcacaaagtctttttcggttaagtccttcaattcaacccgaattggaaaacgcccttgaagttcagcaatcaaatcactaggcttagcctcggcaaacgcacctgagccaatgaacaagatgtgatccgtattgataggaccatacttagtgttaatctgcgatccttctacaatcggtaaaatatctcgctgcacaccttcacgcgaaacttcgccgctattatgcttgtttcctgcagcaattttatcgatttcatcgatgaaaatgatcccgttattctcggcactttgaatggcgtcgtgataaatgtcggcatgattgaccagtttgtcagattcctctttgatgaagatttcgcgagcttctttgacggtcatggtccgctcaacctttttcttaggcattaaagcgccaatagtgtcgcttagatcaatgcccatctgaccgtacatgtcacccatgccaccgccttttttctcatcattgacagcaacggtgatttcatgatcttcaagtaatcctttttccagttgctctgccacgctcaaacgcttattgcgaatatcatcggtcacttcgccgcctgcatctgcatcatcgccagctggcattttgccattttgcatcccttgcaacatgctcatcatctcggccatcggattggtattcttttccttacgaatggccggcactaaaattttaaccaaacgcttgttggcttctttttcggcacgtatgcgaacctttgaaaattgcttctcttcttccatggcaacggcagtttcggcaagatctcggaccatggattcgacatcacggccaacgtagccaacttccgtaaacttagtcgcttccaccttcacaaatggcgcctcaactattttcgccagtcgtcgtgcaatttcggttttcccgacaccggttggtccgatcatcagtaagtttttcggggtaatctcttcttgcatttttggcgataattgcattcgccgataacggttatacaaggcaaccgcgacggcccgttttgcatcatcttgtccaatgacatattgatcgagtttttcaacgatctgttttggggtttgtacttctgccatcataagcctcctgtaggtcaatgtaattgccgacggttacaaactaaaagctttcgacaataacattgtggtttgtgaaaatatcgatattccctgcgatattcactgcttctttggcaatgtcagctggtgtcatatctggggcatgccgcagcatcgcgattgccgcggcttgcgcaaagttgccgccggagccgatcgctaccacgtcttcatctggatctatcacttcgccagacccggatacaagtaacaggtcatgctcatccatcacgatcatcatggcttcaagtttctgcaaggtcggatccttgcgccaatcttgagccagcgcaactgcggaacgtcgcaagttgccagcataatgctccagcttcttttcaaaccagtcttgcagggtgaaagcatctgccaccccgccggcaaatccgatgacgacttgatcatgatagatccggcgaactttctgcgcgttgcctttcatgatgaccttttcgccaagggttacctgaccgtcaccggccaaagcggtcacaccatcttttcttactgctgcaattgttgtcatagtcatgctcctttttaagtgagcgcgagcagaagcgcttagaaaccggagcatacgggggctgcaagcctaaatggctgaattttggctatttaggcttgcaggtcattatgtgtaggtttctgcgactgcgagcgcgttatctgcgtatctcgtcggataaaaacagctaaagtagcgattaatctgttatcgccaatgttcttagcttaaaaaactcagactgcttttgcatcatgctttagtcttaattatgcttcggataatatttcatatactcattttttaaatgtgccatggtgacatgcgtgtagatttgtgtggttgataaacttgcatgacccagtagctcttgaacagttcgcaggtcagcaccatgatccagcatatgggttgcaaaactatgccgcagcatgtggggatgaatgttagctgtcagcgtcgtctgcttgatgagctgatccaaaatatattcaatgccacgcgaggtaatcggacgcccatactggttcacgaatacatatcgatgctgtgcctgacttttagccatcaagacttgtcggccatcttttaaataagttcgtagtgcttgctgagcgtactgtccaaagggcacatacctatctttgttgcctttaccatgaatcaacagtaatgccgtattgaaatcgacctgattcaatgtcagtttggcacactcggaaactcgaataccggtgccatacaaaacttccaacaaagcgcgattacgttgatccagcggggttttgccagcaactgtcttgaacagttcctgaatctcggcttcatagaaaaattgtggtaaatgatgatgctgcttttttaattcaaccagctcaaatgggttgcgtttgacgacatcaattcgtgtcaaataacggtaaaagcttcgcaaactactgatttttcgggcaatcgatgtccgtgccaaatcctgtttgttaagatcagtcaaataagtttgaacgtctaaatcatccacatgccgaaagtcagtaaacccgccgttggccttgagaaacgcctgaaattcttgaagatcactcaaataagccgtcactgtttccggtgaatactgccgttcaacttcaagatactcttgaaacgctgcaattggcttcattgaatccctccgataatacattaacataaaatgcagccattgttgacgctttcagtgcatcaacaccatcaagccgccgaaataccaatgaaaaaatcccggtaacccgagattttttgcgtccttaaacttgttcaacccgattcatacctgcttggaaagtagctaaatcttttaatgcacgatcagctaactgctgattgcgttcttttttattgcgtattttgactgttaacgctggcatgatgccaaagttcgcattcatcggctggaagtgatgggcggatgtgtgagtaatgtaatgcgccattgaccccatcgctgtagtttcgggaaaaatcagcggggtttctccaagcgccatacgggtcgcattgatacccgcaatcagaccgctggcggcgctttcaacataaccttccaccccagtcatctggcctgcaaagaacagatcaggccggcgtttggatgcatatgttggttccaaaaccactggggatttcatgaaagtgttgcgatgcatgacgccataccggacgatttgcacgttttcaagtccagggattagtcggaaaacccgtttttgctcgccccatttaagatgagtttggaacccgaccatgttatataaactcgctgcagcgttatcttgacgcaactggacaaccgcgtaaggttccttacctgtccgtggatcttcaaggccaactggctttagcgggccaaacaacatagttttaataccgcgtttggccatgacttcaatcggcatgcagccttcaaaaaccgtcatcttttcaaaatcatggccttcagcaacttcggcagaaacgagcgcttgatagaacgccaagaattcatccttcgtcatcggacaattcaaataggcggcttcgccacgatcatagcgcgactttttataaacaatgtcctcgttgatcgtattcgcatcaagaatcggtgcggctgcgtcaaagaatgacaaaccggcctcgccgttcagatcaacaattgcctgtgctaacccgggcgctgttagcggaccggtagccaccactgtgatcccatcaggaaatgctgacaattcctcattcaccacatgaatatgcgaattgctcgtcaacttttgggtcactagctcgctaaatggttcgcgatccaccgccaaggcaccgccagcagggacagcggtggcgtcagcactttgaataatgattgaatgtaactgacgcatttcttcctttaatagacccaccgcattggtgatctggttggcgcgcagtgaattcgtgcagacaagctcagcaaaattgctcgtgtgatgagcaggcgtcattttaacgggacgcatctcgtataagttgacatctaccccggcctgagcgatttgccaggctgcttctgatccggctagtccggcaccaatgacattaactgttggcatgagtgattcctccttgtggtggcgtggcgcaattagttcgttcagagaaaatgtgagttttgcggcacgtgtattttggtggcttgctgatgcggtagcgactcagcttgctattgtgggcagactgaatctttgagcaagctttctaaaggcgcgatcaggcgcagaaaccttcgtgtaaggaccttgaagtctaaatggccaaagttcagccatttagactttaaggctggtgatgctccggttccgaaacgcgcaaacaggcgcagaaacctgcacataaggacctcaagcctaaatggccaaagcccagccatttaggctccggtttctaagcgcgcctgttcgcgctctgcccaagtttacccgaaaaaaacagtgagtacaaagataacatactcactgctttctcaaattatgctttttgtaaggcttctttataatcgttatttgggcagacaacttgggtgccagctttgctctttttctcaactaagaaatgtccgcagaccgggcaatcgcggccgactggtttgtcccatgagacaaagtcgcagtctggataacgcgagcaaccataaaaaacgcggttacgcttgctcttacgttcaacaacttgaccgatatgacatttcgggcagacaaccccgatctctttgacaatggccttggtgttgcggcaattcgggaatcgggaacaggcgtaaaacttaccatagcgacccattttgataaccattggcgcaccgcagatgtcacagttgaagccggctggttcgtctttgatttgaatcttcgcgatcccagtctcggcgtgagccacttctttttcaaatggcttatagaactgatcaatcaccttaacccaatcagcctcgccggtttcaatcccatcaagttcagattcgacgttcgccgtaaacttgatattcacgatgtccgggaagaattcaacgatcaagctgttgacgatctcacctaattcagtcggttcaaaccgacgagcattcagtttcacgtagtaacgtttctgaatggtttcgatagttggcgcataagttgacggacgaccaacgccattttcttcaagcgctttgacaaggtttgcttccgagtaacgggctggtggctgtgtaaagtgttgagccggatcggtcttcaacattttgacatcatcaccaactgcaagcggtggcaaaatattgtccttttgatcgctgtcacgtgatgagacatacaacttggtaaacccttcaaacttagtctgactaccgttggcgcggaaagtcacaccgttttggtctaacgtcacggccacagtgtcaataatcgccggggtcatttcactggcaacaaaccgactccagatcagccgataaagtttcatctgatccttgtccaaaactgccgtcaaactatccggtgtccgtaatgtgctggttggccgaatggcttcgtgggcatcttgtgccccttcctgcagtttaccttggcgaattttgacagcagcataagcttcgccgtatttctcatgcaggtaatggctggtttcagttttggcaacatttgacacgcgagtcgagtcggtacgcatgtacgtgatcagcccaacggtgcctaacttaccacctaagttaattccttcatacagttgctgggccaacatcatggtctttcgggtgcggaatcccaacttacggttagcttcctgctgcaaggtactggttgtgaacggcggggatgggaagcgtttgcgttcctttttaacaacattcgtcacagcaaacggcttagttttgtccacttgacccaaaatcttttgaacggcctcgttgttctttaaagcctgctttttattcttcaggccatagaaactagcactgaactttttactacggcccttttggaactcagcatctaatgaccagtattcttctggcgtgaagtttttgatttcattttcgcgatcaataatcagctttagcgcaacactttgaacgcggccagcactcaggccctttttaactttcttccataataaaggactgatggaatagcctaccagtcgatccaaaatccgccgtgcctgctgggcatctacaagatccatatcaatgccacgaggggttttgaacgcatttttaacggcatctttcgtaatttcgttaaaaacgacgcgatttttggcttttggatccaaacctaaaatgtgactgacatgccatgcaatggcttctccttcacgatccggatcggctgcgagataaatcttgctagcttttttagcatcttttttaagggatttaatcacatcgcctttgccgcgaatcgaaatgtactttggctcgtagtcgttatcgacatctacccccatctgactcttaggtagatcgcgaatgtgccccaaacttgcaacaactttataggttcggccaagatacttttcaatagtcttggctttggctggcgattcaacaatgactaacttcttgtcggccatgaacgcgctccttccggtggcattgcctagtaggcaagccctgattaatttgtgcgatgctgacgattcgtcgtcagtaattgatgcgtcctaaggcggcaatagatcatctgccaccggcgcgaccatcaaagcaatcgcaactggtgccagtctaatggtcaatgccacctgctgactcaaaacagttgctatcataagctagtcattttgctcttgtcaaatcaaaagaaattttttctactataaagtaagcaaagatgtgcacctcaagggtaaaaattcaagttttctaccaacgtctctggaccagtcaccaacgccgctcctgcctgaatcagcgcatttgtacctgctcccaaaggcgcatcaattcgattaggcaacgcaaaaacttcgcgattatgttgcaaagcatagttagccgtgatgagactgccgcttttcatctccgcctcagttaccatcacaccatgggcaataccggcaataatccgattgcgagcgacaaattgaaaccgctgcgggccggttgctggtggatactcacttaaaacaagcccaacatgcgcaatctgcacctgcaaatcgcggttcttggcaggatacacctgatcaaggccgttggcaatcactgcaatcgttggcagtcgggcactgagggctgcctcatgcgccatcgcatcagctcctgctgctagtccacttgcaatcaccattgacggtagttgcggcaataactgcgccagcgccgttgctgaatagccggttgcacgccgcgaaccaacaatccctaacgttaattgattcaacagacctaactgcccacgataaaaaagcaccaacggcggctgcggaatttcccgcaatcgtggtggataagcagtatcaacatacgtcataaacggcacgtgtttggcagcaattaattgttgactaaactggtcagccaaacgtttcttgagttcttcctgaaacggtgcgagatcatcttttcctcggatagcttgttctaaagcaactgccatccgcggattctggcgtgtggcaatgtgccatgctagtaaaaaattgcgcagtgtcattgttggtcgtcctcccgcaaataaactacgcaaacacgacatcgacacactcaatgaagcactaagagcgcagtcgatcacggacaggcccaaaactgcggcgatgaattggggtaacgccgtgcgccgccaatccggcaagatgtgcctttgtcccgtatcccatgttgtccttaaaatcataaccaggataaattttatcgtacatcatcataagccgatcacgaatcactttagcaacaatactggccgcagcgatactgatgctgttggcgtcgcccttaattaagcgtttttgcggtaagtcgactggcacgtgcattgcgtccaccaacaaacattccggagcgactcgcaaatggtcaacggcttgagccatcgccaattcagtcgcatggtaaatattttcacggtcaatcgtccgattatcagccacgccaatgccaactgcaatcgcttcagttaaaatatgcgggtaaagcacattgcgttcatgtgcggtcagctgtttcgagtcattcaccggccactgaaaatggtgcggcaaaatcaccgccgccgtcacgacagggccagcaagtggtccccgccctacttcgtctaacccagcgacatactcataggttccccataactgacgctcatacctgctacgataacgtaaagccacctcttcggctgcttgatgggcctgtcgccgttgatacgctgccagtaatttgccagcaccgatgcgactgtcttctttaagtgccgccaaaatagccggtgcaacttcgtcagcagccagcaacgctttatactcactcagcgtcggcatctgtctcaccaggcttctcgagggtaaagcgtcccaattttccttgtcgtgcatcaaaaatcaagcgctcagccatccgatcgtaagcctcagcgaaaccttgtgatttcgtcaacttaaccagcagatcatggggcgcttcatttaaatcatcatcggtgacatggtatgcctttttcaaagcagctggataatgcgccataaagtaagtcaacccatacaagccaaccatgtcttcttggaaaactgcatcggcaattgcacctgtaaaggccaaccgcatcccaattgcttgtgaggcaaacttcggccaaagaatcccaggggtatcaagcaattgaaagttatcactggccttcaaccactgttgattcttcgtcacgcctggtttgttgccggtcaccgcgatgttacgccgaaccagacgatttaacaccgtcgacttgccgacattggggatgccaatacacatcgccttaatcatcggattacgaatgccgcgcgcctttttccgggcaatcttttccgccatcaacttcgtcgccaattgcggaatttgctgcaatcgcttggcatgctgggcatcaatcgcaatcgccgcaaacccttgatcctgataatattgaacccatgccgccgtcaacgccggatcagccagatcctgcttattcagcaccataatgcgcggcttatcagccaccagctcatccaacattggattgcgcgacgattccggcgtccgggcatcgacaacttcgagcacgagatcgacttgtttaatcttttcttgaacttgtttccgggctttggccatgtgaccgggaaaccattgaatttgtgccatttttgtaactcctttagtactaagacaattaaaatctcagtatgaactatttcctaacgactagcatactgtatttatgtgaaaagtaacaactgcctgtttttaaactatgatagccgaaaaatgtgtcgggccgctcagtcatgcactttttagtcgctaaccatctcaccaaacctcttgcgagttccttcatccccaggcagttgcacgccgataaaatcatcattccccaaaaacttaagaaaagtctcaacgaaatagagctctccggcattaggcacgctgagcagcaatcgttcttctcctaactcttcgacctttagctgatcccacgtttgcttaaagacgggatcatccttcaccgcggaataaacttcaaataaggcctttgaatccggcgttcgactatataattggcgaaactttgcggtaagcgcactggcataattttcccagtcaaccatgacaacacgaaaatgcggatcattgaacgtgtgaaaaaaacgcgtacatacctcctaaaaggcatatacgcgcatatcataacctatttgattttcacttggctactgcatccacagccgccttcatcatcggatcatccttggtcaactgtgcactcaacttctgtgcgagcgttgccaacgtatcctgatccgctgttcctgttgcgtcaagcttatttgcttgctggaacgttttgacagcggcttgggtggcatcgtcgtattgactattgacagtgacggagccgactttaagtgccgtgagcatttgttgcaaggacttcacatcgctgcctttatcgcctggtttgagctgagtggcgttgatcaaggtgatcttcgccgcggctgggtagtcgaccttgatatcgggtgttagacctttgtggttaatccaagtgccatttggcgttaaccatttagcgatggtcagcttgagttctttgttgctgcccatttcgccgacattttggacagtgcctttgccgaaactcttttcaccgacaagcggaatgttgctgttttggtgaagtgctgcagcggtgatttcactggctgaggccgaattaccatcaattaagaccgccgttttttcagtgactttaaagccgtcatcgagtttcttgccagccttatagacttccttggcaccgttgcggtcttcgacttgcagaacagtttggccgtttttagagaacatggagctgatggacaaagccgcactcatcatgccgcctggattttgccgtaagtcgaggacaaaggatttggccccttctttgcgtaatttcttaacagtggccttgaattgtttgacggttggttcgctaaaagtcgagatagtaatgacgccgacctgtttgttggccgaagcaagttggccagtgacagtgtcaaccgtgattttctgccgcttcatcgagaaggtcgcttgtttgctgccgcgcttaacggtgacggccactgtggtaccgattttaccgcgaattttggcaactgccttgctaacggtttgcttggagacatctttaccgttgaccttgagcagcacatcgccgacttgcatgcctgcttttttggcgggcgtatcaggtaaaatgctggcgatggaaagactgtcatgattttgctggatggtggcaccgataccgccaaatgaagccgaaatcgtgtcatcaagattggttttatcgttattctgcaagtaaacggaatatggatcatctaacgttgccagcatacctttaatcgcgccatcggttaatttggtcgtattgacgcttttatagtagttattggtaactgtctcataagcagcaataacgggtgctagttccttggggacacttgttttcaaaacactttgttgagcttgctgataagagagcgcgtaaccgcctgcgacaccaccgccaagtgcgacgatgacaattatcaaaacggcccaccacggtaatctacgtttattgatacgaatcgcctcctgtgctttcactcgcctcataggcgcgatacgtttcgtcaaaaacggccatgcttggcaaataattgccgtttagttccagataatcgcttagtcgatggtaatccttttcttgcttaggaaagctttgatccaaaaaggcatttttcgcaaattcagcgatttcactatggtcattggggttacgcagggtcatgagatattcgtaaaaagtccgatgcattattgatccttccatgttttgtcgataaaagcctgccgttgcgcatgttctaatgcataacggcggggattcttagcataaaactgttggtgctcaggctcagccggataaaacggcttggcagcttcgatttgcgtcacaatcggatcactgaagcgcccactagcagctaaggccgtttttgaagcctctgcagcttcgcgttgggcatcatccttcacaaaaatcaccggtcgataattatcgccgcgatcctgaaactgacccatagcatctgtcggatcggtttgctgccaatagatgtccaacaacttcggatagctaatggtgtcggcatcgaaggtgatttctacagcttcagtatgtccagtggtgtgagacgaaacctgttcataggtggggttggcgacatggccgccagtgtagccggacactacattcaaaatgcccggctgctcttcaaagggttcaaccatacaccaaaaacatcccccagcaaaaatagctgtttcttttttcataaaatattcagcttctttccaatgatcactgattatccgggaggtaaactgcgaactctaagtcatcgttcgtcggatctagtttagtggcccgaagcgtcatgccattttggagtttaaattggctcaattttagcacaacgtttcctgccttactatcaagactgacccagctagggattttataactatgcccaatatagctcattacgaaactaatcgggactggcaatgcaccgacgttcaatttctttgactttagcaaaacatcgccatttttaagtaccaacggatcaaaggtcaattggaacttgacattattgccaagaaatttgaacgaaccattcaacgccgcctcattattgccaagggtgacggcgtatttaattgggctgtccttcagataggtttttaaataatgtgccatgattcggttggcactactcttggtgactttaaccgtgaaaaccgggtcgtttgaaatcgtcttagtctctgtggctgtgttcagtgaaaccggcgctaagacggttttggtaaaccaaattccgctacccaagataaggccaatcaggattaaaaatgcccatttccaccagttaatcattgaccagctgatcgatttttgtttgcgctgccgtttcttttctgtcaccctaatcactcccaatctttctttgtggctgttagtttcgtcatcaattgtttagtcatttgcgcataaccggcattattaggatgaaaatgatcttgcgaaaagatcagcgggttgccatctccagatgttgcttccttcaaagcctcttttgcagaagccttgttggcgacagtttccccatttgataggaccttatcgatgtcaatgtaatagacacgttggaagccttgcaaggtcttttgcgttgcctgattccacgcgctcacgctattagtcatcgctgtcatttttggaaaataaacataaaacggattatagatgccaaaaacataaatcggtgccgttgcgttctccttacgaatagttgtgagtaaggtcgttagatgtttctgaaaagccgtgctaccagcagtgatctctttttcagacaagctaagaaaatgttgctgcaacacatgcatcagatcattgccgcctgccgtcacggtaatgatattggcttgcttcaaatctgtacgaatcttcgcctgtttattgatgcgactaagaatctgggtgctggtgttaccactaacaccatagtttttcgtcgtgacttgatattggccggtagcttccaaatcggcctgagtgagtccaacaaaaccaccgttattcgtggcatcaccaacgccgtatgtcagcgaatcgccaaccgccgtcagcttgagttgcttcggctgatcagccgtcagtttgacttgactgggcgcagcggcagggccgaatacttgccagcttaaaaaagccgctataccggctagcaaaatgacgccgaatgaaataagaatactttttaacttggccatggtgcctcctgtgtttctggtcaaatgactggtattaataggctattgtacttgacgttgtacaaattaacaaaggcgctccgtctgaatgatcattgacaatgaccaaaaacagtcgacaagggcgcccagtttgattcaaaaatggtgccggctttgcttctctctaaaatcagggcacaagtagccgcagatgcccgcctaaccgttttaggcatcaccagctgtcgttgccttgatcatgcccgaaaccgtgcatacggcgttttcaagccacaagtgttcgtgctttaaaaaagccggcgcttccgccggccagttaaattttattaaaaattaatcaacgtagtacgtaattgcaaacgcacctggccctgtatgggttgcaatgactggatcagtcggtcgcaccagaatcgggacactcggtagcacttctgcgatgcgccgaccaatgtcttcacctaattccttagcgccggccgttgaaataccaacacttttgatgttgctgagtttggccattttagcaattgtttcggcgatgaaattattaatcgtcttcatcccccgacccttgcgtaaggctttcagttcgccattttgcagttgcagaatgaccttgatgttcaaaaacgatgaaattaagcctgaaacacgactaagccggccacctttgaccaaattgtctaaattcgttacgccaaggaccagtgtcgtgttgtcccgcacttgctcaagcttatcaagaatcgttttcatatctttgccggcttcggccatttcagcagcgactaagacctgaaaagccatcgctcggtccgtgaactgcgagtcaatcaccgtcactttgcctttcgcaatttgagccgcttgccgcgaagaattcaccgttccgctgatcgtttcagtcatatgaattgccaaaacttcgctaccgtctgctgtcagtttgtcgaaaacatcggcaaacgtaccgacagctggttgcgaggttttgggcagattttgcgccgcagccatttcatccataaaatcatcccgtgtgatggtttcgccatcaatataaacggtattatcaatcataatggtcagcggtacaaccgtaatgttatgttggctgatctcttctggagtcagttgaacggaagaatccgcgacgatcttgatatttgccatgtctgagccacgctttctgttaggttcgtttatcgaactcattatagcaaagtccagaaatattgtcagtacatattatctagttatcataactagattaagttgtattgtgaaacgtaccatgctaaaatcgtaagtgaattgaagcgtgcccggcaattctcgtaaagaaatctgtaccggttgcaccaaggaggtagaagatgcgcgtggcaaaatcaaagcattatgaatttaataatgaaatgtttagtgcgataacccatgcatttgccttagggctggcagtggttggcacgattgcgttgggtattaagggcaccaatagtggcagtcagcttgagttaatcagttacttaggatttgggatctccctcatcatcttatatacggcttcaacggcgttccacggtttctattttagcaaggcgcgccatgtcctacaggtcctagatcactccggcgttttcatattaatcgctggctcttacctgccttactgtttggtcgcgattggcggaccattagggatcggcctgctaattgccatctgggcgctttgctttggcggcatcctctacaagctgttcttcttgaatcgcttcaagcatctggaaaccatgatttacgtcattctcggctggctttgcttaatcggcatggtgccactgtggcatcacttaggaccgattggcttctggttactggttgctggcgggttagcatacacaggtggcgctatgctgtacctgcaaaaaggcatcccctacatccatgtcatctggcacctgtttgtcattctcggcagcctgtgcatgtacatttcaatttaccttttcgtttaatgctaactatataaaaaagatcggctcgctccgtcagacggagaagccgatcttttttgcacatgagtcaattttagttaaaaaaacgaactacaaatgcacataactatttaagttccttaaaaaatttctttagctgctaaacgcgtcagatcatttttgcttttgccaaacttcataagtatgcgtcaaagcggggttttgatcttcgacagttcggcttgaggttttagtaaacgcatcccaatctagtggaatcattttagtgtcacctgcaaaactgccagctagacgggtcacgagcaaggtatcaaccatgtctttaaaggcgctaaagatttgagcaccaccggcgatgactaatgcctgatctgcatgttccttcgcataatcaagcacttcagcaacctgatgcaagacaatcgcgcctggtgcctggtaatcagcctggtgcgtcaaaaccacgttcgtacgatctggtaatggccgttttggaaaactttcgtacgtgcgacgcccaaccaccatcattttcccttcagtctgagtccggaaatgatgcaaatcatctggcaaatgccatggcaaatggccgtctttaccgattacaccatcccgatcctgcgcccacaaaaatgctaccatttaaaatccccctcgtttttgatacgtctgatggtactgcaatcagtcagaaccgtcacttaaacagcttcgatatcgccaataataagctttctcgccgacaaggcagcccaagcacgtgcttcgcttaaacggcaactggtgctttaatggccggataaggatcataattcaacaatttaatatcttgcatatcaaaatcaaaaatatcgtgtttatctggattcaagaccaaggttggcgcctgccgtggcgtccgcgttaattgttctttgatttggtccaaatgattgacatacaaatgagcatcgccaaatgtatgaatgaagtccccaacttgcaacccgcattcatgggcaacaagatgggtcagcaaggcatatgaggcaatattaaacggcacgccaaggaaaatgtccgcagaacgctgatacagttgcaaggaaagtttgccatcattgacataaaactggaagagggtgtgacaaggcggtaacgccatggttggcacatcttctggattccaagcggatacgatcaagcgtcgcgagtatggatgcgtcttaatctgctcaatcacatcccccagctggtcgatggtgtcaccacgactggtatgccacgcccgccattgcgagccataaaccaatcctaaatcaccgtatttagctgcaaatgactcgtcagtgagaatacgttcgtcaaacttggccatctgttcacgataactggcggcaaattcaggatctttctggctgcgatgaccaaaatcggtcatatccggaccatgataatcggggctagcaacccacttctcaaaggcccattcatcccagatgtgatttttatgctgcaataggaaacgaatgttggtgtcgccacgcaagaaccaaagtaactcgcttttaatgagaccaaagggcacctttttggttgttagtaaaggaaaccctttgctaaggtcaaaccgcatttggtgaccaaaaatactgtacgtgccagtatgcgtgcgatcaggcttgaaatggccttcatctaatactttttgggcaagatcaagatatggctgctctaacattgtcttcttccctccagtgggcgtgtgttcaaacatactgatccagttcggcaaatcggtcgaattttttatcaattgtttggttgatcttgtcaatttgggcttgtaagtcacctagtttgacataatcttcaccgttgacttcggccatagctgccttgactttggcgagtttatcgtccaactcgtcaagctcattttggagtttatcatactctatctgctcagcatatgtcagttttgttttcttctttggcgcggcttttttcggtacagcgtcagtagctgatgtttttggtttggctgccggctgcttggtttgttgctgagccagataatcagagaattcgcctaccgctcggtcaatccgcgcgttgccattgaagatcagcaattgatcagccactttgtccaaaaagtaacggtcatgtgacacggtgatgacggtgcctggaaattgatccagataatcttcgagtacggtcaaggtggcaatatctagatcattggttggctcgtccaaaagcaaaacattaggttgacgcatgagcacctgtaacaaataaagccggcgtttttcgccgcctgacaagcgaccaatcagcgtaccatgcatactgcgcggaaaaagaaattgttccagcatttgggttactgacacgcgttgaccatctgcttgcacgacttcttcgccaacctcctgcaagtaggtgatgatgcgtttgttcggatccaaattggcactcatctgggtgtagtagcccaaatgaacggtctcgcctaattcaatagatccgctgtccaatttttgtttgccagcaataatattcagcaatgttgacttgccagcgccgtttttgccggtaatcccaatgcgagtgcctggttgaaccagccaattaaagtcttttagaatcggctgatcgtcaaactgcaaactggcatgatgcatttcgatgacttttttgcctaagcgggcgctggcgatctgaatgggatccaactgctggtttgcttccggtgccgcatctttggcagcttgcaaggtctgaaagcggttgatgcgcgcttgttgtttcgttgaacgtgcctgggcaccagcatgcatccaagctagttcctgcttgtaaagctgggcctgcttgtgattagccgacttttcggcctccaattgctcagcctttttggcgacataagcctgatagttgccttgatactggaataaacggccgcggtccaattcaaaaatccggttcgtcacgcgatcaagaaaataacgatcatgcgttaccacgaccaaagcgccgcgataattgctgagatacttctcaagccacgcgattgaatcgaaatccaagtggttcgtcggctcgtccaacagcaataagtccggcgattcgatcagcacttgggcaagaccgacacgcttttgctgaccaccggaaagaccgccaacacgcatgctcaaatcatcaatgtgcagctgcgtcaaaattgttttgatatcggtttctgcagaccaggcatcttcttgcgtcatgcgggcatctgcttttgtataagcggcagttttttccggattcataggatccttggtatattcggctagtgcttgttcatattggcgaatcgcttgaaaaaccggtgagtcaccatgataaatggcatccataatcgccaagtcaggatcaagatcgggaatctgagccagatagctgatgcgatattgcttgggtgttttaatttcaccagcatcaactgaatcaagtccggctaatgcgcgaataagcgtggttttcccagcgccattcaccccaattaagccaattcgctcgccttcgttaattaaaaaatcaatctgattgaataattgtttgtcaccatatgccttactcaggccttgcgctgttagcgtctgcatgttgtccctcatttcactcgtatcgttgtccatcttagcaagaagcagcgcacaagaaaaggccgacatcaatgccgacccgtacgtgatcacgattagatccgcggatattcatcatccacggtatgtttttcatcgatcacaatataaagatgaccgtttgctgcaagcttgctactctggtactcgttatcaagcccgcttggatccttttgcttgaatgggaagtagatttgaacgcgctttttgtcttccgcattgaagaccaagtccatcttttcaatatcttgatacttagtggcgcgaccaaacatccccatctccagcgaaccggtgttgatatcgcttgacttgacgtggtcagcttcaggcaaaatctcaaccttaaagctcttgcaaggatgaatctcttgaatctgaccgccgtgaatgcgtccgtaacttgtggttactcgactgatccagacgtccgccagttcatcatgctcaacagtccattcgtcaccgttacgaaaatgaaaaatcaattgctcaaaaacatgttctgccattggaaatcccccttcactgtcatgcagaacgggttggaaacgcactggtggccaactatgctattttaaagccgcccagctgatcaatcgtcctgtttgacgttgttgaatgtgcttacatgctcatcataacacactcacaaacgatcttgagacatttcagttgcgatcggcaacaacttttttagttcatttggcaaagctccagcgacgacacgctgctcgatttgattgagtgctttgcccatcgctggcccgggacggacccccgctttaatcagatctgcaccggtcagcgctaattcttttttactatgaatcggtaaggccgcgtaagcctcagctagctgctgctgatcaaagtcaggcgtcagcagtttttgaacctcgctagccgttgtcacggccgcttcaccagcttggtaaagatcccaagcagtcggattcggcatcacctgcagtagcttgacagtttgcgtgaccaaggtgatcagctcattggattgcttccaggcctttagcatcaccagcggctgtgttcttaaaaggaaaatcaatgccgcccagccgcttgccaaactggtcagctgcgtatcaggcaactgagaaaattgcgttaaggctgtttcatgagccgccattttcggggcgtaggcaaacaagcgagtctcaataaaatcttgcaagccagcacgtcgatcaatcccagtcagcaaccgattaaattctgcggcgactcgttctacagaaatgtgcactaacagtttggcattgtcggcgattgccgctttggtggctggctcaatgccgaaccccaattggctctcgaatcgaactgcccgcatcattcgcaaagcatcctcatgaaaccgttcatgaggattacccactgcccgcagctggtggtgctgcaaatctttcaggccgtcaaacaaatcaatgatcgtgccatcatgccgaacagctaaagcgttgatagtgaaatcccgacgctttaaatcttctgctaaggagcgcacaaaagtcacatgatcaggccggcgaaaatcctgatagcgcgattcggttcggaaagttgtcacttcatagccagtcccgtgatcaagcaccatcactgtgccatgctcgatgccggtatcggctgtccgcttgaaaattcgcttaatttctgccggatacgccgaactggcaatatctacatcgtgaatcggcagccccagtatcgcatcacgaacactgccgccaacaaaataagcttcataaccagcagcttcgattttttttaaaatcggaatcgctgccttaaaatctggctgggtcaaatctagtcgcatttcaaactcctttttccaaaccggcaaccaccattaccacaattaagccgaaatatgacatttctgttagaataagcttaaattcttttttgggaggcggcctatgtcacgcaccacgcgtacttgttgggatcttttaatgattgttcttggttgtgctttatatgggttcgggcttgtttatattaatattgcgaatcacttggctgaaggcggcgtcaccgggattaccctgctaatccgctattggtggcatctcgatccggcatacagcacaattctgctgaatattccgttgctcatcgttggttacaaatttttaggcaaacgcgccctagcttacactgtttttggcaccttgatgctttctgcttggctgtggatctggcaacgggtacctttaaccatcaacctcgatcatgatctttttatctccggggttttagctggactgtttggtggttttggcagcggcttgatttaccgccatggcgggaccaccggcggcacggatgttgttgcccggatagttgaacaacagaccggcgtgccaatgggacgaaccttgttggttttcgatgccgctgtgctaacgatctcgttgacgtatctgaacatcgaactcatgatgtacactctgcttggtgcctacgtgttctcacaaattgttaactttacgctggatggtgcttacgcggcaaagggccttttaatcgtctctgacaaaagccaagaaatcgccactgccattatgaacgaattggaacgtgggacaactttcttacatgctgaaggcgggttcgcccacgatcgcaagcaggtcgtttatgctgtcgtttcgtcaactgaaatcgcccaaacaaaacggctgattgaggccattgatccgcacgccttcatcagcatccttgatgtccatgaggccttgggcgaaggcttcacctaccagaaaaaacgccgccgactactatttggtcattgattcgcaacgattaatccgtctcggcgttgagttcatccaaacgggcctgcatctcgtcgtcagtaggtaccagtttcaaatatcgcactaaagcggctttcaattcggcgcgagcaccagtcgactggaagaaatcaatgatatcgtggagaaagtccggggaatcctgaaagcgattgaacgctaaaaggtaattctcacgggcttttttaatattctccaaccgatcgtagcttttagccatattccaataaatttgtgggtcaacatcaccactacgatcgatttggtcaagaaagtcaacattttcttgatcacgctcttcctgcaccaaaaagttgctccaagcgagcatattaccttgatcttccggatcaatcgccaaggccttttgtaaatacgtctcggctaatttgacattgtcttcactaagcgctaatttgccgcctaaggcatatagcgttgggttcgtatcatcgaccatgacgccggcttgaaccgtgtctaaggccttgtcaggctgattctgggcctcataagcacgagcaagtggcaaatacgcattggcgtaacttggatcactgtcaatcacggcttgaagattggtgatcgctttagccggatcatcaagttgtaaatacaagccacctaattcgaaccggccattgagatccagtgcatcaacaccgacatcttcataagcagccactgcgtcttcatactgccctgtttgcgctaaactggccgccaaccgtgcttcgatgttaaccccagcaagttcagttgtaccggccgctagcagctcgttataagcactaatggcctcggcaaaatgaccccagtcaaaatagaattcgcctaaagcgaaggtcaccaccggctcgtctggcgccaatcgcttcgcctcaagcagtttttgctcactaacctcatataaaccaagtgtttgatagacgtcggcagcgctcaccagactttgaacataggcaggatcacctggctgaatgcgactaagataattcaaggcggcgtctgtatctccgtcagaaactgcaatatcagctaaagccgtcgccagatcgccttggtcaggatatcgccctaggagcccttgataaagccgcttagcctgaccgttgaacccaagcgcatacagttcttcggcaaggttgtattgggtttcgtcgtcatcgtgggccaatacttgggtgaatagctgcttcgccgtttccatctggccagcttcaatggcatcaagcatttcttttgcgtaactcatggctgcctccgttgatttcattttataaaaagcctaaagattgtcgttactgctagtttaacattgcgttttgctgattccgaactgatgagcatcaaaagctctccagcaacacttgactgcgcataccgctattgtcgctcgtcccgcccctggtcgctggcgaatgacgccaaaacgcgcaaaaaccgagtccagatagactcggtttttggttgtttcatcattgcctcaggtgaaccgcttatttaacggcgtccttgagtgctttaccaggcttgaatgctggtaccttggatgctgggatcttgatctcggcaccggtttgtgggttgcggcccttacgagcggcacgctcacgcacttcgaagttaccaaagccgatcaactgaaccttgtcaccctttgaaagggagtcttggatagaaccgaatactgcatcaacagctgcggttgcatccttcttggtcaaaccagttgcggttgcaacactttcgatcaattctgctttgtttgccatgaacatttcacctccatattgattagatgcgttaacacctaaacatgcccattcctgacctctcaggaatgaagaaacaatgataatatgtatcaccatttcaggtttaaacatagcatagcaagcccgttgtgacaaggtttttgccaaactttttgctgtctgatcaaggatcggttatcgaaaatcacgatttttgacatatttttttaaatgaaaagacaatattcagccatcgccgaactacttgcgtttacgtgcgatgatgtgaatcggtgtaccggaaaaatcaaaggcctgtcgcaattggttaatcaggaatcgctcgtacgagaagtgcagcaggtcgggatcattaacaaaaaccacgaaagttggcggtttgacagcaacttgggtcatgtaataaatccgcaagcgttttccgttaactgtcggtgtcggtgtaacagtaatggcatccattaagacatcatttaggacactgctttgaattcgccgagtttgattttctgaaactgccacaatcatggctggcaagctctgtaaacgctgtttcgtcttggcagaaacaaaaataatcggcgcataatccagatattggaattcctgacgaatcaggttttcaaaatccttcatcgtgtgattatctttctcaactgtatcccacttgttgacgacgatgatgatgccacgaccggcctcgtgggcataaccggcgacctttttatcctgttcgcggataccttcttcggcgttgatgacaaacaaaacaacatccgaacgatcaatcgctcgtaatgcacgcatgaccgcgtatttttcggtgttctcgtaaaccttaccacgtttacgaatcccagccgtgtcaatcatcgtgaaggtttcgtcaactgcttcgaacttcgtatcaatcgcatcgcgggtcgtgccttcgattggactcacgatgacccgattttcaccaagaatggcgttaactaaagacgatttaccgacatttggccgaccaatcaggctgaacttaatcgaatcgtcttcaactgacttatcttcggatggaaatgctgctaaaacagcatccaaaacatcaccaaggccaatcccatgggtcccagaaagtggatagggttcgccaaaacctaatgaataaaaatcgtaaatatcttggcgacgttcagggttatcaaccttattgactgccagtacgaccggctttttagcccgataaagaatctgggctacccgttcatctgcatcagttaccccgctttcaatatcagcgagaaaaaggatgacatcggcttcatcgatggcaatttcagcttgatccttaatttgcgccaaaaaaggttcatcgcctaagtcgatcccaccggtgtcaatgacagcaaattctttaccaagccattcactcttgccatagatgcgatcacgcgtgaccccgggcgtatcttccacaatcgaaacccgctcaccgagaatacggttaaaaatggttgacttgcccacattcggacggccaacgattgctaatgttggtaagaccataaaacggcctcctttctgtgacggcgtcatgggatttgtttcccataaaaaaagttgagccaaggctcaactttttaggttcaagatgactacttgttatcatcctgatcatcattgcccttagcagcatctttcaaggcatcgcctaagatgtcgccaagtgagaagcctgaatcatcttgctgatattcagcaggaatcgacgtggattgatgacgatcattgccacgacgaggacgtgaagaacgacgacgatcaccacggtcgctattgtcacgactgctgttgccgccttcatgagattcttcttcagagcctgctggacgttcctgcaaagccttgatggacaaagcaagacgatgtgcatcagggtcaacggaaagaaccttgacctgcacttcttggccttccttaaggacatccgctggggttgctacgtgttcgtgagagatctgggaaatatgaaccaaaccttcaacaccagggaagacttcaacaaaggcaccaaaagtggtcaaacgtttaactgtaccagtcaaaacagagccggccggcgccttttcttcaatgtcgtcccaaggttgtggcaacgttgctttgatggacaaggaaatgcgattgcgatcaggatcaacgttcagaaccttaaccttgatttcttgaccaaccttcagaacatcgcttggcttgtcaacatgatcaaacgaaatctctgaaacgtgaaccaaaccatcaacgccgccaagatcaacaaaggcgccaaagttggtcaaacgagcaactttaccttcaacggtgtcgccaggttgaatcttcgcaaagatttccttgcgtgcttcagccttgctggcttcaacaatcgcacgatgtgaaagaatcagacgattttcacttggttcgatttcaatgatcttgaattcaagttccttacccttgtattggctaagatcttcaacaaaatgatcttcaaccatggatgcaggaacgaagccacgtacaccggcattaacaaccaatccgcctttaacgacgctggtgaccggagcggtgatggtttcacctgcttcatacttagcttggatttctttccaaaccttttgcgcttccaaacggcgcttggacagcaggaactgcccattttctttatctttgccaaccgttgaaagcacaactaaatcaagcttgtcgccgacttttgcaacatcgtgaatgtcatcgattggctgagttgataactccttgatcgggaccacgccttcgacgcctgttccttcgatcccaacgatcaattgtttatcttcaacggcaagaacgtctgccttgacggtatcaccaatctttactgtggtgacactcttaagggcgtccgccattgtttcggtgttctcattaacgttattatcactcatgccaaaaaatcctcctatgcagctgtatactggatctattgtacttgaaaacgaaccaaattaccacctattattttaagcccttgactatttcgtctttacttggcctatcagggataaaattcgttccaccacttcatcgatggtcattgatgtcgtatcaattctaatcgcgtcagaagcctgacgtagcggggaaacggcccgatgagagtccttgcgatcgcgttcggcaatctcctgttcgagggtagctagtggtgtctcaatgcctttttgaatattctctttgtagcgtctttttgcccgttcagcaactgatgccaccatataaatcttcacttcggcgttaggtaaaacggtggtgccaatgtcgcgaccatccatgacaatattgctagatgctgcgatatcccgctggcgtttcactagttcagtgcgtaccttaggcaacgctgacacttgcgaaacattgttggtcacgtctggttcgcgaatggctaaggtcacatcttcatcattcattaagacgcgctgttcagggtcacccggttcaaaccgaatcgtcatgttggcgagatgctgcatgatagccgcctcatcgccaaagcccagctggtctttaatggccatgtaggtcacggtgcgatacatcgcgccagtgtcacaatagataaaccctaattccttggcgactcgtttcgcaatggtacttttcccggcactggccgggccgtcgatcgcaatttgcatactttcctccacaacacacgaccctgctcatgccaatacgcatgcagaacagggtcgtgtcatgattatttcactttcaaaaccgtgcccggtgcaatgctggaacccgcactcataccgttcatctggagcaactcatctaaggtcattccatgattgacagcgattcgataaaggttatcgcctgcttgcacggtatatgaactgccagccgtgctggcacttgcttgctcgctaggctgcgctgatgcactggtctgttcttcttgttgggaagtaacgcttggtgcttgactaggctgagtcgacgctgcctgtgacgaggccactgaagtcttcgaggctttggaagccttcgatgatttctttgattttgaaactttactgctctttttagtactttggatcacaacgcgatcattagaaaggttagcgccattgcggctttgatcaccagaaattttgacataaataattggtgccaaaaccacaagaattaacaagatcgctaaaatccaggtcaattttgaacttccttgcctttttttcttggtggcaacgcggctcaaattaccttgatcatcacgatcatcgtcaaacagcgtttcccaaggtttacttggatcctcaccattggtgcgcttgtgatcctcattgtcatgttggtgttcatctttttccgccatcacgatccccctcactactgcgcttattgtatcatattgaccagcgtcagggcgtcggttatctaaagatttggtgaaatactgcctgccaagaagctaattttggttgttcttgtggcacttcaggctgtagttggcgcaatatcgtagtggtgatctcaccacagcacaaagccgtatgcggttcaattggcgaatcaaaatgttgcagcagaacagcacgacggcattctgattcattaacaaaagccgccatcgctgcgaaactagcctgtttctcagttagtctgtgctgtaattgctgctgcgtagcctctaccgaaaagccagcgtctacatacgcttcgatcaggttgatctgcggatcgtcaaaagtgcgatacgcctcaggatgcgcatagatgagccgaatcaatgccgcatctggcaacatccccgccaaaatagcgccgtgctgaacatcatgatcggtcaccaaaagcgccgctagactctgcttgccatcacggccggctcgtccgattgcctgataataagcttcaagcgattccggcacataggtatgcacgacgaaccgtacatttgccttatcgatccccatgccaaacgcactcgtcgcacagataatctgcaactgatccgattgaaactgtcgctggattagatcgcgttggtgccgatccaacccagcatgataaaaggccgcagcatggccggctttttgcaatcgtatcgctaacgtctcacacgcggctcgggtagcactataaatgatcgttggccccaccacctcgtgcaataactgatccagtcttaaagccttttccttatctgttaagccggtctcaacgccaaggaaaatatttggtcgatcgactgacccagccaaaattgctggcgattgcatgcttagatgttggacaatgtcacggcgaacgggttccggtgcggttgcggttaaggcaagaatcgcatctgcttgcaattgttggcgaacttgtcccagctgcaaataagcaggtcgaaaatctggcccccactgtgagatacaatgcgcttcatctaccacaaataagcctagggccagtcgtttgagcgccatgagcacatcaacgcgttgtaaaatttctggtgagacaaaaatatagtggtaacttgccaatcgtttgagaatttgggtaaaagcaaccggtggcatttgcgctgacaaggcaatgacccgtttttctccagctgcttgcaaacgaccaacttgatcattcatcaaggcaatgagcggttcaacaattaaacttggcttgttactgatcaaagtcggcaattgataacagagtgatttcccgctgccagtaggtaaaattcccagcgtgtcatgtccatccaacaccgattggatcaaagccttttgtccaggtcgaaattcttgaaagccaaaatgttgttgaagttgtgcttcaagttgtgacacgcggccacctcccttgaaaacttagaatctggaacagtcgaatctgaaaaaaagtacttccaggaatggctgccaacaatgcctgatgatcgtagatttgcgtcacccgatcaagtgcacggtgaattttaagcggcaccaaatgctcaatcggcaacgtttcacccataattgccgcgagcaacagatgttcattaatcgtgctttgcttacggtggctgcgattagcaattgttggcaacgccatgccagcgcgtgcttgcgccaaggtctgctgcgccggtcgcgaaacgaaatcgcggggtccgccccacaacgccgtccacatactcctagtattagcgagttgctgaaccagtgccgctagcgcatcaagtcgttcaaagtgagcctccaatgttgctggcatcagttgtccggcgtagtcatggccaatcatgttagccgctaacgtgtcagctaattcagtcggcagtctttgaaaaaggctgcttaatgttataacggcagctcgatgatcgacctgctgataccactgcttcacaacttgctgtgtcgcccaattaacacttattggttgataagcacggttcgcataactcgcctcagaaagcacttgcacgcctaagaagaaccgcggtgcgaacaccggtaagttcatccacggctgataatgtgtcggaaacggtaactgggtaactgctgcttgcttgagatgctgccctttttccgttaaaatcaagccggtttcagtttcacgcagcattctttgcactttcaacgtcgtgatggccgctgaaaaagcttcttttgacagacttggataaagatgcaaccattgcagttgttggtgaatcaaggcggcgtaaaggattgaaatggtctgcttaccagttaagagtccaaaaacagcccgctcacgccgcggctgctcactgaaaaattgaatcacaaaatcggtcagcaaagcttgtcacctcatttctcaacattgctgtctaagtgttatgtatcgtataaaggagtttgaatatggctttatatggcagagtagaacgtccagagtgtattgcttgcggcttgtgtcagatgttggcacctgccctttttgattacgatcaagctggcattgcttattataaaccagatcgcaacaccggcactgagcctttaaatgatcaggccacgatcgactttcgattggcctaccaacgctgcccgacccacgctatcaaacgtagcgatcaaccgttcaacgcgcgcccgttttccgagacggggaaagcttaactgctatagtttcagattacgcgaaccaataggaagattgacgtgattcgtcgcaagacaatcgattttacgctaaagaaaaacatccgtcgcttaacaaagctgacggatgttttttggggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgcggctttgaggccttgcaccctaacgggttttacacggcccatgtgcgcgtcctcaacggggttgaaatgccgacagtcattgacttgcacaagcaacgatggcgctgtcataactgttaccacacagtcagtgcccctgtagtaagcgagtaaaggatggcattgaatacgtcataaagatcataacgacgctgtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctcaggaatcagcttacatccaaatttgactgctattctggcgagaaactaaattgtctacaaacgtctcgaagccaccatattttgctggtgtgccttttgatccaatgataaataccttacgtctctctgtcacaacagattcccccaaccttactcaatctaagtattctgctaaaaaagttaaaaaatagtttaccaaaatttgtagcaagctctttagtgttaactgctcaattacttaaccacaaaccatcacattcaaaaacaggctattaccgcacatcattactttgatacccatagccatagccataaccatagccataaccgcgatcgcccttcgacgcgcgcactcgttcgacagagccaaggatttttgccttcgccagctttaagacctcaacagttcgtttcaaatcacctttcaaggttttccccatatttgtaacgacaacaaccccatcagtctttggaactaatacttgcacgtctgatactgccaaaaccggaggcgcgtctaagacaacaatgtcataattcgttcgactccattccaataagttggccatacgttttgaatttaaaagctctgaaggatttggtggcactggaccagaggtaataatatcaagattgtcgacaaatgttttttctgcaacgtctgatggttttgttttcccggttaaaacggttgtaactccttcgagattgagtgttctaaaagtagcatgaactgtcggtctgcgtaaatccgcatcaatcagtaaaacttttttcccagcttgagcccaagtcacagccacatttgccgaaacaattgacttgccttcagacatagtcgaagaagtgaacattatgacttcacattgatctaatgctgcaccagcaaactcaatattcgttctcactgtccgaaactgttcagcaacaacatgtttgggctctgcaaaagcaaccaacataaccccgtttttctgtgtttcattatcttcttgattgcgatgcgtgaatttgttaaaaattttattcaagctcatttctattttctccttcaaatccggcggcgactgcgctgaggcaaatcccgcatattgaattcttcaaaagattcatcgtctttagactcctcattttccgacctagccttcgcaattgcttgatccatgtctttcatgcgcttaacataatttacaataccaagattaactaagcccagatcatcggtaataaagtcaaggtctttaatggtttggtctgtcagctcccgaatcaacccccagatgaatgcaactagtatgccaaaaaataacccaaggatagcaattagtggtaacttcggtgaaaccggtgacgggttagatgaagcctccgaaacaacagagacgttagaaatgctcattatttgggcaatcttttgtttaaataccttggcaacttcatttgcaatatcacgcgcccgagttggatcagtatccttgacattaaccgtaaacacttgagaattttgttgggttgataccgaaaccattttggctagatcatccgctgttaagtttgtatattttgctggttttagtttgtattgagctggtttggctttttccacaacatactgttcgcgaacgccagtcgtcgcattataccgcgtgccataaactgctttttcagctttcttggttatcacgcgccgcggacttgtcagatcactagcaactgcctgtaatacaacagggcgcgtgataatatctttgtaggtattaatgatctgcacatcagcttgttgtgcgttcaattgcatattcggatcattatcctgcttgcggttgaccaacagcgaagtgtcagcttcatattttggtacaataaaagtcttggcaccgaaataagccgcaaccataaatagaatgccaaggataaccattgcaataaagctgcgtttaaacacactccacagccgtgaaaggtctatttgctcgttcattaactctttccccacctaatcccttgatttgttggaactaactaaaatacggactgcaagcagcgcagcccgcaactaaaaaagaagtttcaataatacttctccaaagcataataccctagcttgtgtaaacaagtctacccatgagcaactaattaacacgttctaatgcttctattgccggtgttttaagtcgaaagagtccccctttgacgttgttgttaacctcgaaagttgttttgttacagtctctttacaattccgcaaaagcccgtcagaatgaccctaacttgtaaccagactaacctgatttttagtttaaaatataagcaatgcaacttttgggggttcactaaactatgaaaaaaaacaagctacgtctacgtgactggctattaagtatcgcgttgggattggcaattgctggtgttgcggggtttttctacgtcaagcattatcagtctgagcaggcgattgcggttaaccaatcgacgcgtcagcgcattcagaaggattctaaggcgaaggtgaagaaggaaaaggtgctgaatcagtatcggctttatggcttaactgacagcgagattaatgcggccaaaactttgccggtgtcggcgattggcgattcgattatgctggggagttcggcatatttgaaggtgctttttccggagatgtcgattgatgctgaggtcggccggcaggtgcaggcagcacctgcgattattagtcagctgaaggcaagtggtaagttggctaacacggttgtgatcagtttggggacgaacggaccgatgacagaggccgacattaacgggattctggatcagcttgggactgagcgccaggtcttctgggtgaccgcgtatgctcccggaaaggcgtggattgatccggttaacaagttgattcatgcggcagcgaaaacgcatgctaatctgcatgtggtggattggtattatctggcaggcggcaatgacgactggtttgctgatgacggtgtccatccgaacgacgctggccggccgcattactacacgttgattgctaaggatgtcatgcagacattgaaaaagtaacaatgaaaagaccatcattacctaggattagcatcttgcttaaaaaagattcagggtgtatcccttccattaaaaaagcatcgagacaattgtcttgatgcttttttgtatttaaccaatatttggccaaaatcaggtgcattggaagcctaacctttgcgacaacttttgaccacagcaatcaggcctgcgtacccttctgccagatcgaaaagcttcagcgaaacctttcctgccagtaagctttttttctataggagcctctttcaatagccttatcgcctacttatccaaatccacaaaccgtgtcaaaatcatcatcacaacgccaccgacggccatcgagatggcttcgccaagcgcgatagtcgcataagttggccagaatgggacttttgtgaggatggtcagttcgccggcaatggtgaacatggataaggcaaaaaggatacccatgatagtgaatttagcccattttggctggacgagtttggctaaccagcggctgatgatgatgaagacgagcgtgccgagggtgccgattgggacatcgaggagtgcggttggcgaggttaaattggccaaaaaaacacccagcgtgacggcccagacataacggcggttgaagagtgccgtatagttgagcatctcggagaaccgaacttgtacgaccccgaagctgagtggactgagcatgagggtcatcacgacgtaaatggacgtgatcatggcggttttggcgagactgacgattgaacgatgggtggttgaagttgtttgcatatttgttctcctttgtggctatgccagtagtaacgacgatcaaaggaaagtaagtatcgtcgtggaaggattgccttccgtttcagttttggtgttgcagtgcattaagtttacttttcgagccagccgccgtcaatgggaatcacggttccatgaatataatcagcagcatcgctggccagaaataaagataattgcgcgacttcctcgggcttggcccagcgtttggctggggtttcgcgcgctacccaggcggccattttcccgtcgccggcaaaatcagcggcgttcatgggcgtgttgatagcgcctggtgcgagagcgttggcgcgaatgcccttggcggcgtaatcgaggtctaattgcttggtgaggccgatgacggcgtgcttagcagcagtatacgccacgccgccaccaccaccgactaaaccagcaatggaactcatattgatgaaaataccgtgaccacgagccagcatccccggcagcagcgccttgatcattaagaactgactggtgagatcgacatcgagaatgtgttgccatgccgagagcgccgtatcggtcacagtttgataaccatccaacacgcccgccgtattgcagacaatatctggctggtattgagccgcaatcgttgctgctgtggcaggatcgctcacatcggcctgaatggcgtctgtgaggttgctaattggttggaggtcaattcctaccacagtggcaccagctgcctgaaaagccgccgcctgcgccgcaccgatgccagaagccgcgccggtgatgatgacggtcttgtcggtgaagtcgaaatgcgtcatgcgttcacaagctgccaatcttcagccaaaatgtcacagtcagtcggtgaccagagactgaaagcttcgtcggcagttttgatcaaaaaatacggattcaaagtgtcgccttcgaatttgccttcgggaactagttgcacatacaactcagtaccttcccagccggtgcgaacggccttcttgccggctttaagggacggtaaaattgcttcaaatgtcatgtcgagcattctccttcttttaaaatgcgttctccagatggcggtcgggtattgtgaagaaagcctgttagccgaaccaatacttgatcaactattcagtgccactttgtcaaaccaagctaaccgtgccagttcgcgctcattgtctaaaatcagtgcatttagtatacgcgttttaccagctgactgacaacgggttgcgccatccttttaaggtcattctgacatttttgatatcaaaaaagaacagcctcaagtgacagactgttctaaaaaggtggtacttgcaggttaatcacctgcatgagtacctcggaaacacgcgcccgttctttctctggtaagtgggttaagtatttcaccaccgctaatgtgctaatatcgctcatttcgggagcaatgaagaagtcgcctacctgcatatttaaagcccgcgcagtgtcggtcaatttttttatgctgatattgttgacgtctccacgctccattcgcgaaatcagactgatcgagacgccggatcgctccgccaacttctcaatcgtcaggttcaaactgcggcgctgttggtgcaccaatttcccgatattgtctaacatggtttcccccacctttaatgtgcggcgttatgctttaacattagatgaaacgccgggctatcaaaagattttataatattatttaataatctaaagatggcctattctcacagaacataaccgcactgatcccccacatcaactcaccaattcttgctctataactattgtaaacgctcgcaatgaggaactgccaaaaatcagcttaattaattaaaaaatacacaataaaaaaacaatgccaatttattcagcattgttatttactttctgcggttgctggcacaaaggcccataagctgccacgtgtgaactcttcgccatctgaggtgtccaattcactgatactattatttggcggaatgcgcatcgcatcacgcgcagaatcgagatcggcaccgaggtatgtgcttaataacagcatgccgattaaaccgtgtgccacaacgagcactttgccgtctggatgggcatcataaatccgattgattgcccgccgtccacgttttaacgcatgggcaaatgattctgcaccgatacgctggttatcaaacgccgtcaaatgatgataataatgatcaatctcaggatcatcctggacagaagtgagcggctgaccatcccatttgcctaaatctacctcgcgcaaatcacgatccgtcacaatcggcggttgaacgactcggctttgggccacaattaattcagccgttgtttgggcccgcggcatcggactggcatagatgcccgcaaaaccagtcgtcgccaaaaagcgtccaactgcgatcgcaccatcgcggccactcgctgtcaacggcgtatcggttcgtccaccattaaatcgccgcgccaaattcgtttccgtctgtccatgccgcacaaagtaaaacttggtcatctcctgcacgctccttataaacacgttcatcaggccagcaaccggtccgacgaacgttctgtctttgaccatagtgtagcagaagcgcaccaaattagcggcaataatcagaaaagttcagcccgacttaaccaaaactgtaacgattatgcctattccgtcagcattttgacgacatcaacgacaagaatgtgcttactcgtctagaaatgtgtgggtaagacatttgtacgcaaaaagccgaacatgcaagtttcacatgttcgacattcttacgcgatcattgaagcacagcgttcagtaggcgtttactgggcagctttaaccccttgatgatccgcttcggcttcagctttataagccgccacttcgtcatcagcggcaaaaatgtaatgttcaggataaacctcaaccattttacgtttcttgttgtcgccttcgaccttgctggcgtcatacggcagcggcacgcgtctgcgctcaacatctggatcaggtaccggaatcgctgagagtaaactcttggtgtaagggtgtaacggatgactataaacttcatccgccgttgccaattcaaccaaccgtccataatgcataacagcgatacgatctgagatatacttgaccatcgataaatcatgtgcaatgaacaggtacgtcaaaccttggcgatcctgaatgtccttcagcaggttgacgacctgcgcctgaatggaaacgtccagcgcgctgatcggttcatcggcgataatgaacttaggctgtacggccaatgcacgggcaatcccgatccgctggcgctgaccaccggagaactcatggggatagcgagtcgcgtgatcagcgtttaaaccgacttcttccaacaactgctcaacttgatgatcgcgatcagcgttgttttttgccaaatgatgaatatcaatgccttccgcgatgatgtctttgactttcattcgcggatttaaggacgcataaggatcctgaaaaatcatttgcgtggctcggcggaaagccagcatctgtttggagccatttttcagtttggcaatgtcgttgccattgtacaaaatctcgccgctggttgggtcgtacaagcgaatgatcgcccggccagtggtggttttaccagaaccagattcaccaaccaagcccaatgtttcgccttcataaatatcaaacgagatatcctgaatggctttcacttgatcttttttcccggcattgaaggtttgaaccaagtgcttgacggacacaagaacctttttgtcttttttgtcgaccacgttagttcaccaccttttcatcttgatgtttacttgcccataaggcatgtcgccgcgcaatttctggcggtaattccactttcggtgcgcctggtgctaatagccaagttgccgccgaatgggtcggtgagatcttgaagaatggcggttcctgctcgaggtcaatcgccatcgcgtatggattccgcggtgcgaacgcgtcaccttttggcggatcaagcaagtccggtggtgtcccaggaatggcgtacagtcgatcgctcttggtttcaagtgttggcatagcttcaagcaacccccacgtatacggatgctgggcattgtaaaagatttcgtcaaccgtaccatactcaacaatcttgccagcatacataaccgcaacacgatcggcaatcccagcaactacgccaaggtcatgggtgatgaaaatgattgaggtgtcgatcttcgactgaatttctttcaacagatgaatgatttgtgcctgaatcgtcacgtccaaagcggttgttggttcatcagccagcagaatctgggggtgattgatgatcgcaatggcaatgacaatccgctgacgctgcccaccagagaattgatgtggatagtcctttaaacgaccgccggcatccttgatgccaaccaaatccaacacgcgttcagcttccttgagcgcatcggctttactgattttactatgcaacagcaacggctctgccacttgtttcccaatggtcatagttggatccagtgaggtcatcgggtcttggaaaatcatggcgacatcattgccacgcatagcattaagctgtttctcggattttttgagaatgtcctcgccgttaaacagcacttcgccatgcgtaattttcgcattcggggctaacaagcccatcactgttcgcacggtaacggatttaccagaaccagactcaccaacaatggccagtgtctcacctttgttaaggtcaaaattgacattgcggatggcgtggacagggccggcataggtggcaaagtcgatctgtaaatcttttacttctagaattttactcattttgccacctcctaatgttcactgcgcggatcaaaggcatcgcgcaaaccatcagccagcaagttaaaggccagcatcagaatgacaatcacgatcgccggatataacagctgatatggcagcacttgcagattcttttgaccatctgacagcaaggtcccaagactagcagtcggtgctggcagcccgatcccgatataactcaggaaggcttcaaagaagatcgctgtcggaatggtgaacatcgtttgaatgataatcgttgaactcagattagggatcagatgtttaaaggcaattttgatgctcgactcgcctaacgttctagcagctaagacgaattcctgatcttttaactgcaacgtctgcgcacgaatgagtcgagccatggtaacccacccagtgaaggcaatcgccaagataatggaggtcaaaccaggacggaagaccagcagcatcagaatgacaacaaccaagttaggaatactggagatgatttcaataactcgctgcatcaacgtatcggtcatgcccccgcgccaaccggagatgatgccgtagaaaaccccaatggtcaaatcgaagaaggttgcgacaatcccgatgaacagtgaaactcgggtgccgaccatgattcgagacaacaggtcacggccaaggtaatcggtacccagcaagaagtaaacatttttacccatgccagcgtatttgttttgaccgttcatgtagccgttcaaacctggcaaatcgatacctggccatttgggcggcaggttcgcatagttcaggctttgtttgtttggattagaaggtgataaccagatagaaatgatagaaatgaacgcgatgaaaacgagcacccacagggaaattactgcggccttgtttttcttcaatcgccgaatcgcatcttgcgtgaacgtcagcgcaggcgtggcaatacgttcctgttcagccgcatccactttaacatgcttgaatgcatctggacttaatttacttgttgccattagtttgcctccccgctcaatcggattcgtggatcaatgaagccgtaaagaatatcgacaacaaggatcacaaccgtcagcatggcactgtagagaatggtcagtcccatgataactgggtaatcgttggtcgtaattgacttaacgaattgttccccaatcccagggatcgcaaagatgttctcgacaaccagtgagccgaccattaagtcaacagccattggtccgatgatggtcacaatcggaatcattgagttacgcagcgcatgcttggcaacaacttgccagcgtgattcacctttggaacgtgccagttcgatgtaatcagaactaagcacatcgaccatttcagttcgcatgaatcgggccgtttgggcaagcggtgcgatcgccaaggcaactgtcggcaaaatgctataagagaagccgccccaaagtgctactggaaaggcgccagttttgaaagcaaaaagctgcagcagtgcggcgaacacgaagttaggaattgagcgaccgagaatggcaaaaatggtagcagtcgcgtcaacccatgtgttcttgcggatcgcggcaatggcaccaagcaagatcccggcaagtgtgccgacgaccatcgcctgtgcgccaatttgtagagatggtccaatccgagaagcgattaagtttgacacggtttggccaggaaattgataggacattccaaaatcgccatgtgagattccgacaatatacgttaggtattgcatccaaactggcttatccaatccatactgtttcttcaaaatcagcagttgatctgctggaattttggggttgttaaacggcgtccccggcaacaacttcatcaggaagaaggtagcgctggcaacaataaacagtgtcaggagcaggaagccgatccgttttaaaatatatttgaccatgattcactcctgtttatgggcacacgccctgataagcaaacagcgttgtccgccgcagaacacgagacaacgccgtttgtgagaactacttatttgaaactagcaggcagttattcgtaactgctcacgttttggtttaaaaacgcggttgttagaccataatccgactaagttctacttaactttcgtattcacaaagttgtaggaattggttgggttgtaattcaaaccggtaatggtcttacgctgcaaggttgtttgtacccgttgatacagcggtacaacgccttgttccttcgtcaacagttcttgggccttgagtaaggtgttccaacgagcggttgcgttggtcgcatcggtcgtcttggactgcttgatcaaagcatcgtattcagcatttgaccacttgccatcgttgtaactgttatcggaggtgaacagatccaagaaggaaatagcatctgggaaatcagcactccaagcggagataaccatatcgaactgaccattttgggaacgagatagacgcgtcttgaatggtactgtagcgatggtaactttcagacctggcaggttctgttgcaaggtgctctggaagtattcggcagaacgcttagcattggtcgtatcgtctgtcagcagttccaaagttggtgcggactgaccgacttctttcaaaccttctgtccacaactctttagccttggctggatcgtacttaacagcggaggattcagctttagatgccgtcttggagaagtcttgaccgttcttttcgaacaatccttcaggggtcacattgttggccgcgatggaagcatcattcagaaccttcttaatgtatgcctcgcgatcaatcgacatggaaattgcctgacgaatcttggtgttcttaaagattggatccttcttctcgttcaattcaagatagaaggtcgcactttgcttgaggcctttgaaatcagacatggattttgcttgagccgcttgttcaccttgcaaagctgcgatatcaagtttcttcgactgatacaagttcatcgcggtttgcgaatccttaaccacttgaccattaagggtatcgatgtgaacgttcttagcattccagtaagtagtgttcttagtttctttccaagtgttgccagtgccgttccagttcttcaactggtaaggaccattggacaagatgtacttggaagtagttccgaatttcttaccagatttttcaacgaatttctcattttgtgggaagaatgctgggttaaccaacatggtcttgaaataaggaatcgcgtggtccaaggtgactttcaaagtcgtcttgttgacggcggtaaccccaagcgtgctggccgcttttttaccggctgtgatgtcatcagcgtttttaacgcctgaatataggtaggcgtattgcgacttggtcttcggttcaaccgtccgccgccaagcaaacacaaaatcttgggctgtgactggatcaccgttactccatttagcattacgtaacttgaaggtataggtcttcccgccatcagtaacagttggttgactcttggccatggcattttccaatttgctgccattgtaccgatacaagccatccatggtatcaatcaatgcctgaccagaaatagcatcggtggtcgttgatggatccatcgtggagatcacatcactctccatccgtgtaatcgaagtacctttactgctgctagaagaattagaaccacaggctgctaacacccctgcaagcgcgagcgcagagcccgcaaccattgtctttctaaatttcatcctgttccctcctaaaatgattgaacttaccttacattagaaatccattaatgtaaataagcgaatcctcaatttcgcctaaaaaaactaattctttgatcttacttttgtcacatttatgctaccgatctcaaattaaaaattgtatatcccgtaaatattctctagatggattccttatttatgggcagtaagaagcccacctaacctaataatcgacacgcgtttttgttttcattttgagtgatgatgctaagaatagcttatattaaataacactggcaagaatcggaaaatcgtcaaatagtggactaatattcggcttttgctcatagaattttcgcttttgtcagacaagctgccatcttatacaaataaagctgagcaaatgctcagttttatttaaccgctttcatatgtttcacttggatttattgaactgaagccttcgttcgccgactgcgaattgttcgaaaaatgacaattattaatccaaccacggaaacaatggttgctaaccagaaaacaaaggccaatgcatgcaggaatggtgcccccgactgcggcgaaattcgcgtgacgcctggcagctgggcaaaaagtaacgtagcaccaaagctgatgccgatggtcattccgatggttcgcgccaacgagttcagcgatccggccacaccagagacgctagcatcaaccgctcccatcgttaaggcattgtttggcgaaaggaacaacgccatgcccgctccattgagcacaatcggccagatgatgggtgccatcgacaattttgctggataaaaggcgtagccgacttgtgacacaatcaggactaacaagcccagaatcgtgagatagtaacgattccaatgatcggcaagccagccggcaaacggtgtaatcatcaacatgacaacactttgcagcatcatcaacaggccgctttcaaaggcagaaatgccgccgtaactttgcaaatagaatggcaacaaaatgttggaaacggagttaaccaacatgacgatcagcagcacgctgacggatattaaataatcgggattatgcatcaatgctggcgcaatccacggtgacttggcacgttgatcttggatgaaagccaacaacgtcaaaatcgccccaccagcaaggatgagaaatcccaacagatgctgcgtcggctgctgaagccaatagccactggcaaaggtcaagatcatcccgccagtaaacagattttgccctgtccaattggcgttaccccagacttgcttaatctccccagttgctggccggcgcagtggcaaaagtcgcatccccgcaaacacgatcagcagaccaactgggacattgaaaaggtaaatccatcgccagcttgcccaagtaatcaaaatgccaccaaatgccgggccggaaatcgacccgacggaaacaaacattgagatcaccgctaacgcctctgcccgattagcatcaggaaagtattggctaacgatgcccatcgaattcgccatgatcatcgccgacccaacggcttgaatgacgcgaccggcaaggatggttagataagtcggcgcgatcccagttaacaatgaaccaacaatgaataccatttcgccgatcaaaaagacgagattttttgagaccaaatcaccgatatggccaaacatgaccagtaaaacagaggtcgtaatgaggccgatggacacaatccaagtcgcggcactgctggaaatcatgagatccgccgaaattttcggcatggccaagttcgtactcgacccagacagagccgttaataacgacatcatccccaaaacaattaaaattttaattcgttgcgcgcgtggcatggtcatcaccatcacaccctttcggactgtattttaggctaattggtcaggagtcacaattattctaccttggtgtgacggggtttgattgaagtggttaagtgacttgttacctgctggtgaggttgatcgataattttctcctaggatttatgatttgttggattccaactaatctgggaaaagacattaggctaaagttctatgccgtgccaaactccgcaatctacggccagaaggggcttgcgacgcggagctagagcggagacggcgcttcgagcccgcaaaacccgcggtctcgaagtcgcctaacaacatcagctccaaaacccggtcgctgtgttgtttgcacggctgagccccatctggcctacgattgctccgccttggcactggtgtctctaaatgccaacgggttatctatgacaaactgtgaatgatgtcccaacctgcatgttacgtaatgatgcggcaaaaagacacgtttttggataacaaaaaaaccacacagattattcactgtgtggtcagcttgctttcgaaattatttttgagcacggcctttgtaagttcctgtgtcggtcgtgacgataatagtttcgccatctttgacgaaatcaggcacggtaacaactaagccagtttccaatgttgctggcttgccgccgcccgccacagtgccgcctttgacagccggctgggtttcggtgactttaagttcaacgctacctggcagttccaagccgatgacttcatcgccgtagaattcaatttcaaccggaacgttgggcagcatgaacttcaattcatgctcaatgcttgaagttggcaattcatattgctcgtagctgtcgctgtccatgaagtaggcagtgtcatcttgcgtgtagagatatgtcgcctttttacgatccataatcgcaatttcgactttttcgcttggccgcatggtggtggtaacgttagcgccggaacgaatgtcgtagagcttcatttgcatgacggtgttgcccttgccaggcttgtggtggttggactccagtaccttgataagcttgccatccttaacaaagaccatcccagatttcaaatcaattgcttcagtcatattttgtgttctccttcattcgcattacgccgcaacggcgcgtttcgtgtttagtataccatagtgaacgatagcgctatctttttaatcaaagacaaaagcacaagccgagacataatttcatctagaccttgtgatctgtcagatatcgaataaattggaaaaacaatctggactaaaaaagggcttgccgtgccaaactccgcaatctccggccagctggagctgatgttgtttgcacggctgagccccatctggcctacgattgctccgccttagcaatagggtcttcaaatatcagaagggggtgtatcacaaaacgcttgtttggtagacatagtgccaaattaaaaagcccgtttcttctccatcgagtcaccacaacagaatagagaaaaacggacttccgaaacacttgacatgatattgacaactcaccaagaacaactgctcactaataagctagacctgagaaacttcggcaatcacttgtcaaagtcagatcacagatttctgaaacatctcattttgtcatcacattgacagaagatgtgcctatcttggctccaatcctacgacagaatgcagagagctggcggagcggggatggggctcagccgtgaaattggtcttggtgcgtggttttctccgcctagaccaaggccgatcttcaagaccgcggttttggcgggcttgaagtcgtgcccacagctctagcttcgcggtcgccatcccccatccccgagtagccagctcggatcatcaattaaaacttagcccagaatagaactaaacaactaaagatatcaaactacatatcctctacaaccaagtaagtcatgtccaacgggccgtggacgccgacaacgagggtcatttcgatgtcgccagagttggatggaccggtgatgaagttgatgttgctggtttggagcttaccggctttaatgtcagcatcgtaatgatccatggcttggcgagaacgtggcaggatgttgctctttttgataatagccaagtaatgggttggcaggaagtggaagccacggccttggccaggggtggtggcaacggtaatcgtgcctgattcagccagcaaataatccgcaaagccgatggcgacgtccgcagccgccgcttgcttcaaattgaagtcgcggcctttgcctggcgtccagtacatcggcttaggactgacggtgttggtccattcggtcaagccaaaatctgcgtacttgtcagtggttggcaaaatcattgttttaggcgcatcttgctcaatgtaagcattcaaggcagccgccaaatcagctttggtggtggttttaaacgtgacatgcaccccttcgctatttttcttagcgatggtttctagctcatcttgagagtggccagacaaggttgtttctggcagatcattgagcggctcaaatggatgatctttgagctggtgccgcggtcggccggctttttcagcgatggcgttcaaaaaatcttcccgattcgtgtgatcactcatgtttttgcgcctccaatgctgccttgtgctccttgaaccagtgacggaagttctcgttcttcttcggtggccgtggcaggtcacgcacatcggtccagcctcgtgcgagtttcggcagcatcttagtttgtttgatgcgaccactattgtactcattttccacgctgccttgatccttcgtagccaaaacgaccatcatggcatgatccatgtcaagcgccatgttgaataaaaccggagcgctggtgccaacgccaaccattttcatgatcttgtcgttgaagctgtgatccatcttgagcttatccatcatgacttcacgatgcttgatcaacaattcgtgaagcggaatgcggacgggacaggtttcggtacaggctgcgcagagacttgaagcaaatggcaaatcgccgaacttttcataaccgtctaaaactggtgaaagcaccgcgccgattggtccagggtagattgagccgtagccatgaccaccgatatgccgataaaccgggcagacattgagacacgcgccacagcgaatgcattgcaagactggctcgaatggcgtgccaagggcgttactgcggccattatcgacaatgaccacatgaaaatcttctggtccgtctgcttcgccgtcaacttgcttgccagagaaggaacaatagctggtcagtttctgacccacagctgaccgagacaacatgttatccagtgtttctgcttccttcaaacttgggacaatccgttccatccccatcacgaccacctgtgtcttaggaatcgccatggtcagatcggcattgccttcattggtgaccaaattgatcaacccggagtcggcgatcgcaaaattgcaccccgtaataccgaaatcagcatgtaagaaatagcgccgcaagtattcacgcgcgaacctggctaaatgttctggatcgttgtcacctttgtaacccagtttatcgaaaatggttttgacctgatcacggtttttcgccaatgccgggaaaacgatgtgagttggttctgcccaatcgtcttcttgcaaaataaactcagccaaatcagtttccatcagctgggtgccaggaatcttcaacaaatctttgtccaaattgatttcggtggtgaccatcgacttggacttcacaatcttcttagcctgcttcttcttggcgagattcgtgatgtaagccgcggcttctttgtccgttttggcaaagtacacgtgcccgccgcgtttttcaacgttatcgctaaattcttccaaataatccggtaagtatttgatcacatgctggcggatctgctcgccaagatcgcgccattgcggccagttgccaagttcgtgacgtgacgcctcgcgtttatcccactgggcgtcttgtgctttggcaacacttgcctgcatgaacttgtcctgttcggattctttcacccgctccaagaatggtttatcactggtaacgatactcataggcgcacctcctgttctaccggcagtggatcatggaacttgatccgtttcgggtcaacattgtggttgagcacttcagcaatgtgcatgatcttaattttttcctgacggcgagagaaacgaccggaaatattcatcaagcaggcagggtcagccgaaatcaggactttggccccagtactcagcacatcgtcgactttttcatccaccatctgcttggaaatctccggctctttagcggaaaacatgccgccgaagccgcagcagttttcgatatgtgggagtggttccatttgcagatccttcacatgatcaagcaaaacgaacggtgctgtccgctcacccaacaaccgggtcatgtggcaagagcgatgataggtagctttggcatcgagttcagcgcctgcatcaatcacattcaaaatccgatacagaaactgggagaattcaaatgttttgtcggcgacttccttcgccttttcagcatattccggatcatctttaagtaaagcgcggtattcgcgcagcatatttacgcaagaaccagctggcccgacgatgtaatcggcgtcaactgacagcaacgcatcgatctcattacgaaagaccttctgcgtagctttcacgtaacctgaattatatgtcggctggccgcaacaaatctgcttaaccggcatgaaggtttcacagccaaagcgttccaatacttcgaccattgctgccccaacgttcgggaagaaaagatctacgatacaggtggagaaaatgacaactttcatggcgcacctcctatattaaaacgattccaatttaaatatacacctccaaacatgattacggtactgaaagcgtttataaaaaaataatttacttctttttgaaatcgttatactaactagcagcgaccagccaatgagttcactttgaaaaagcctgtttatgctagcttttgatactaggtttaagcatattgtttcttaagcacgatactgcccgtctgaatcacgctgacaactaggcataactgccactagcatccacaattaggctgtcatcaaaaccaacgacatcttgtggctcttttgctgctttattaactaaaaaaaaccaactttttaaaacggtctataccccctctcccccttgacttaacgctgttccgcgcggtttcacagccttgatttttaggctaaaaagactatggtaaaggtggagttaggaaaccctaaataataatggaggcgtgtttatgcgtaagcgatatagggcaacgttacaggcgcttaatgatgattgtatcggtcggaaagcacacgggtttgcgaatcttgaagtcacggatgatgatgccctgcaaattcgcatcgagatgtttaatacgccagcagatatgacgcatatggccgtcttggaaggttccgttacgaaagcgccagtcgcggttgcgacagccgcgcaagacgtgaaccatgatggtgtcgttgacgaggaagaagcagagaaggtttccggtaaagtgtttgtgccactcgataatgctcctgaaaagctgaatctcatcggtggtaaatatccagaagccgacgacaatggcttttacatttaccagcagcgagttgtcatgtcagacttgcgggaacagttgctcaaacgttacggcacggatgtcttcaatcttgataatgcggtcatgtatgttgacggcgtccaaagcgatgtcctgttgccgaaaacagtgatgagcgatttggacaaagagaaaccttatctcaccttgccgattgccgttggtaagttgcgtaaagtgatgggttgatcattgttccccaatatgggattcgtgaaaagattgggctaaacaattctctatcgtgccaagctctgtagtcgtagactttgatctttcaagcctaaaaggcactgtgacgtgggcaaaaattctttgtttcggtaattgcaaattttgtcctgacctgttcactgtttcttgttagctttacaccattcaaaaaagccgatcatcatctgaccggcttttcgtttgtcatttttgtgttgcgcccatgattaaacagttggcgcggttgtcatttctgccatccgctgataaacagcgacaacctcaccggccaaatcgcggaaagtgatggcattcatgagatgatcctgcgcgtgggccatcagcagtgacacctcggcgtgattgccactggcttcggcggtcagcagctctgtttgcgcattatgcgctgacactaatgcatcatcagcttcttttaattgcacagttgcttcaggaaagtcaccggctttggcggcttgaatcgcggtgaaggccgcacttttggcattgccgcctgctataatcaagcccatgatcgtctgttcattcacttgcgtcatcgcgttttctcctttgtcatgatcagtgtttattaactcatcggcggtttgtggctctaacttttaacatgctttaacatgaacgtccgccatggtttcagcaacggcaacaagtcgagatctgagtcagttaattgaccaattttattgcgtcggccatcatttgccagttcacgcaggacaatttgcagttctccggcatagcgggcatacgtctcattcaccacgacaacatcgccacggtgtaacgtgccagttgcatcatgcgctggaatcgcctgtcctgcatagcgaatgcgtggctgggtgtcgcgaaccagatagtctgaggcgtcaccacgatataaatgcgcctcactgaatgcaatcttggtttccaattcagaaatggccgccgttggatgcacgcgcaatgccggatacggacagaagaaggccagtgccgcggcgtgcaaatcagcctcgctcgccatcgcattgccgattaacacatcgtcaatcacctcggtcagtcgcaaatggtgcacctgactggcaatggcccgatcgcgatcactttccagtgttggcaagccttcgctgatcggccacggcccatgatcagcacttggcgcagtcacaaatgccgcggtgcgaatgccataatgtcgaaacttctgcgagtaggccacaaaccgctcatcacccaaaccagtatattgctgcgggtaaaaattatgacagcctaacaagttatctagacgtggtccaaacggcatgatggcatcaacataattcgtgccagcactcatattgatctcaattttcaagccatactggttatgcgtcatcaacgcctcttcttgtccagtaaatccctcgtcaagccgcaagccccagacgcccagttcgtgaaagaaactcagatcatgataatcaatttccaactcggaaaataacggtggtgcaatatcgacaatcgttttaaatccaagttgagttgctttggcgacaacagccttaaaaatggccaactgatcgcggcctttttcgccagacaactgcaatagcgatgtaaacagccgccgatacccaagctgatgagccatttctagataagcagtcgccttcgctatcgtggtttgttctgggtagagactgatcccaatctgtcccattttttcgcctccttctgtcgagtcattgttttttgtttcactgtcttgtattgcttgcttcgtgctccgtgccaatacagatggggtgtcacctctgaaggcaactttttttaagattgacacatcttcaaagccattttcttgaatcggcgtttccgaaaccagcccatcagtaagccgctcacccgattgttggccgtgccgcgcgccgtttttgcgactaaagattcttcatattccaaccgactttttcccgatgcaagtggcactaggcgatagctaacgcgaaagtcgtcttgcggcgttgccaatgtataagcatagactttgttcggctccatgtcggtaatctgcagccgcgcctgccgaccattcggccattttttaacatagctaaacccgcgcaaacttcccggtaaaagttcccggccggtatgcgtgcgaatgtctgccaatgccgagagctgtaactgtttgaaaaagaccgccggctcaaccggcagattcatggtgatcttcatcgcgcccctcctgcttttgtgccttgatcaactgaacatagcgacggacgaacacaatcgttaaaccaatgccgatgccgcagccaacgatctgccatggtgctggcaataatggactgaacatcacgatggccatactgagattgagcaagatcaagtttgctgtcacatttttcaaacagcatcaccttccagcttgcctgtctccttcacgcgtttttcttttttcatcaccggttcgtcaacggtcaactcagggtccagcttgttggctgctttgacgaatggcacatagatcaagaacccgatgaccatattgactgcctgtagaatcggtgcgcgccagtccatggttgcaatcagcgagttgacaaacggtggcattgaccagacgatttgattcttaactggcgatacccagccgaggatgtgggcgccataagcgattgagaccatgaccactggcgccaaaatgaatgggatgaagtaaatcggatccagcacgatcggcaacccgaacatcacaggttcattcacattgaagcagcctggggcaattgataattttgccacggtacgttgatcgtctcgttttgaaaacaggaggatggcaatcagcagcagcaaggtactgccggcgccgccaatccatgcatacagatcaaatgcgtttcgggtccagacaaacggtaacgcttcacctttcatgaacgcattcatgttagcaatttgcgcggtcaaccaaatggaatccaacaccggtccgagcacattggtcccgtgcagaccgaagaaccagaagatttgcaccaacagtgtcatcagtaagactgcccagaaaccttgcgacatattcagcaatggttcctgaattaaggtagcaataaattcgatcaccgttgttttgtttaagctaatcagatagttgatcacaccggctaaatacaacgcagccgttgctggaatgatcccggtaaacgccttcgcaatagcaggcggcaccgcctctggcatcttaatcgtgacattctttttcatgagccagatgtataaggtcatggcgatgccgcccatgatcatgacggtgaagaagccataggaaccaaagaacttgccaaagttgaaataaccccacatgctgatgttcttgccatcaacgaccccaccagcatcggtaatcaactttgtagcgcctttaccaagtgcactgcttaaagcgactgtgaaattctgcggtaaactcatgatgaatgcgcctagtaccacaatcccaccagtcaccggctcaacttggtactggactgctaattgatagccgaacgtgaaggcaaacagcaagcctaaaatcgccagtgtgccggtccagaccatcgcattaatgccgatcagccattgcattgaatcaacaatgcccatccacttaaactgggtcggaatatcgcgaattaaaacgttcaagactgtcgaaactgcgccggccatcatcgctggcatgatcgcaataaacgcgtcacgcaaagcaactaaccaccgaattgatccaatcttagccgccatcggcaccacatgccgattcagccatccaataaatgcattcataaagatgcactcccctcaaatattttttgataatgtcgcagtcattctttattacaattaaaattttacgggagtgctggttcgcgggtcaaagataatagtagttattgtttataatttttataagcaaaataggatgatgatttgttcttgtgttggctggttgaacaccggtagtacgagttggctccgcgccgattgggctggaacgtggtgggcacagctttgaactcgcgcaaacccggcgcgatttcaaagtctggccttgttctaaaacgggaaaaccacccgtttaagaacaatttcaccactgagcccatcgtcgctccgccaactctttctttctgctgttgggaatatcagcttgatgcatcattttcaatcgacaaataaagattgttggttctgacttctcatggcgtatttattgcaatttttaaagaccgtagtgccaaggcggagcaatcgtaggccagatggggctcagccgtgcaaacaacacagcgaccgggctttgagctgatgttgttaggcgactttgagaccgcgcactttgcgggctcaaagcgccgtcacagcgttccagccccagctggccggagattgcggagtttggcacggcaagaaaattttagcctagcagttccctacgattattcggaatttaataaaccacaagtcctacaagagaatgatggctctcactcgtgatttctagcaattcaagtttcagaaatgaaaacatcccccgatatcgcaagcagttcgacaaccattcgcttataatagattgaaaccagtcaccataacgcgctcgcagtcgcagaaacctgctcgcgctttccatcatgggggtaaactttatggcaaatattgaatatgatccggaacgtcaattgtttcatttgcacaacgacacctttagctatgtcattcaggttattcgcggttatcttgttaaacgttactgcggaccggcgctggatcatttttccggtaccgccaaacttgaagacttcagtcatgcttttaacattcaaaatgatgccgcaccttactcactgacgaccttgccgctggaatatagcacattgatgggtggcgattaccgtacgccagcttacgccgtgcgtaacggtcacggtcagctgattggtaatctcaagtttgaccactatcaaatccttgctggcaatgaaagctttaacggtaccttgccgacagcgcggacaccgcacgggcaaacgctgatcataacgatgcacgatgaaacccagacgcttgctgtcaggctcaaatacacgattgtcggcgatttgcctgtcttgctcaaacaagttgagtatcgtaatctgacagacacgacactgacgattactcatgctgccagccttcaactggattttgacgaccacgcttatgacctcattacgctgaccggtgctcatctcaatgaggccaaagtgacccgccagccgctgacccccggcaaaaagtcaatcggcagtaattatggcgccagtgggccgcaaggtgtccctgcgacgattcttgcatcgccagcgaccaatgaatttgctggggaagctttaggcgtcacgcttttgtggagcggcaattttaactatacggcgcaagtcgatcagtttgacaacagccggctcgtgatgggactgaatccggagctctttgcttggcaactcaagcccggcaagccatttgtcacgccggaagcagccgtcgcttacaccaacgatggcttaaatgatctcagtcgaattttccatcgctttttcgccgatcatgtcatgccattgccgcgcaaaaacttaattgaatacaacacgtgggaaaccacttattttgacgttagcgaagccaaaattcttgccgagatccccaaagcggaagagttaggagttgagttactggtcattgatgatggctggttcaaaaatcggcctaacgatgctggccaacttggcgactgggtacctgatcccgttaagtttccacatggcttgcgcccggtggctgacgcaattcacgctcgcggccttgcttttggactttgggtcgaacccgaaatgatcagcgaaaatagtgagctctatgccacccatcctgactgggccatgcagtatgtcggccaaaaacctctacgttctcgcaatcagcttattctcgatctcagtcagcggattgtgcaggatcacttgatcacagttctaactaaccttgtgcgcgataatcacattgactacctcaagtgggactataaccgccacttcagtcaacctggcagtccggtgctgccacctgatcaacaaggtgaagtcggctatcgctatacccgcggcttatatcgggttttgaaaacgttacgcgacacttttccaaagctactcatcgaaaattgttcgtccggcggtggtcgtttagatggcgggatgatcgcctacaccgaccaaacatggactagcgattttactgacccggtttaccgcatgaaaattatgaacggcttctcgctgtttttcccgctcaaaatttttgtctcgcatttcaccgcctccccgaatctacaagatgcgcggttaacgcccttgcatacccgcgcactgttaagtctggttggcatcactggcatcgaatgcccgccgagtcagctcagtcccgctgaagccgcggcggtcaaggccagttttgccttttacaaagcgaatcgcaaagaattgcagaatggtttgctttttcggttacaacctagccatgttaatcaagacgaggtttgttggctgatcaccaacgccgccaaaaccaaggcactggtcttgacttcagtcggtgtcacttcgccgattcctcattatcaacatgtactgctgcattacttggacccaaaattgtcttatcaaatcgacaacaccaaaaatgccaccgggttagaactgaaccacgccggtgttaccttgccacttgcccatggtgatttttcggcaacgctcatggagctgacggcaataaccaaccttccgcaacccaccgcagcaccgacgcttgatcaaataaccacgcagagttagaccatcttgttgttcaagcatgaccgtttaatctcagccgttagaaagtgagtttcgctcgcatgaaatttatcatcgctcccgcaaagaaaatgatccgcgctcaagacgatttcccggtccaaggccagcccaaattccgtgcccaagctggcgagctgttgctgctgatgcaacaattgaccttttctgaagcgcaggcgctgtggcatgccagtgacaaactcacgcaaaccgcctacaaccaactgcagcaaagtgacctgacccgccaacaatcaccggccatcttcagctattctggcattcaataccaatacatggctccggacttgctagacgacgccggtttggtatacatccagcaacatctccgaatcttgtctgggctgtatggcatcttgcgcccattcgacggtgttgtgccttatcgcttagaaatgcagaatcgcttaccgctgcctcatcatcacaatctatatgacttttggggcaaccgcctttatcaagccctagccaaaatgcccggaccgatcatcaacctcgcctctgatgaatacgccaacgccattcgcccttacttgcgaccaaaagatcaattcatagatgtccgcttcgcccatcgcgtcaacggtcaactaaaaacccgcgccacttatgccaaaatggcgcgtggagaaatggtccgttttgctgccagtcaccggttaaccaaggcggcggacttgaaacattttgattcgcccacctaccgcttcgatgctcatctttcaacggcaacgcaactcgtgttcatcgcgaagtagctgattataaaaaagctgacatcaactgcctttgatgattgccgtcttgttaagagggtcaaccgtcattggcagtcaacgtcagcttttttgcatacccgttagcatgaccaaagtatgcgaaagcgctgatcgccgttgagatacctgggagcatcgcgtccaaaaaagtgacgatgcagacaacccgccatcactgagcttcggacttgcagtttcgttgaagtcacgttaatatataaacaaatactagaaaggtttgttaatatggaaaccataaatagatttgtttatgaaacatctgatctagctcgcggttaccagctcaaagaccatcgttaccaatgccgctactgtccagtcacatttgctgcggatgaagtctatccgcaagatgatcactttttcacggctgaagcgatgatgcgtcaacatgtcgctcacgtccatcatggcgcgctggcagcattggtggcgcaacccgctggtcaacttggagtgtcatccagccaacagacagttttacagttgttcgcccagggactcagtgatactgtcatcgcgcaacgactcaaagtctcgccttccaccatccgcaactaccgctttaagttccgtgaaaaggcgcaacaggcacaacaatttctcgccgccatgacgctgctagcgatgccagacgcgctgatcatccctcacgacggtgcaaaaatggtcgatgatcgatatgcgatcacgcctgaggaacgaaccaagacactcaaaagtttcatggacgctgatggtcgcgtgacgaattggccatcaaaagagaaacgcaagctcattattttatcggaaattttcaaaggcttcgatccccagaagaactactcggaaaccgcggtcaatgaaattcttaagcaacacgttgaggattatgtcactgtccggcgtaatttgattgaatacggctttctcgatcgaaccgcagatggccgcacgtattgggtcaaggctagtggtccgcgaatttaaaatggcacgacaaatgtgctcgcgggatattcaaaaaagaatttagaataaagattctgcgccgtgccaaactccgcaatctccggccagacggggaggcgacgcgtagctagagcggagccggggcttcgagcgcaaaaaccggtctcgaagtcgccttacaacatcagcgacaaggcccggtccctgtgttgtttgcacggctgagcccgatctggcctacgattgctccgccttggcactgaggtttttaaaaagttatcgtgataagacgaaaggcgagggattttccgaactctcagaaaatccctcgcctttatttgtcttccatgaatgatatgactatcaaacatcccgagcagattttctagccggcaattgagcaacctcatcgataatctgatccaagatgtccagttgttccgcataacgaacggcaaatggctgctcgcttggtttgacttcctctgcttccagcgcaggtcgcgtggataagcgttcagcgtgccgcttatccagccaagctaagacctgatcaaaggtatagcggctgaacgtatcgactgtcagttggccggatagaaaactgccgagcaaatcatggcgggcgtcgatgggatagattttggtgcgggctaagagcacccgaaagtcaccaataaagatgaattgctgctgggtgcgcgtcaacgccgtataaaagctttgggcattgagcatcatgtcggcgccgttgacaatggcaataacggtatctgcctgcccaccttgggccttatgcaccgtaatcgcataagccaacgtcaaatcgcgcggcacgctgccaaaactgtagtaacaatattgctggccgatttggaccacaacaaaatggcgtttggtatcaatatgggctaccacccctgtgtcgccgtttgccacaattgtctcacgccaacgtttagtgccaaaatcatcggtctgttgcaagccattttcgcccagcaccgcacgccgttcccatgttttcggatcaacaagcggaacatgtttgtcgtttttcaaaatcatgacccgatcattgagtcgcaagtgatgtttttgattagtgaccgggtccacgtaactgctgatatactccggttcgccatttttagccgggttgaccaacgcttgcaactccgcgttaaatcgcaagcggccagttgcgccgatgtttttattcacgatcaacaattgcgcatcaatctgctgaccacttttgaccagcgcatcctgatacgccttcaccccagcatcaaacacccggccagcattgcgttggttatacagcgccacattgccgctgacatagcgatcatcgtctggtccaaaaggcagcgctaaccgctcacgaatgcgattagctagtgctaacacgccggactggctatcttgccgataaacgcgggtcagtgttgtcgccgccacctgttcatcgtctagacaatcttttaaaaagttgccaggaccgatgggcggcagttggaaaacatcaccgacaaacagcacatgcgcctttttgaaattaacgttcttcaaaaccgtgtaggctagcagcgttgtcagcattgagctttcatccaccacaatgagtcgcgcatcgccaaaggtttcccagtcggcatccgcgtcaaactggccggtttcttcacctggcagtagatgcagataagcatgaatcgtggcagctggctcgtgcgtatactttgccaaaactttggcggcgcggccagttggtgcaagcaagacacttttcccttttgcttgggcgttaaaaaaccgaaccagcaaatcggtcaaccaagttttaccggtgccagcactgccgtttaaaacgctcaagccatgacggttcacattttgaaaagcggcgcgctgctgatcattgatggttaaatgaaaccgatcgagaaactgatcgagggcatcatctagctcatccggagccatcagcggttcggctgttttttgagcgactttaataatccgcgccaccgatccttctgtggcaaacatatcgcaactcgtcaccagtccatactgctcgttaagtaaaaagccgtattgcaaggcttcttgcggattagcaaacattttcaaatcggcttcgcgtacagccaataaagtggcggcttgttgccggaaccacgtaatggtgatataggtcaatccttgcgtgagtacagcggtgcgaaaaatatattgcagtcctgccgtaagccgatgcggatcatttgctgcaatgccacgcgtcttagcaaaggtgtcgactttcttgaaatcaggctgggcaactgacatcaacaggtacggattggcatcaatactttgcatggccaaattggcatctttataagccaaccaaattttttcataggtcattgagcttagtgccttgccccagtgattggccaacacggcaatttccagtttgccgcggatggcggtagcgattttcttaattgtggcgggaccaatgcccgggacactatccggttttacctgatcggttgaaaaaatcgtcaagatcggggtatcattcgcaaaatgttcatgcaaacggcgccggactgtcggctgatgcaccagcagcgtgtcaatcaactgccactgccggcgcggttctttgggcaagccaaaatgtaaccgcgccaatttgtaagacggcttgttataacgcaatgagccagcatcatcgtaaaccaaatcagcggtgatgatcgctcggcgattgtagtagcccatatcaccggtaatggttgcctcttgggtgagcgtcattttaagcgccggattcggattcagaatccgcacggcgtaaactttataatcaccgttatcgctattaaacagcaacttgatcacttgcagatcaacattttcataaacttgttcctgattagccacgtgcgcccctcctctcaaaaaacaatcaccgacaaaaactttatagttgcattcttagtttcgttgtctcgtgtgtcgctgccttgtcgagcttcggtgcaatccgaaagcgaaaatcctccggtaaggcttgcaactcatgctgagcccactgttggataaaggtcggttgctgccgggcctgataaaactgcaactctgggcgatgcgtaccgtaaaccacgacatcttctcgcccgtgcctcactgaccactgaatggccgccagcagtgcgaccaagccggcagatggtagataaaattttcgcgccgggttgaaatcgtccggtgtcagctcagcatttgctggcgcatccgcgtatgccaactctttaactgcatcgtccaaaaactgggtgtggcgcaacaacgttttatctgccgcatccgtgattttcaagccaaatcgattgccattcaggtcattcagccacgctaaataaacctttgtctgcggcgcaaaatctgcactatcaacctcgtgctgcagattggccatgccgcgatgcagcaagatcccctcagctgtgccgccattaggaagtttaatgatgtgttgtgcctcgcttgatgttgcgtgtgtatctgccatgatcggcctcttttcttcaaataagcttaaccggtatggtggttggctgcaaatattgattagctaaccctcaaaacggcggctgacttgctgctagcattgacttttgagtgatctcgagagttccattagcatcgacttttactactatcattcttttgatatttttgggggtgaagcttagaccggcaatttaagtctcacaaatcggcatttatttaccttaaaacgagacaaaaagttatttttagctttgtgatctcgtgaatttgaaagcgggtttccatgtaaagcctattaataagcgattaaataaattttacttgctcactcaattcgtttttgttggctctcgcaaccattcgcgtacaattaaagttgttccagcgaatggaacgatttgacatcaattggggggaacttttatgtcaaagaaattgtggttgagcggtgtcgcgtttgccagtctcgttgtggggagtattgcaaccggttcatcgcttgtagctgcggacaacaccgttggcacgacaaatacgacagtcgcagtgacgggtggcacaatcgaccttgcagtgcctgacacactgacttttccaagtgagcctgtcgaagggattgttagaggcaatgtcaacgagacggttaattccgctgacaactcattattaacgatcaatgacttccgcggtacggacgccgggtatacggtgtcggccaaagcgtctgcgatcacagccgctaatggcgatgttctgccaggcgcggccatcgaactaacgccggatgccccagcagtgacgaatgctgatgccccgacttggagtaaagcggtaacgttgacggattcagatcaaccattattcgccacgaccaaatcgctaaacggtgccggcattagcagttatgatctgaacaaaacaacgttggcaattcctgaggacaacgctgttaaggctgaaagctattccggtatcatcacctttacattgacacctggtcagccagctgcaccagctactgcacagtaacggtggcgcgaggttgatggttttcgacttttctggttgtacttgccggaagggagttgattcatgtcaggacatcaccagaagactgttcggtcacaattaaaaatcagcgcgggtacccacgtcgtttggatcggcaatcattcacgcaccatatcgtattgaatctacaagtctttcatctctcttatgaattttcatctctacacatgcggcatcaccattgtcttgggggagacggtgatgccgcatgaaaaagaaccaaagttaatgtcttactcaaggttgacttgcaactgtcagctttgataaccaagtcgcgacacggcaaccagcaacatcagagcgcaaacagaagcgctaaaaaatcggaacatgttcaaatcccaatttgatgttaccggcattgctgatcgttcacgcgcacggtcagcgatccaaacccacagtaccgatcttttcaaagttcccgaaatgggttgccgacttggtctatcaaaaagcatcaaagaaaccgtcgattttatgatcgacggttttttcgtgagcgcgaaccagcccggttagaaaccggagcatatgcggccttgggcgtgatggtcggtttttgaccattgcgatcaaggcccttatgcgcaggtttctgggctggcaagcgcgttatgacgaagcgcgaaccagcctaggtagaaaccggagcatatgcggccttgggcgtgatggtcggtttttgaccattgcgaccacggtccttatgcgcaggtttctgggctggcaagcgcgtttatggcgaaacacagcgcaattttcacgaaatcagtggtgcgccatgcccaaatgaaccgggcaacaaaacctgcgccgaagcgaatttagccgcatgacttaatgattccgaaactttggcatccaatgttggcttgctagaagaatacaaggtcgcagcaaaggacgtaatataagcatcccctgctcccaacgaatccaccgccttcacgccaagcgcctgctgccaagacatcatgccgtcgaccagtgccgcagacccgcgcagtccgcgtgaacaaacaatccgatcacaaccagctgccgcaacccggcgcatcaatgcctccacatcatcatcagaccgtgctttgccagaaagataggcgagatcaatctgtggcgcaatctttttaaacagtttgtcatcgtcaaggatcgaaaagtcataaaccttgcgcgctgtgatagcctgcagaaaagcatccgcatgactttcaccattcagatagaccagatcgaaactattgatataggcaatgtcctctgggtcaagtcgcagctcttgtggcggctcgccgaccactttacgccgtgccccatctttgcctgtgatcgttgtaaaagcatttcgaccggcatattgtagcgaatgctgcacatctacgccgcgttcgaccaacatgcgccgcgcaaaatcgccacgcgcatcattcccaaacgtcccgatataggctgcctgcaagccgagttcggcggcaaaaaccgccgtattcgctgcatgaccgccaagatacatctgcttatcagccggataaagatcaacgacattgtctccaatcgcaatgactttcaccgatctctccctctttccatcaaacgcggcaactgcagtcttcgatcaaactgctgccatgcaaactcctgcttcctgttaacaaggtcaagtttaccacagcaggaattgggtgtggcatcaagcttgtcatgttttccagaatgcatgatcatcaccaagcctatccgcgttaggaaatgaacaaaacggcgtccaaaactggccgtcgttttttcgttttatatgttattccaagctaatgtctgaaaacttattccggtcaccaataacagtctacaaatttcgatgatgggtattatcatcatcaggtttgctttttcatttcgccaaattcccaaccaccttaatcttcacccgattcgcattctcaggatgataagccagcggtacctcatcaacttcaacgacttcaatcgtcgtttcatccgcgccagattcaattgctgcggcagtagctttctcctttgcatcagccatcgccttgtcgcgcggaatctggttgtatggataaattcggccgtattcacccgaaacttgactgatggacgcaccaatcgcgtttgccacaccgcccaatgggtcacgaactagtttgccgaccccttccaaccgatgcggtgcaatgatcgccccgccaccaacaagaatcaccgttgctggctcagcactcgttttcattttatcaatcgccacggcgatcatgtcgctgatcgtttgcaaagccgcctgagcgaacttcagcggaatctgcttggtcagttggggatcgccaacctcggacaaacccaaacgaaccgcaatgtcagtggcggtgataatgttaccgccaaacgtcaatgcctcgtcggtaatcttgtagccaacggaatcggggcccaccgtgacactgccatcttgctgctggcgaacgattgaaccgccgcctaagccaatcgacatgatgtccggcatccggaagttagtcgccacgccgccacattcagaccatgcacgcgcttttcagcccaatatttgtcgaattgccagtaacaccaaaccaaatcccatcatcgccatcgtgatgttaagcaccttcgtcacgattcgccgctcttggtcatccatctcttcaatcatgctcaaattgtagtcattgtaaggctcagcatcccagtacccgacataataactcagcaacttcttctcccgaccagtcaacggcttactgtcagcgcgaagcaacagttgatcatcaaacaaagcatacatatcatcgctcaacatagccgccttacgatgccgcctcgcctgctcactgacctgatcgaacaaccgctgaaaccgttctcgcaccaacgcatcctcatcgtcttcggctgaccacgccgttaatttccgcctaaaaatcgtcatcactgcgttaaaatgctgccgttgaaaatgattagcaaacgtcaaataacgattctgttcattcagatatttagtttgccaagtctggtaaagaaagtagccaaacaaccacaacacgatcaaagcattgatcaagttcccaaaattccaggcagtcatcaatttctcaagactgccaatcacccaaaaagtcaggatcatgagactaacaaacaatgacaacagttgcttctgccgcatctgcggattccgctgcatctcggcataaatcgtctggcgatgcttcaggtaaaggacaaaataatccaaaaagtccaacgagcggacttgtcggtaagttttaacaatgtaaaagagcaggatgaccagtgaaaccatgttgatgacgcggttgatggtgtcgattggggacatgaaggactccttttcaatttaatttcaatgttgtagtgccatcatctttaaacccagttgctctttatagtcccaatacggacctccggcaaatccaatttataaccaactgtcggctaactgacggtactgtgcctaactggtgtcagctcacaagtaacctcttcaattctgcgtttattaacttcctaactcacacccaaggccttaaaagccgcatctttaaccgaattataaaagatcaagttaaatgaactcatcagatctgttggcacaccgctgatgtcgctggccgctgcagctggcagcaagacacgttttgctccactgtccaaggcgacttgcaatgtatcggcaagatcatcgatgcgtgaaatcgttccgccaatcgtgaaatcacccaagataactaaacgatctagtgtcggtttccctaatgcgatcgaaactagcgcgataaatgtcgccaaagaaatatggctagatggaactgaattattcaaattagtcgcgctaaccacgaaatcacgggcgttggcattaattcgttgatcaattcctttatagttggcctcaagatacttaaaggctgtgtccattgcctctttagcttttgtacttgatccgacgcccgatttactcagtctaccaagtcctggaacgacctgtgtttctaatttgatcagactaagccgtttactctcgtcataagcaacagtataaacatggccgggattttcttgaccatcaggaatgagcgaacttgatccagtttccggaaccgagacataagtttcctcaaaggtcgtcttatcaatatacgaaaagttgacatcatagaattccatgcccccgattcgtttgagttgttcttttactcgacgacgcatttccatagcaaattcaagaattttcgcaacgtctgctttttcaaacacaccgtctggataaagtaatttgataagcccagaaacagtcttacgaaccgcaatcacgtcacgctggttaagctgctttccaaacgaaaaatactcgtcaatcgcatctgcgtatgaaatcttgcggagctcgcgcattacctctgcaaaataatcagtgataaagccaaatcctttggtaaagaactcgggccgatacttaggaatctcccaaccaggcaagtagttatgaattctatccaagaaagccgtatcattgcccatcatctcaggaaaaggttcaaagagattagaagttcgcaacagtacatcaacgctttgattgatattgccaacaaaaaccattcctgctgaggcttgaatctcatttcgcccacgtgcaaacgatcccgaagccatatagtccttcataatctgcacgccatctttatccttgaagtgaatcccagccacttcgtcgaatgccacgacgtcccacatgccgacaagtcccacttcacgtctagacatgttatagaacaagttggcgacagtcgtctggccacctgaaatcagaattgaatccggcgatagctctttatagacatgagatttacctgtcccacgagggcccagttcgacaaaattgtaattattttcaacaaaggggattaatcgagaaagtaatagccacttttcgcgctcagtaaattgagttggctccatccctgttgttcgcaataaaacatccagccactcctcagtggtgaaggcctttcttccggcgtagacttcttgcatatcaacaaatggtacttgaataggattcagcttttgaattgagaaatggtcaaggctttcgtgatcgtaactaactcgcacgattgaccagatacccccgattaacaaacgctcataatcttgcacataatgctcgtcaaccggcacgcccgttaagccaagattgctgaagctcgcttcataccgatcctcagcttcatttaaccgaactgaaagtttatcgatgactgtataagcaccgtcttctcgaatcttagattttactttctcagcctcatcgggtcggacataattatgcgccaacgtttttttgacattctcaacgccacgctcaactgtctccatatccgaactattcgcaaactgccccaataaaaactcaagaacataagttggcacatttgcgccttccttgattctttgcgttagatcttttcggacaaaccgcccaggaaagttctgctccaacttgattaaagtagcgtcattttcagacgcttcatcatgcgcgctatcagatgtcaaagtcaaaacctcctcccacagtgagatccatttgataatctatcggtgtacttgtgttagcatcaacatttttgatgattaactgatagtggccaccacgttcaaagtcctgatcgatcaatggtatgtgtcggcgaatcaatcggtcgttgacattgattgaggtaatatccgcgtgaacaagctgttcgccagaaatttgtcggccattcccatcaacaaaataaagtgcgtaagttgccgcacgatgcgtttcatcgaccggatcattttgaaccatattgacaataacttcgtggctcgtaattcgccggctggaatctgtcactgccaatgtggcatatgttgcctgcgacttgcgactctctgtggtgacatgcaaaaccggaataatcatttcttgaggagagcacccgccatgaacataattttgaccggctccaggtaccgagaacacgttcgcattacttggataaaagacgaaccgctgatcatcgttgcccaagatatcgcccagcttgacgttatctaccccaatttcatcaaaatcagttgatccaattgcgtaacggagattcttttgctcaaagtcgacatcactcggtagattaatcttatctgttgaatccagtagatgacggcgatagataaagccatggtcagctgtcacataaatatttcgaattgaaatagtccgcaaacgatcaacgccccgctctaactcagctatcgcatcctctacggcacgaaatacattgacttccgaagctggcttatcgccagtcgcatcaacggtgttgtgataaaaataaatcactttttgatcgacgacgtattttttctgctctgctgacgaaagtgataagaaatccgtcaaccgcatggcttggctttgcggctcaatcgtttgtaggatatgcatgcgttgctcaagattgatcgccttttgaccatccaccaataattccttgttgccttgatacgcgagttcatgattcggcaaaagcgatggcataccaaaataagtgacagacggcaatcccgtgactgcatattgcatttctgtgccaaaaacatcccgtttgtccagtctttgctgcaattccttagccgcctcaaaccgaaaggcatccgaaataatcaccactgtacgatccttatttggccccaccgtggaggagtaaaaattccgctcacgtctttgcggttcgatcatatttggcacataatcttggcaccaatcagagatcatcggaacaagatgctcgttgttgtatgccgattcaacatttcgagacaaattgtcaaacaagtcgacctgtgtggctggaagctgatccaaagcattgatatatcgacgataagccgtgtcaactaaatagtcctcggtgatatagacctggattaggtcgtcaacctgatcaacatctcggttttcccgaggcaccaaaacgttatgggcatcaacagtcatcctataagcaagttgatactctggagaaaagtacattttcccacgtttttcagcgatttctggcaaggtcatatggttaataacctctcccagatgacctgccaacaattcagaaatcagccacttcacagcatgccgatcaaactcaataaacgtgtctgccttcaataaatcagctatctttaagttcttgaagatttgcgttccgtcaagttgtcgccagactttagccgctgcttgtttatatacttcgcgagtatcgtttcgattccgccaattcaacatgaaagatacaacattattcatgtaactgacttcataatggcgaagcgttatcggcaactccaactccatctgataatacgcaaaattcaccatcatggttgccagcagctcttgtaaatcatgtttaccatgatagccatatgctcgatcaacaaaactccaaaaagtctctaagacctgatatttggcaaattcgtctaaaagtgttggtgccttgataacctcgatcaatatgtttgatagttgcaagtcattcgtcttagcaattgccgcaagctcaacttgttctggattctttccgcgttgataacgttgcttaaacttggcaatacgcgtcttagcggcaaagaatttgcgctgagcttgaacaaagctcaacccagtctcaggcagtccaagttcgtgaagcagcataacattcatatcagcagtaaacttcttggaataaagaatcatgtcggtcaaaagattctgatgaatgtctggctcactgaacgcagcataaacaagcgcctttcccccagccttttcaatgtccaaaagttcgattttcgtcttcagctgggttcgtgggtgcatgattacaattggttcagtcaactgatggcctagttcgtcaatattgtcagcaaactcgccttccttgtcataccaaaagacaaagtgcgtgtgacctttgaacagcttctcaatgccagtgacgacatccttcaattctacctctgccatactttatctactcctacttagcatcccagttagtatcctagcttccagtataaccaacggataaagccgtggctataatcctattcttcttttgttcactccaagctattcttcgggtgtcattaaggacttggttgatgacattaaggaagatgattttgatgtggataaaggcgggcaggtcgagattattgggtggttgtatcagtattacaacattgaaccacatgacaaagttgtcaatattaatggcggtccaatcaaaactaatgacatacccgcggcaacacagctgtttacaacggactgggttgtacgctatatggttgataactcgctgggtcgactatatctggagtacttccctgattcgccaatcaaggcgaatctgacctatcttctgcctggcccaattgagaaacgcacggattcatttgatctctcaaagctcaaaatgttagatgacgccatgggttctgaccacattctggtttacgcgttcgacttgttaatccaaatgtatgaagaacaaggttacggcaaacgagacgcgacagatgcgattttggcacacaacttgtatgggctagagatagacaaacgcgcttatcaacttgcttactttgcactgatgatgaaggcgcgccaatataatcggcggattttaagcaaaccaactcgacacaatcttcatgtgtttgaatcaactgtcgatgtgccaaatgaagtgtttgaaaaaatgaaagcatccaaagataccattgatgatttgcgcacactcgtgtcaactttcaagaaagcaaagttgctcggatcaattatgaattttgagaagaagttcgattttgatgcattattcagcgctgttaattcattaccagattcaactcagttggacttatttggccttcaagcggcgaagaactcccttctcggcattctgaagattactcaagttcttcagactcattttgatgttgtcgcgacaaatccgccttatttgaatcgaatgaatggcgatcttaaaaagtacgtcaaaaaatactataaagcttattcaggtgatctcttctcggtgtttatctggaagaacattgagatgaccaagcaagatggatattctgcttacatgacgccattcgtttggatgtttatcaaaacttatgaaggattgcgtaagtcaattttagactctaaacaaatctctagtttaattcagatggagtactcagcatttgaggaggccactgttccaataaacacttttgttttaaagaatgatatgagtgcggattcaactggtacttatttaaagctttcagatttcaagggcggcatggaagtgcaaaaaaggtatgtgctaaaagctattgctgacccttcagtgagctatctgtatcgtactaaacaaacgaactttgagaagattccggggagtccaatagtttatcagaacaccgatcgagttatagctattttccaaaataccgccctcgggcattacgcttgtccacgactcggaatggctactgcggataatagcaaattccttcgtatgtggtttgagatatcgattaacaatattggatttaatatgtcaaatcgtaaagaggcaaaagattcacatctgcgctggttcccttatgaaaagggaggtgactattgcaaatggtatggcaatcatctattggttgtggactggcaagatgacggaattcgtattcgaaactttactgattcttctggaaagataagatcacataattataatcttgagtatatttttaaaaaaggtatcacttggaacgcactaacttctggtaatttttcagcaagactttcggaaccgggatttttgttcgacaatgctggctcaaaaatgttctttaatgaagaggagcatataacatactttctggctctgctgtcaacccctgtagtacattatgttctttccgttatgaatccaacattaaattttcaacctggctctctggcaaacttgcctattatattgattaacaagcctctcatcaagaagctttctgaagagaacataagcctgactcgtcaatattggaatcaatttgaatactcttgggatttcgtctttccgttcaaatttcaaaatatcgctgagcatcagaagtcacccactacaaaactcttgatcttttttgacttttgtgacaaatatgtgccaattcagtttagggggttgattttttatggtaagttatcaaaaaagaggtaaggtatggcaatacgagatttcgtataaggatctggatgggaagtttaaaaaacttcgcaagtcaggattcccgcgtaagccagacgctgaattagcggctagtcagataaaatcgatttatcttgacattaaacagtatcaggctggggcgatcaccttgtctgaatactttgaccgctggattcacctgtataaacagaactctgtttcatcggtgaccttcatcaagtatgagaacaccttaagtcacattcagcaattgtttggcggtgtactcttgcgtgacctgacacggacgctgtatcaagaacgtctgaatgtctttgcgcagaaccatgctccaagaacagtagcagctttccacaagcagcttcgtgcagctctactagatgccgtggatgaacgtatcattcatcttgacccaacacgcaaagccatcatttcaggtcgttcactccccttaactaagcgtgctcttgattatcaagaatggtcccgtcttgttcatgggttagataccttgaacacagaacaaatgattatttacatagccgctctcacgggacttagatatgcagaagttctgggtctgacagagagtgatattgactttggtcatgctgagatttctgtgaataaaacttgggattataagtatcacacgggtttcaaaaagacaaagaatactgcgtcagttagaacaatcgtactggatcctttctctctttctagattgcgacagtttttaaaagtaaataaacctcagacattagacacggcaatctttgcgccagagggacatgcacctgtcagcgcagaaatcaataagattttgactcaaaagttagaatcacttggtcttccacggattaccttccatggactacggcatactcatgcatcgattcttctttatcaaggcgtcagtgtcctatccgtttccaagcgtttaggccatagcaacattacaacgacacaagccacttatctgcacgttatcaaggagttagaaacgcaagataacgagaaaatcctatcaattttaaaggcaatttaattggcacatttcttggcacaaaaaaaggcgatcctcaactggggtcgccttttgatcattttaatggtgtcaaaatttttgtatcagcttgtgctttggcatgattgactagaacaccatcgtctaaatccagatcaatatgcaggtttgcaacgtgttgtaacttttcatcatacttaatcaattcgtccaattctttagtaatcgtggtaatctgcttcttatatttatttttttgacgggtctgctgctcgttttcttcgaatttctttagctgtacaagcttgcgctcataagcctcttgaaggggatgcaagtatttagtccgaatcatcgcgactgtgttccgatcataacgatgcaaatacattagcgccttaaagccaccatttcgtcctgaattgaattcccaatatattggccgtttctgataagttgatagatgatctttcttgaagaaatcatcacgcagataagcccgaatcttttcttcagaactttctccccgtttgcctaaagtatcagcaatgaattctaagttctcattcagattttctgaaccaaaagtagtcgtcaaaaactccttgaagcgattcatgacatcccgattatcaccaaagtaatcgtcgtcagttagcagaatcacatcgtcctcgtttgggataaaagtcttatatttactggcatcccaacctcccccagcataagcaagtccaggtgtatcaattgagtatcggccaaagacgcaaccaataaagtacgacataaaagcttttatatcacgaggcaagcaagcgcgtctaatagacacgtctttatcttcctcctcaggactaagttcatcttgcaatccatacaaatcaataaagattcgatttagttcctcttcattggccttcaactggttgaaacgatcatccgcctctttctgccattgtttaaaagcagcctcgaccgtccaatttcgatgatgctcagcgatatggactaacaatttcgaaaatgaaaaattccaagaatgctcataagaatcatatgattgctttgccaagtctatacaacgagaaacttttttatcaatattcacatatctgggatatggaagttttgaaatatttccagccgttaaattcagtgtcggagccaagaaagacaaaagatatgaaactattttcgaattaaagaaacctaataataggtataagtcactttcttttgtgaatagtgcatcacctgactgatcaaaaataaaattcgaaggaagaactttaaaaccaatttcagatgacccgattcgtttccaagagattcctttgagaaaataaaacgattcatttcttattacagcggaagaagttttcttgatctgctctcctttatttttccaatagagcagatttaggtagttaccgtaccatttgactgttttgccgccagtatttagtttaaaccatttagtccccgcctcttgcttattaaagatatttgtatctgaaatatccacttcataccagttccgaataaactttgagttgttgcccgtttgtagacctgtgcgtggacttgatacatctccgacaggcacccctttaaatagattaaatgatttattgcttgcccaataagtgattgcttgccccggaatcatctcaaagttcgtttgtttagtacgataaacatagtttaaattcggattctgaaccgcggcaaggaaggcttgttgcttctttttttgggaatcgaagtcaactaagcgctcataggtgccaatgaatccctgaagcttctgtttttgaacgacaaaagctgttgtttgaactacctcaccaccaatttcctcaaacgcacgtgtgcctaaatgtgccatattgataatcggccagttgctcatgcgctcgcgcaaggctttaaagctggaaaggaacatccattggtgttgcgtaatcatggcaaagattccatcttcttttgttagatattgaaggcgctcaataaaaacagcaaacaagtccgacttactggcagggtaatattttgcaacgaacttagccagcgtttttggcatcttacctgaacccatgtatggcgggttggtcacactgatagtgtattgacgacttagcaattttccaacgcggatcagacttcttaactcccactgatggtgcacttggtctgacatctcaaaagtaagctgtcccgcctcacgttcgcttacaagcttgttaataagcttgtcatcaaaaatggagtttttgaaggtgatcaaagacccaagttcttttcccgcaccaaatcgacctaatacttcgcttaagttgcccgaatcaattgtatctccctccttagcgcctgaaaaattctctaattctaaagatgtcgaaggtatttcaaatacattgggacgcaattgcagttcgaaacttcgacgattttcacgtctcaatttcatcatcatcgcaaaatatgtcaattgaaaggcacgtcgatcaatatcaaagccaaaaagatttcgttcaacaatattttgagctgcttcgcgacgtgaatagccttcggattggtagagctgtaataagacatcaaatgcatagatcaagatatgacccgatcccattgcaggatcaacaaaagttatctcttccacacgtttcttagataaactgactcttgaggaaacttcaccttgctttgcttccggcataaagtattgccaattaaaagactgggcaatttgcgaagatgttctttcgtctccccggtcatggagcacacgtatccaataacggcctaatgaattctcaacaagatatttaacgatccaatccggcgtaaacagttgcgttacagctgggatgtcagaagataaatacttcctctttttgaaggcagcgtcttttggttcggtattgtaatactgatacaaccacccaataatctcgacctgcccgcccttgtccacatcaaaatcagcttccttaatgtcatcgactaagtccttaatgacacccgaagaatagcttggagtgaacaataattgcataaaatcgtcagttttctcaaaaagttcagggagatattggtttaatgcattggcttgtttagtaaagaggatgacataggccgcatccatatcagttggatcctcagtatcaagtgctttttgaataatttcatgttcatcaacactatacccaccaagatcatcttcaatttcaaaagcctctcgcaagatgtctggcacctttagctttgtttccgacgacaaaacccgtacgccactcggaagatattcgttaacttccataaagcgaattgcaataatccggttaaaccatgtgtaggcaacttcttcgatcaaatctgttaatgcatctgaccactcttcttgttttgccatgcctttaagtcgggcaactagttcacgacgtcggcgaatatcctggcccgttattgacaatcctttgtcaccgtaatattcaatttcgtttgtggactgagacattttctcagcaacgccgtccttggtaatcccgagattttcaagtttcaatttaatgctttcaatcaaactgcggcgagcctgaatcgcaaatgttttgatagcttttttatccatgagtacccctttcaaagccgacacacgtgattcagtcgacctgcaatgtcacgattgtattgtctgacagttgtgcttctagcaatcttttaaactcggcagtcagctcagccacatccgcggaatcctccaacttgtaatcaccacgacgaagaacctgatcaagcttaataaacttctcttcctttgcccttggtattggctctggctctggatctggacccggatctggtatcggtggattagtcttatcatggtcatctggagaaactggctcaacgagtttaacttctcgttcgatttctttctggatgccatcacttagttgatccaactgagcatgtgcctgcgcaggctttgcaacgacttcgtttaaagttactgcgttctgagcagcattacgaatgattttgatcttattttcaaaatcacgctttaaccggtctttcgtttcttcattagaaatacccgactccaaaattcgtttaatgccacgatccttgagttcgtcgatttgtgctaaatattcagctgccttcttatcaaaagccgcagtaaataaagtatcaaagtcattgtttaattcgctgattttgactgccgtgtctccctgaagtttctgcaatcggagaagtttacccatctcttcaacgatattttgcaatttgctatcactcagaaaatcacttgagtcgcgataaaccctcaatgcatttaatcccttatcccaaattttttgcattgaaacactaaagtagaaatcacgaataccatcgtcaagaaaatcgtcgttccaatccaacaaatcatctttatgtttgccgatgtaatcataaaacgcaccagaatcgggcatattcaaaagttgttgcaacatttgaatgccttgctgtaacacaacgtgacccggatacccctgcggttttgcctcaaaatctaccaaattttctaaattgtcttcgacagtatccttaagttcagaagcccgctgttcatcgttatcggacttaaacgacttcttgccaaacactgcagacgcgaccgtttgcatagctttaatctttgatggggcaacttcttctttaatttggaaagctaggttcctcatcgcctgctttttagtaaagaaaccagctaggtctcgcgtcgtatgtttatcgtccatcgggttaatagaacttccattgtaaaacatctttaacttgccaatagcgactaacttcgcaacaagccattgaatgtcctcgtcagtataaccgtatggtatatcgttaaacttcgacaggacactttccatcgtgatatgcgcattgttttgagactcacgacgcatgtagtccagaacagcatctacggctgcttgattgtctttttcatcaagcgccaaactcgagatattttcaaaaagttctcgaatatccttttcagactttgcaaccgtgatatattgcaaacttcgataggtattgtcgaccagcagcttcattgccttctctaatcgactatcaaagcctgcttcactactaacagattggccattttcataaatttctgcgttatccaatgcagcaatcagctgttcatgggcatgagcaaactcctcattttgctgagcttgtcgtgttgaaaccatcgcttgatagcgtggatcagtggaaacattgctgttgacaacgaattttcgaatgcgcaaagcgtttcgaatttcaccgacaaagtttgatgaccgcggcaaggctatcaagacatcgtgattccataaaccagtcgatactcgtagataatcgttatcttcaagaaagtcgtcgttgactggtgtgatgatgtgcactgacaacttattacgttgcgcaccgaagatattgtcagttttccgattaaaggcaaagacatagcgaccattaagcttcgggtaagtcaaggttgtggcaacacccggcttagcattaaataaatagtcgccaatctctttagcaacttcattatccgttacttcctgctttgaaatttcacgggtaatatcttgttctgcgtctgttaaaaagtcataccctttaacagttttctcaacgtagccttgcgttactaaaacatctaacgcatcctgaacctgctttttaagcgcaatgcgatcagcatcgactgaactaatcatcagagtaattaaattatttaatgatgctgtgaagttagaaacgtatttaaccatgaataatactttgagtagttgcagagcaaatggattcttttccttattcggattaacagcaggattatcgtgtgcgcgaactaacacaatatgatgtgtgtgatccaaaaactggtccaacccgtcaaagaatcggctaaatggtgctaaagtctcagtgctctcactcatcatagcctccgcagactcttggaaaagcgaaagcatggagcgttctccttcagacaagtgcttgccatccgatccgttttcgcgaatcgccgttaacaccaactgtaagagattaaattgatagggaacaaatggatagttttgggcgaaatctttcggcgattcatactttggacgtttaacatcatcatcgaaatcaaatgagttgttaatagcagcagcgttcgccgaatattgatcttcaagcattttttccgccacgtctgttttttctagtaaacgtttgcgaataacttcatcaacattagccgaactcatcgacaggcgtgtcttgaaacggccttgaatcttggagaaatcctgtcctgaggcaatgtccgttactttgtcaattgcttgttgggatgtgacaacaacccatgccttgccacgtgtcattgtccctaactgctcaacaattgtttgcagattaagcatgcgttgaacgctatcgccaatgaactgaccaacctcatcagccagaaagacgacacgatggccggttttatcaatgtactgcttaactaactcagcaaaatcatcaatgctgatttgatattctgtgctcaatgtatcaataaagccttgcgcatttgcttcgtctgagaaaccagaattaatcattgctgctttaatggtgcccttgttaaggtaataggcatctcgcaagtcttcccaagatttatgattagcatcaatcgcggtaatttgttccttaaaagcatctaacttaccagcttctgtcagctggcgttcaaggtcagcaatccaaaaatcggcatcagtaaatccttgcatttcattgaaaacacgcataaacactttcaagatgctttgtttatctgaaccaacggtatctttggcttttgcatcaatgttaaataaaatgacatcattctttgcagaagctgccgcgtgcatctcgttgagaatcatttggtcatcaatcttgtcatcgaagtaatcgacggcatttttaccatcaacaaccttgttggcaagaatatatgaaataatcttcaagaagtgagatttcccagaaccaaagaaaccagaaatccagacacccatgtcatccgttggcgtctgaagactattatcaaatgcattgaaaaaggccgaaaaatgatctcttagttcactggttacgacatattcgtccaactcttgctttacatttgcttcatcatcttgatcaaccttgataacaccttggatgttacgatcaattggtcgtttaaaaagctctttaatttccattccccaaactcctcctattcaactcgaaatgcacggtagtagttcttgtcatctaatttaccaaacgcgcgaagagacaaactgttataactgcctggataaaacatcacaacaggcgtttggttaatcacttggttcatcgtgttcaagacgcgatgtgcacgaatcaacggaaatatctgaccaacaccagtgagaaaaataatattgcgctcatctcgatgttccagatgatccaatatgtactgaacgatcaagttgcgttctttacccatttttaagacgttattgatttgcctaatcaccatatcaataccgtctttttcttcaatttgaatgaactcttgcagataacccatttcatcaatcagtcgaataacgacatcgaacagattaaacatctggacatttgcgccaattgaagcagtggtcgagttgtgcgcaatatcttcgacctcattacgaacgaataactcatcttttggatcgtaatcgaaaatatagaacccgacttcattcgagagccctcgattttcctgaaaagcaggatttcgtatttttttccgaaaccggtcaaagcgttcacttactaatgtcataatgctctccccgttagtgccaaaatataatcagacttcccattctgtttaagccatgcgaccaatgaagcctccagtaaagctcgttttaattgcattgcacctccggcatcttcagccaagccactttgcgttaggatttcgtgaaatctagtctgaatttttttcaaagtttgctgcgtccaatgagccgtttctggatgttgcagtggtaaatcttgcaagtaagcactaatctcatacggttcaagtttcaaatcaccagtcaaaaattcttttttcacaacttctaaaacaaagtcttctaccagaggatgtgcattcatgatcgcaattagattcattaacttctgattattgaggggtaactgctcaaaaagctcagaaaaacttgctggtagagctgaaattcgaaacatcaattctctttttaactcagtagaccgatttgttgaagacatcttgaagatgttgtcgtcaatgatggcttctgcaatgtcatcccaatccttgccattgttcagcattgagatcactgcagaaaattcaggaaaccagaaggtacgagaaataaaggttgccgaaaatttcttcaagttgatctcctttctaagtttatttgttcaaaagtcaacagggtcttctcactacaaaatactccttttcattgtatcaggatactaacatgattggggcaactttctggacttattagcccttcgaaacacttgaattcattacaactcaagtgattcttaagctgcacgcgattcaaaccaaatcgtttcacagatgagggtaaataacctacctacacagctgcgggcaactgcattatattcgctatcattgtgtatatatgcccaccacccaaatgtgctaaagtaagactctagacaccatcacatagaaacatctttggagtgagcaaacattggctaaagaaacacatcacgtcgtcatccccgacgccatcatggaagatcttgatattaaagacggcgagcaagttgaagttactttaaaagataaggaagccgtgattcggcctaaacggacggatacagggacgcagacgatttcgttacggttcttcctgattcccacgattttggctgggatcgcgtttttggcctactttatctactttcagattttgcaggtgccgatgacggggaagaactcgattgcgcagatggtcattgtgctgggcgaattgagtgggattgctacgtttgcggttgcttacattcagaatcatcgccagattcatgggcgggatcatcggcgccggtattggcgaatttttccaacgatgctgttgtcctttgcaattattcttgcgtttgtgacatcggtgtttttctgggtgattggctatatgtttgaaggcgtcagttttgatatttacacggcgactgggttgttcctgctgtttatcagtattgtgaactacctgatgatttattcggccttgtcgatttcgacctccttcatcacgaccctgtttctatcgaccttcgttggtggcgtcattggtgcgatcgtgacgaacagttcgcgccagtggtggcaacataacgtcagttttcttggcacgaacaaggctttgaatgcgtggcaatttaatctcaccatcgctgtgtcggccttgctgtggatcgcgctggtggattatctcttcgtgccactgatggcgcatcgcaaaaatgattggcggttgatcacgatgcggatcatgttgacggttgcggcaattgctttgctgggtgttggccttttcccgaacaatcgcggcctcatgcatatcttgcatacgcaaagtgcttggttcctgaattatttcatcatcggcatgatcattgcggttcgttggctgttgccaggcgtttcgcgcgaatttctaagcaccagttacatcatcggcggcatcatcattttcgctgcgatcctcttccagttcgtccactacttgtcactgacagcgtttgagatgatagcctttgccctcgcgatgtcatggatcatgttgctactgcaaaacattcaccggctttaccaaaaagacgagtctacgtttgtcgtgacggtgaccacggataaggttaatgctgactaattatgatcgattgtcgtttcttgacacgcctccatctaacgtcgtgacgacacggggaggtgctaacctcgctcagcgtactaaaatgcccccagtaccaacagacgcttgagacatctgttggtactgggggtatctttaagctaaaacgggcccgaaacgggcccgttttttagaatttttaggcaattttagggattttagcccaaaaacgggcccaaaacgggcccgtttttaacaacatcaagccggttcaaccgattcaaccttcacatcttcacgctgcaccgcgagcaaatccgcacctgcctgaaccgtggtatcagccgccactggctcgatccgtacataagacttgctgttggtaatcagcacgatagtagtcgcgtttagcccagcttttttaatagctgcttgatcaaaggtgccgagcaagtcgccttggttgacatgctgaccggctttgacggcgactgtgaatggtgcacctttaagattgacggtatcgatacctaggtgaacgaggatttccatgccatcatctgtcgttaggccgtatgcgtggccggtgtcggcgacgacggacaaggtgccggattgtggtgcataaactttgttgatgccaggttcggcaggcttgatggccatgccttcgcccatcatccctgaagcgaaaacgggatcgttgacttgatccaacgcaactgtttcaccgccaacgggtgcatagactttgttgtcgctgacggttgaggagatcacagcattggcggtttcgacatccccatctggcgttagcacttccttcgggatcgcaaacgcgttggtcgcgacaaaggccgcgacaacggtcccaagtgacacgatggtataccacaacaacgcatggccgttatagatgtacatcagataagatggcaccactgcaaggccatacgagttagcagcgacgttgagcatgcttaaaatcgcagcaccaattccggatgtcaaaacggtgacgatcaatggccgaaagttgtagcggattaagaccccaaacaacgttggttcagaaaccccgaatagttgtgaggtaaaggcacccattgaagttgctttagccttgttggaacgagcccgtaagaaaatgacaagggcaacgccgaggttggcaaagccatacatcgcttcaagtgtgatcaacggattcaaaccggttgaagcaagcagcgaagtttcgatggcgatcatggtctgatgaatcccgatgagaaccatcagtggataagcagccccgatcaggaacccaccgattccaaatggcagatggatcacggcttcaacaccgacaagcatgccactttcaatggcatggacaattggaccgacgcccatgatcatgatggcgaacgtgacgagcatcgtcaagaatggcgtgagaatctgttccaaaacgttgggcatgtgacgccggaagaatagttcaagtttggcaccgataaacccagcgaccaaggcggttaacacggagccttgactaccaacaactggcaaccagccaaacagcataatggccttggcactgccatcagcaactgaatacgcatttggcaaaattggcgaaaccagcattaaaccaatgacgatcccaatgatcggtgtgcctttgaagtagcggaaggtcgaccagacgatcagggcgggcaagaaagcaaaaacggtgtcagtgagcaccgagattactgatgtcaggctagccggtatatcgcttgggaccgctccgaaaagttttaatacttgcgcattggttgctgcacttttcagccctaagaacagaccggtggcagcaatcacaggaataattggaatgaaaatgcctgacagcatcgccattaatcgttgtacgactgtcttgtgctcgttgctggttttaccggctgtgtcggcgtcgtctttaccataaatcgcattcacggtgccaagcttagcaatggccgcgtagacatcgttgaccaagccggtgccgataatgacctgatattggccagagccatagaaaacacctttgacttccggcaacttctcaagggctttgtcatcaattgccttccgatctttcaccacaaaacgcagtcgcgtctggcaatgggtcacggaatcgacgttattttcaccaaccagctttaaaattgcttttgcttcttcttcatagtttttagccatgatcatttcacctcaataagaatcgcttgatagggttgtaaactcgttccaacgtccgggtaattgttcagccaaacgtgaccagctggtaagtcaactgcggctgacttcgagctaagattcacaaaaatttggacatgttgcccgcgggcataggcaatcacgttgtcgttgtgtgcattcagcggggcaaagtcgccttcgatcaaatcggcgcgcaatggcgaggcattccgcaggcgacagagcgtttgataaaacgtccagaccgaattgggatcatcgtgttctgcctgccagttcacgccagcagcttgcttggccagcggcaaccaaggttcatgaccagcgttgaagccgccattttggctgtcgtcccatggatacggcgtacgagcattgtcacgtgagcgtcggttgacagaggtaagcgcaacgtcttcggagtagccttctgccagtgcacggcgatagttgtcgtgcgcggaaagatcgttgaattgatcaatgttggttcgcaccgcattgaccatgccgagttcttggccttgatagataaacggacagccacgtaaaccgaagtataacagtgctaaggcttttgccccgatcgcattgcgatattgcggctcacggatatacttgcttaagcttcgcggttgatcatgattttcaaggaaattagccccccagccaactttttgaattgccagctggcttttggcaatcgcctcgccaagcattttcggcgtccagttggtttgcttgaaccactcggacccagaagcgacgtcaatgtcggcgtaatggaaatcaaaaatcattgagaagtagccgttttcgccaatgaagtcaccgagttgatcgtatgcaacgccggacgcttcgccgatcgtgacggcattggccggcttaaaggtggcagcgttcaactctttgagaaattgatccagacccggtcgattttccgttttgcgcttaactttgcctaacccatcgctgccatctggcgtgatagaagcaaaatcctgatcctttttgataaacgtaatggcgtcgacccggaatccggcgaggcctttggctagccaccagttgatcatgctataaatggttttccgcaacttcggattttcccaattcaggtccggttgttgtggggaaaagacgtggtgataataggtgttgggctcaccgggaaccgctgtccatgacgagccagcgccgaagtttgagcgccagttgttcggcggctgaccatcatgaccttggcggaaaatatagaagtctcgatatggtgaggcaggatccttgagcgccgcttgaaaccaccggtgctgatcggacgtatggttgaccaccaaatccattactactttgataccgagatctttggcagttgccatgagctgatcaaagtcagtcatggtcccaaagcgcggatcaatcgcctgatagtcggcaatgtcataaccattgtcaaccatggggctcttataaaccggcgataaccaaatcgtggtaatgcctaattcttttaacttcggtaattcggcagtgatgccaggcagatcgcctatgccgtcattattgctatctttgaatgaggccggatagatttggtagaaaatttcttgttgccaccaagtacggctagtttcgttcgtcatgactgtatcctccagttagctgatgctgtcgtatgaaaatatggtatcgattccatatgaggtaaaaataaaactcaggcgctttgcctgattttcaacgataagtgcaaggttggttgcgtgtcttgggcgacttgtcggcccaacccttttaacaactcgtgcgtcgctgctgctgccatcgaagcaacaggctgatgcaccgtcgtcagcgggattttagcaaaaggcgcaaacggctgatcgtcatatcccataactgcgatgtcatcaggcaccttcacatcggcagccaacagactgtcaatcacgccgactgcgacctcgtccgagttggtaaacacggcatccggccgcacattcggcgccaagctcgcgagctgcttgccaactgcctgcccttctttggctgtgtgaatttgaccaaacagtaaatcttgcgccactaaaagctgatgtgcctgcataaagtctaaaaacgcttgcgtgcggctttgtccatggtgggcgccgctgatggtgccaccgctgacatacgcaaaccggcgatggccttgattgaataaatagtcgagtgcatcacgggtcgcctgataatgtggcaataccagcgaagtagccccggggatctggacatcggcattcacaaccacaacccgccccggaaaggctttcgcaactgctgcaactcgatcaggggcttcaactgaagctaaaatgacaccgtccaattcgcgacttttcagttgcttgagaaaccgttcttcggcctcgggatcatcatatgtctgggtaatcatcacttggtaaccgtgggcatgtagttcccgttcaatcgcatcgaacaagccagcaaaaaacggattggtcacgcgggataccagaaccccgatgttgccagtggcttgggcgcgcaatgacgtggcggccgcactcggcgtatagcccaactgatgaattgctttttcgatccgcgtacgcttttcagcggagatgtagggatgatgattcagatagcgcgaaaccgtggtcacgccaacccctgctgctttagcaatttcactaatcgtcgccattccttgcatctccttttatatggaatcgatttcatcgatgagtatacagcgctttcaaaaattgtcaagcattgactaaaaagattttttgcgtcccagtctaaaaaagccttacgccgtgtcgccacaacgtaaggcttgcgatcaaagaccgccattatcctttttaagattccatgacacaacatcactggccgctgacggtggggtgatgcgtgccgcggtgggtgcttcattgccaaagaagcgaccggagacaacgcggtagccttggtcaatgaataattcgaacacggatacatcaatgaacaagcggacttcaactgttttcccagctggaaagccgaactggcgcaaactgccgccattattgcgattttcgcgctgaatcatcccctgcccgctatcagagtcgagatgaatcagcaactgatcatggtccgcatcaggcagatgaatcgttgtcttttgacctgccgcaagcgtgaaggctagttcaaaggcgccttccaagttggtaacggtccactcatcatcatgctgctgaatgaccggtagatcttccaccgccgtctcccgcagacttttgatagccgggtgcggatagaggcaaacgtgatcatcacgcagcgtcaattggcgcacataactcaagaccccggcccaaccatcatcatctgttgggtaggtggtatctggcaagccgagccatgaaatcgccaaggtgccatcatcatttgtattcgccagacgagtcgcataaaagtcaaagcctttgtcaatgttttgcagccgctggtgggttaagttaccagttgccggatcaaagttatcggccacaagggcaatgttaggatagacattttcatattcgaaaaagtcctgatcgaggccttgtgggcagtatactaggaccactttgccattgatgaacgtgatgttcgggcactcaaccatgtaaccgcaaaattcatcaggaatacttagcggtgccacaaaccgccagctcttgtcggtctgcttggcataaagcagaatggcgccggtgtgatctggacgctggccgccaatcaggacataggtctggccttcatagttaaacaagaatgggtcgcggaactcctgggtgtagccagtaggcggtgttaggattaatggcttcggatccttgaacaaccggccatcagcgccgagaacggcccctagctgggtgctatgccgatgccactgatcatcccgcgcattgccggtatacatcaagcgcaacgtgccgtgtgtcaccaacgctgatcctgtgtaagccccatgcgagtcatactcgttatctggcaatagatcgcctggcacccggcgccagttaaacaaatccttcgacaccgcatgcgcccacgacttcaggccatggaccgggccaaacggaaattgttgataataaaggtgccatttgttgttgaaaaagttcaagctgcacgggtcattgattaaaccagtatctggttgaacatgcatctttgtccgccatttactcgcagcaacctgagccttcaacttcataatataatcaggcgcccaggacgaatacggctgataccgcgccgccgtactccaagttgcttctttcatgaacttaccaccttgtttgaaatgttacccccatcatatatgagttaggggcaatgtcaatgaagacagataaacaggtttctgaaatcttgatgcaatcatttttgggagggctggttgaccaccgaaaagacgaggtggcgccgcggtgatccgcgaagctagcgtggtgggcacggactttgagccaacgggcaaatccggcacgctggctcaaaactcggccttctcctaaagcaggcagcccatctgctttaggaaaatctcaccactgagcccatcgccgcggaatcagctcaggctagcggataaatcgctgcccaagatagatcctgaaaagcgatccgcaacaaacaaacttgatgcaaaaaatccgcagcttaggccgcggatttttgattggccgatcggagggtggccgatcagcgattttttactttggaggagtaaaaatgaaaaagttgggttggggaaggaatgagtgggtggctcatttctatgttgttaatactacaagcgatgtgtgaaatttttgtgatggtaaatgggtctttatgttaagtctgttgattaaaatcatctgcccacgacagcggtttaggcagaaattctgcccgataatcatgaacgtattgctcaaagctgattgctgggcgcccgagaacatttggcaatgttgtcgtaaccgttttggcgttacctaactgggtgatcaagtaaagcatcaccatgacattgacatagttcttcggtagcccgcgttgcagcatgaccttgcgaaaacgccacaaactcggcttgctataggtgatcggcacaccgagttccatcgtcatgatctgagcagcatcggcgtaggtgagcgcttgggcgccggtaatatcgagcttttggccaatatatgccggatcgcgcaggacaaccgcagcagtcgcgccgatatcacgggtatcaatgaaactagtgcgagcatgcccagcaggcacaaacagatcgcgatggccgacgatatcagcttggtgggtggtattcaaattttgcataaagaaacttgggcgaatgaaagtataaggcaaaccgagttcaacaatccgtttttcgatttgatgatgcggcgtcattggattatgcgccaccccaagtagtgacacaaaaacaacttgcttcacatgtcgagccaccaaggcatcgagaaaaggatacatatcctctttgggcttagccaattgtggcggccgaacgaagaagaccttgtcgatgtcagctaaggcttgctcgaaagtggcaggatcgagaaagtcaaaccggcgtacttgaaccttcagcccgcttaacgcctgtttggcatgttccgaattgtgcacaccagcaaataggtgaacatctggatcatcttgcaagtcgcggatcagcggttgaccgatattgccagtagcaccaatcactaatagatttgtcaataactttctccttataaagaaaaagtgcctgaacaggcacttttttaatctcgatcaccgcttaattatcgcggttgatcctattcatacatataagcacgggttgccggcagatcttttccagacggccccttgctgatcaaatactgcatcacgtcaatgttgccagattcaaagctggcagcggccgcctgcagataaacatcccacatccgcgtaaattcgtaaccgaatttttgctgaatcggattgcgatgattattgaaattggtatcccaaatctcaagtgtgtgttgataatgacgccgcagtggttcaagatctgcaacttgcatgccagcatcgacaatgtgattaaggttttccgccatcccgggcacataaccatccgggaaaatgtatttgttgatccatgcgtttaccgcgccgccttgttgtcgcgtgatgccgtgaatcaatgccacaccgtcatcttttagcaacttagcgacatctttaaagtagccttctagattttccttgccgacatgttcaaacatgccaactgatgtgatgtaatcaaatggctcgcgattcagttcgcgataatccatatacagcacctcagcgacatcggatagatgttctgattcaatccgatccgaaaccagtttaaactgttccttgctcaaggtgatgccgacgaccttcaagtgataggtcttagctgcgcgtaacatcaacgtgccccagccgcagccaatatccagcaatgtccgccccggctgtggattaagtttccgcaaaatatgatcaatcttatttaattgggcggtttctagatcgtcactccagtcctcaaagtaggcacaggaataagttaaagtcggatccaaccacagtttataaaaatcattgccaagatcgtagtgagaatgaatgtcttcttttgacttatgttcggtatgactttgcttcgggagaaagcgcatgagtttcttgttgcgcataaaactgcccgcattcgcataagccgccgcgattaattgttgcaatggccgtgtgccgccaagcacttcaatgtcgccacgcatataagcctcacccagtgccaacgatgcatttttcagcaaatcacggaccggaatggcctttttcattttaatcgtgatcgttggctcacctgtaccatacgtttcttccgtatgatcccagtagtccacgcgaaccggaatattgaaagagtgactgaacatggtatgataaaactttttttcaagcatgatggcctccgttttgagaagttacaagaagaattatacggctttttaaccaaagaaaaaacaccgccgtgaaaatggacggtgtgtagccgttttcatttaaaattttcgaaaacgctgctgtcgcttggcaatcagtgcctgcggatcagtagcaactaattctgcgagcttgggcttgatcgctgccttcaacgtcgtcgcgaaagtcgtaccggtatccggaataatgcgatcacagaccgctttagccaataaatcttgcggggtcagttgcatgaccgcggccgcctctttagcacggctggcatccttccacaaaatagccgcaaaaccttctggggatagaatgctatacatgctcttgtccgtcatccagacctcatccccaaacgccaaagccagggcaccgcctgacccgccttcaccgatcaaaatcgcaagaatcggcgttgggagatcagcacaggtgtataacaaatcagcaatagcggcgccttggccattggcctccgcctctttgccaggatatgcgccgggggtgttaatgagcgtgacaatcggtcgatgaaacttgactgcctgcttcattaaccgtagcgccttacgataaccccaaggctcaggactgccaaaatgcgtctgcaatcgctccgttaggtcttgccctttatccgttgcaatcacggtcacggcttgctgatcaagccagccaatgccgccaatgacagccggatcatcgtgacttgagcgatcaccgtgaaattcatggaagtttgtcaccaacccgttaatcagttcccgcgtgcgatatggtcgtggtgctctggctgcttgaactgtctcatacgctagcgtttctttatccgtcatgcttgaaagcctcccttattgctgcaactgtatgcctgtcaatgtgtttgtcagacggctacgcgtgatatgaagaacgctaggcaaattgatccaagatggcaatcaatccgtctagcgtcgcgtcaccatgcctcatcaaatgtcactgctcaggctgtgtgcaacgccaacaaatcccctaaataactaggctgatcctgccgctgtaccactgcatcaataaaaccgctttgcaaaagggtttctgctcggtgaaagttttgcggcagcttttggttaatcgtttgttcaatcacccgccgacctgcaaaaccaatcaaactgtgcggttctgccaacgtgatatcaccttgcatcgcaaaactcgcggttacgccgcccattgttggatcggtcaagacactgatgaataacaagcctgcattgctgtgcgctttaactgcggcacttactttggccatttgcattagcgaatgaataccttcctgcatccgcgcaccaccgctagcgcagaaaagaacaactgctaaattggcgctggttgctttttcaaataaccgagtcaaccgttcgccagtcacagtgccaagtgaacccatcatgaactttggatccatgataccaagcgcacagctttgaccgccaatcgtcgcctgacctgtccacacactgtctttcaaaccagtagctgcctggcctgctgccaatttctcggtatatcccgggaaatccagcgggtccgacgtcacaagatcggcatcccattcttctgttgctgtcgcgataagtgaccgtcgttttttagcagtgattcgaaagccgtagtggcagtgcgggcaaacttgagcattgcccaaactctcacgatagctgccttgcttacaatacggacattgaatccacaagttttcgggtaaggctgcctcacgagcaagtgcttcttgggtcagttgtggttgtgccatgcagtatccttcctttcaaaacgcgttcacaggcccagaaaccgggctggttcgcgcgcctctgcttaaacgcgctcgcaggcccagaaacctgcacataaggacctcaagcctaaatggccaaagcccagccatttaggcttgaggccacttatgctccggtttctaatcgggcctgctcacgctctgccattttggtaaaaagtcgcgattgagataggccgtatcggctttgccggccagaactgtcggtgcttggaataacgccagcgcaaaatcccggttggttttgacaccttccacatgcaattcaatcagtgcacgatgcattttcgctaaggcctcgtcacgggttcgcccatggacaatgagtttagcaatcatggcatcataataggggctgatcttatcgccaggcgcaacgccggtgtcaacccgcagccccatgccgccggttggaaagcgtagttgttcaagggtgccaacatctggccgaaaatcatgataaggatcttccgcgtttaaccggcattcaatcgcaactcctgatggttcaggtgtcgttaatgccacttcatcgccagctgcaactcgtagttgagcttggaccaaatcaacaccggtcaccatttctgtaattggatgctcgacctgaatacgcgtattcatttccatgaaataaaaatgatgctgctgatccatcaagaactcaatggtaccagcattgagataatcgactccttcagcaatggtcgcagcgaggtgaagtaactttctgcgttcaggtgacgtcaagactggacatggactttcttcgaccatcttttgactgtgacgttgcaagctgcaatctcgttctgggaaaacactggtatgcccgtgcatgtcgcgtaaaacctgaacttcgacgtgtttggcagggacaatgactttttcaagatacatcgtcggatccccaaacgccgcttgagcctccgcttgggcccccgcgaattcagccttcaatgcagcagcatccgttaatttgcgaatacctttgccgcctccgcctgcgctggccttgagcatcaatggataaccaatggcctcccctgctgccagcgcggtttcaacgtcctgtaaaggatgactgcctggaatcacgggtacgcctaagtcaatcattgtttgtcgagcaacggctttgtcgcccatttgatcaatggcagtcggttttggcccgataaaggccaatccggcatcggttacaagtttcgcaaactcggcattttccgacaagaagccgaacccggggtgcactgcctcggcaccgctcaaaatagcggcactgacaacattgcgcatattcagataagagtcggccgcccgcggtccgccaatacagatggcttcatctgcaagggtgacatgcaggctgtgacgatcagcgtttgagaacaccgccacagaggtgatgcccatttcgcgcaaggtctggataatccggaccgcaatttcgccacggttggcaacgagtacttttttgaacaaagttccacttcctcacacaaatctggtttcaatggcagtttcagccaatagcaaaaactaaatccgcactgctggccatgttttcgccaacataaattttgcctttgcccaaacctgcattgtcaatcagtctctccaaggtcacttcaatccgcagcacgtcgcctggacgcaccatgtggcggaacttggccttcttaatgccgccaaggtaggctgtctttcctttgaagtccggcatcgaaagcaatgcaatcgcgccagcctgcgccatggcttcaatctgcaacacaccagggaaaattggattaccaggaaagtgtccctgaaaaatctgttcgttaattgaaacattcttttgtgccactacggattcaccgggcttaagatccaagacccggtcgaccattaacatcggatagcgatgcggcaaaatggcctgaatttcttgtgcttcaagtgttttcttggtttcgagcataatgccctccttttaaacgcgttctccagcctagaaacctacgtataagagccctgaacgcaatgccatcaggttcaggcccgcgtacacaccgatttctaaacgctcctactcacgctctgtcttcttcaattgtgactaatgcctgatcatattcaacgaggctttcattgtcgacgttaatcgccttgagtgtgccgctgacggtgcttttgatttcgttcatcattttcatcgactcaatgatgcagaccacctcgcctttgttaacgtgcgcgccgacttcaaagtacggatcagcgtcaggtttaggggaaagatagacaataccgaccaatggcgccttaatcgcggtgcctgtcggagcttctggttcagctggcaccgccgtttccggggttaccggttgactaggcactgttgcctgagtattaacaattggcgctggagccgcacttgctttgaccagatgtaaagaatcgttgccaagcgtcagctctaattcatgcaaagaactttgctccaactgtttgatcaggacttcaatcatttcggtgtccatgatgctcaccaccttttgaaggccaagaccgcattatgcccgccgaaaccaaaggaattgctaagtgcatagtcaacttcgacatcgcgattagcggcatccaccaaggtgactgggcattcaggatcttgctcagcatcaccgacattgatcggcaatttaccttcgtgcaacgcactaatcgtcatgatcgcttcaatcgcaccagccgcacccagtaaatgaccagtcaaagccttggtggaactcaccaaaacatcgtccccgaaaagatcgtggatcgccttgctttccatggcatcattagccttggtcgccgtgccatgtgcattgatatagccgacatcacttggcgcaatcccagcttcttcaatcgccagttccattgcccgtgccgcttgatggccgcttggatcaggcgccgtcatatgataagcatcgctcgtagcaccataaccaacaacttcgcctaaaatgttggcaccgcgttgttgcgcatgttcgaggctttccaagataatcgcaccgccaccttcgccgaggacaaaaccgctgcgatcagccgcaaatggcaaacttgctttggccggatcggcagccttggataaggcagacagggctgcaaaaccagcaataccgatttcgttaacagaagcctcggcaccacctgtaatcacaacatcggctttaccactttgaatccgcatggctgcttcgccaatggcattcgtggctgaagcacacgcagtcacaacgacatagctcggtccgtgcgcgccaaagtactgagaaattgtcccggcgaccatgttgctaatcgcttcaggcacaaacagtggacttactcgatcaggacctttggcattcatttttgtgacttgttcctgaattgttgtcaagccaccaatacctgagccaaaaatgacagccattcgtttagaatcagcatcatctttagttaaacctgactgttcatatgcctcgattgcactgtaaaggccatattgcgtgaaaagatccagccgtttgctcagccgtttttccattcgcacttcaggtttaaaaccttcgacctcaccagcgactgtgatcccggtcttctcggcatcaaacttagtgattggccgaataccaatcttgccagcatccatcgttgccactgtttcggcaactgaatgacccagcggattcacagtacccattccggttacgactactcgttgcaatgtcattcctccgttcatgtacttagcctaatccaccagcaacagttaatgtttgcccggttatgtaggcattttcgaccagaaaacgggccgcatgcgcaatttcctcaggttgaccgaatcgctttaacggaatctccgccaaaatctgatcctgactagcctgactcagcgctgcggtcatatcggtagcaatcatgccaggtgcgatcgcattgactcgcacgccacgcatggcaccttctcgtgctaatgttttggtcaaaccaatgatgcccgctttactagctgcataattggcttgaccgatgttcccggtcaaccccactacactggcaagattgataatgacgccagtgcgtgccttcagcatttttttgaatactggctgactcacatagaaagtcccatctaagttgacgctgacaacccgggcaaaatcttccggtttcatccgcatggccaacatgtcactggtgattccagcattgttgactaaaatatcggcactgccaaacttgtccagagcggttgccaccagctgctgaccggttgctggatcgtcaacactgccaaggacagtgacgacgccatgaccaaaggcttcaagctctttgatcaactcagtgggaaattcgtggcgagcgtttaaaacaagatttgcgcccgcttcagcaaagtttcgggcgatcgcttcgccgatgcctcgtgaagcaccagtgatgatcgcggttttatcagttaatttcaatctgccttcactccgttattcaagtcaatgactgcattgagactcgctgcgttactgatcaagtgtgtggtcatactgcgatcaatgcgcttaatcattttgctaagcactggttttggtcccagttcaatgaccgtgtcaataccagctgccttcagttgccgcaccacatcagcaaacttagtcggttcagccacctgggccgccaaaattgaccgcatgttttcagccgagaagggctcaagggccgtggtactgatgaccggtgtagctggatcaaagacatgtacttggtcaagggcagcacgcaatggtggctgcgcatcagccattaacggactatgaaatccgccagcaactttcagtggcacagtgcgaacgccttgatctgacaaccacgcttcaacctgcgccaagccagccttgctgccagccagtacggtctgtttagggccattgtaattggctggccaaacatcagacgcttgttgacaggcagccgcaatcacagcagtatcgccagtcatgacggctaacatgctgcctggatgggcctgacaagcagcggccatcgccttgccgcgggcagcaaccagctttaacccatcttccaaactgatcccgccgccagcaatcaaggcactgtattcccctagacttaagccagcaagtgcggtttcatcgggcaatgccgcagctgctacttcatgcatggccacgctgtacgcaactaaagccggttgcaaagcatccggatgagcagcaaaatccccagtcgctaaaaactgcggcagatcgaagtccaaaactgcatcagcgcggtcaataatctctttgaatatcaaagtattctggtaaaaatcaatccccattccggggacctcggcaccttggccattaaacatatatgcaaaacgcaagcaagtacctcctcgtttcaatgcggacgtttgccgttaagcctgtgcctgcacatcgacttgacctgtcaataaggccgccatttttgagccagccaaaatttctttggcctgacgcatcacgtcctcaacaatgtcttcgctgctttcttcacgcttaactaagccggcaatctcaccagccatgaaggaaccgtgttcacgatcgccttcaaggacggctttacgcaaactaccattaccaagttcttcaactgccgaaaaatcggtcgtgtcagaaagggcaattttcttttcaagtttcaggaaattccggctcattgggttcttcaaaacacgggcagcatgaccgacatacaggccggttaccagcgtatcaacgtccttggctttaatgacggcgtccttgtagttctggtggattcggctagacgttgacgtcagaaaacgcgtccccatctgaacaccgatggctcccaaactcaaggcagccgccacaccacggccgtcagcaataccgccagctgcaacgacgggaatatcaaccgcatcgacaacttgtggcactagggccatcgtggtaatgctaccaatatgaccgccagattccatgccttcagcgataacgccgtcgacaccgtcttttgccatccgttttgccatggcgacagacggtacaaccggcatcacaatcgtgccattttgctgcaaccgttctaagtagcggcttggatcaccggcaccagtcgtcacaagcgcaaccttagcgtcaacgatcacgtcaatgacttgttcgacaaatggtgaaagtagcatgacattcacaccaaatgccttgtcagtcagtgacttggcaatatcaatttgctctttgacccaagaagctggggcatgaccagaaccaatgatgcccaagccgccagcttcagaaactgatgcggcgagcttgccgtcagcgacccacgccatgccgccttgaaaaagcggatatttaacgcccaagcgttccattaatggactcattggcccactcccttcaagttgtcttaagcttcagccttttcggtgatgaagttaacaagatcagccaccgtttcaatgctttcatcggtatcaatcttaacgtcgaattcgtcttcgatttcgttgatgatttcgaaaatatccaaactgtcagcatccaaatcattcttgaagttggttgtcagttggacttcttccggcttcttatccaattggtcagcgataatgttttgtaccttaggcaatacttcttcgtttgtcatgtttaatgttctcctttaaagttaactattttgtaagcgccagcagaagcggacccataagctggcttctgcgactgcgagcgcatcagactcaaacatactgctaataagtgacgatcaacgagccaacggataaaccgccgccaaaaccgctgagtaccagccgctgaccgcgttgtaagcgaccgtcttcagctaattgtgccaacaagatcggcacactggctgcactggtgttgccatgctcatcaatattgatgggaaacttggcaggatctgctttcagctttttggtgactgattgcacaattctggcattggcttggtgtaagagataccaatcaacgtcatcaaccgcaacggctgcctgtgtcagtgcccgattgattgagcgtggcacttcggaaatggcgaattgataaaccgctcgcccattcattttgaaaaatggggacggcttagctgagggtgcttcggcaaacggactgtgattcgtctgttcaccagcaaccaaagccatctcagtatcgccgaaacttttaagatccacggcctgaaccgggaaaccttgatcattgatcaaaaccccgccagcaccatcagcaaacaatacggccgttcgccgatcatgccaatcgacaagccgagaaagcacctcgctgccgatcacaattccttgatgaaccgttggactcgtcatcaggcgatccgcaacatgtaatgcatattcaaagccggcacaggcaacattgatgttaaaagcaaaggcgtggtctgcctgcaaggccgcctgcaaccgattagcctcagctggcgtcgcataatccggactcatggttgccacaataataaaatcaagttggtctgccgcgacctgcgctttggccaataactgctgagcaacatcgtaagctaaatcaaagtttttttgattggtgacgacatggcgcgctttaatcccggtgcgttccttgatccaatcatcggacgtatccatgtactggcgcaattgatcattctcaatccgcgtggcaggtaccgaataggcactggccagaatctccaaagcgggtccttctttctaatgacgatattcgtcaataaattcattcagattatccagtgcacgctcgatcaattcgatctgtggctcggtaaatcctttgacgaaactcgcaaccattttttgatgaaaggcaagatgggcacgatacatcaagcgacctttgcgactgagccgtaaattcacaacgcgtttatccgactcaagatgcaaccgctcgacataacctttacgcgctaaattgttgatggcaacgctcaaagtgccttgggtgacatgcagtcgtttagcaacatcgcttgaactcggtgtcgcatgaatgccgatcgcatcgatcgtatgcatttccttgatgcctaaatcgcggaactgacttttacgcagttcttcttcttccattcgtaaaatatcggtataaactctgatcaatttatcattgatccgcttgacgcttggcttttgggacataggtgtgcctccattgacaactgatttgatattcaaagtatcagttgaaaaaaatagcctgtcaagtgagctaagcattggcttctaccacgaaatgcaattctgcgtggcaaaccaattcatctccgatactggcagtcgtcgcaacgacccccatattctctcgaaccttaaccattttgatcgccagtgttagtacactgccggttggaacttgtgctgaaaaatcagctttactgatactgcctagataagctgttttgccagcaaactttggcgattttaaaatcaaaatggatgccgcttgcgctagtgtttcaataatcagtgttggcggcatcgttagttcatctggtagatagccgaccaaatgatcctccgcaacactgacatacttctcagccaccagcgattcatcaggcactaactcactcacatgatcgatataaaacaatggatatcgattcggaattaatgcctgaatggttgaggtatttaaagttgtcatagcttcgcctcctcttttcaaacgcgattgccggcctaaacgttgcctgctcacgctttctttttaaacacggtcgccagcccggaaaaaaccgggccagcttttttcaaaacgcgttcgctgacccagaaatctacgtgtaaggaccctgcacgcactggccaaagtgcggccatcacgttcaggcccacttacactccgatttctaaccgggccagcttttttcaaaacgcgctcgctgacccagaaatctacgtgtaaggaccctgcacgcaatggccaaaatgcggccatcacgttcaggcccacttacactccgatttctaaccgggccagctcacgctctcaactaaactagttgaatgttcaaagcatatgcagaactgctttgattgtcaaaccttttttatatttattatcttttgagaatattgatgtatcagaatgaatacggtctcagataatatggttaaggggtttaagggttaccgaaaaaaggctaactatgcaaaaaaaaatctcgacttttttctggttttcgttgtcaaaaatggcaaaataaaaaagctaaagttgagaatacacaatagcttttttacaaaattcggttgaacttaccactcattagccgatgtttgggacacggcagcacgcaaatggttttcttttagccgaagtcggacaatggtgccaacttttttgggatcgtcaatccacggttcatgtcctgccccattcacggttaacagttcaccatgttgcacgacagcggcgatttcttgaccgagttcaggattcgcaaaggtatcatttgttccccagattaacgtcattggaacagacagctcgcgcaattgcgactctttcaatgcattgtggtacttttcttgattcatcgtccgtaataaggacaaggttgccagctgatagtttggcaaatgatcaaatgcataaacacagtccgcaaagctttgcggcaaagcactgacggcagccggatcagtccccatgcgatgcagcggtccccaagcgcgtttggctgatttagggatttgacgtttcatgaaccatttaccaagacctggcatcatcgccattttgagcaatgtcggtgttttggtcataagcattcggccgggattacccagtaaaatgagctgctgaacccgatctggataggccagcgcaaaccaagtcgcccaatgcgcaccgatcgaatgagcaatgatcggtgctgatttgagatcaagcttatccatgacctggctgaacaaatccacggcaaaattgtgaacatctacttgctcatgatcaaatccatcgctcaaaccgccacctgggcgcgccatgacaaaaacatgatagccgactagttgcggcaacaacggcgctagcgcatatggatcaccagtattgccgggcacaaccagcacggggtcgccatgaccaaactctaagacccgaacccgcaaatcatcaggcgcaattttaaaccagcgcgtcttaggctttaagtgaaagtcagcccagagttgattttcagcgtttcgtgccgcctgaaaagcaacagaatcatgttcaagaattggttgcgtcaaaaaagaaccccctttaaaagtggcacaacactgtcaggtatagactcgttaccgctaacacttttatgccagcccatctgtcatggatgcttgataaatcgtttcgacatcttctaccgacaacggcacataggcgcgcgtttcaagactagcattggcaacagcagcagtcgccatggcatcaaaatgctgagtatccttgatcccgacttcaggcaaggtcatcgggaaccctaagcgactaatccaatcaaaggtcgcgtcaatagccgcttgcgccacggcataagattcatcaccttcaagatcccagacatggcgaccaaattgtgccaacatttctgctgtcgttgcgtccttggtcagaataaacgacatccaacgcggtgttaaaatgccaaggccgacaccatgggtaatgtcataataggctgacagttcatgttcaaggctatgcactgtccagccattttcgttagcaacactcacgataccgtttagcgccatcgttgcgctccacattaagttggcgcgggcatcatagttatcaggttgtttcaacgcaatgggcgcccacttaataactgtacgcatcaagccttcaatcatgcctttgctggcgtcattattttttgaacgatcaaaatattgttcaagcaaatgactaagaatatccattgatcccgccgccgtttgtctggctggcacagtaaaggtcagtgacggatccaaaaatgaaaccgctggtgtgtttggcccgactgtgccgagcttttcatgagtgacaggatttgaaatcacggaaccgctgttcatctcactgcctgtcgctgctaatgtcagaatatcgacgactggcaattgctgcaattttcggcgggttacgccacgatctttgacaagatcccatgggtcgccttcgtaaaacttggcgctggcaatgacttttgcagcatcaatgacggaaccgccaccaactgccaaaacaacatcaatatcctgatccttcgccagcttttggccagcacggatagaatcgatcttcgggttcggctcaatgcccggcaattcggttaactgcaaatcagcgagcagtccagtcacggtatcgtataagcctgactttttgatggaatggccaccataaacgaacaaaacacgcgaaccaaattgactcaccgcgtcgtgcagctcaacatctaatcggcctgtaccaaaacgaatatcggttttattctgaaatcgaaaattcttcaaagttatcgctccttttttgagtgtgaacctgatcgtttcttattactttaattgtaacggttttaagggtaaaagaaacgcgaatagtggcaaattctcggatctcgttcagttgacgggtatcgatgaatccagctggtaacgtggtgactcgctactttctcccaaactggtaaggaatgaacgccggcatgttcctcagcacacaaaaaaagcccgacttaaacagccggactaccaacccactttttttcttagtgactcgctttaaccgcgtaaacaacccggattggagtggctcgcacgcgtaataaccgtgcggcctccacattgccatgggccgcgcggatgcataacatccgccgtgcctgctttgccactagcaatgtggggaagtttttagggaaaagtaaagcgaataactcctcattcgtcgcgccaatcaatgataagggacacctttctgcttgctgtaatttgtgcatagtgtagcatgtttctcagcaggcgccaaggggtaattgatgtttttgttattttacttaccgagacttaatttaatcggcctttggcaatcaaatcggtatttaaaaaccagtgtacggccggatcgccttgtaggcggctgtaaggtagtggcgttttcccttgtgcagcaagttgcttgttgaggtaattccgaagaatccaaggctcttcaatttgatcaacctgcaattgcaaaaccgcttcgacatgctccggcgtggtcgcaagatcttgggcagcttgctcaagtgtgacgccagccaagttaaagttagctgccagttctttcttcgtgttgcgtcgttcaatgatggttaaagacataattttgctcccttcaaagggtcataaacgccggcaaggttattgcaaggctttcaacacttgcttcaacgtcaccgtcagtgcttctggatcaggcacgtttgccgcaaaggccttttccagtacttgaaacaaatcacgaacttgctcggcggttgtctcgccctcatcagtcaaaaacagttgcagctcacgttcgctgtgcggtgccattcgtttttccaaaagcccgcgttggatcaaacttttaatcaaattagacacgctggccggtccccgacttaattcgacactgacctgtcgttgattagcgcctggattagcggcaataaacgtaagcaccttggcttgatcgctattgagatccaaattgcttaaatgttgattcaaaaaatacttctgtagttttgcgagctgataaatcagcccggaaatgttcgattcactttgcatcatcaaaaacctccatgataaccagtatacgtctttctgtttcatatgcaacagtttcatggacaccttaatgctgcatcgttttattttgtaaaaatgcgtcaggtcattagcagcgccgcgcgcctactcagaaaatgcatgacctgcgacggatctggatcattatccgtcagttttgtccaaacaaaagtcggtcccaacgaaaagaatcccatcgttagaaccgactatttttcaatatttaattcggagaatctcagtcaccatcgtatatttcaagcctgacgactagtcatcatccccatgaattaacgtccacttaccggaatcatcgttaaacttgctcatctgatcatggatttcatcatagcggtatttaccgtgcaaggcgccgctatctttatcgtaaacatcgacttccttcatgttagttgccggagatgtcacctcgacgcgatagtcatccaaatcaaaatcgtcataatcggccgccatttgcgcaacttcacgattgcttaaatcactgtcactgcgactctcatcgtcatcgcgactatcttcggccgattcacgggcattggcgagtgattcgctggctgcttcttgagaggccgaagccgaagttgattcagccactcgtgaatccgaggcggatgcagccgcaatcgacgaagcagaggcactcgccgccgctgagctggatgaatccagtgcctcagttcgagcttgctgctggcggttttgaaagaataagaaagctgctagcaaaacaacagctgccaccaacacaatactaacaatgacccaaggacggccatgcggttgcttttgcccaccgccaccatttgatcgccgacgcgtcgcattcggcggcacagcccctgaagccagtggctgttgtcctgatggctgactggtttgcatctgaccattcacttcactaccttgtccttgcgccggttgttcttgtgccaggccacccttttcagcacgatattgggcaagattaaacccgcaattatggcaaaaggcttcgtcagcgctaacttgtacgctacaatttggacaatattccataaaaaaacgccccctcaatttctttgctgcaagctagcgcagcttttttaaatattagttggttgttgctcttggtagctgttgcagcaaccactgatacgctgctggcaacgcctgctgccaatagttaaatccatgtgtgccagttgctgaccagctggtagtcggtgtcacccccactgcctgaagctgtgaggcaaaatgagtgacatcagtaaatggcacagttgtatcagcttgtcctgacgccaaataaactttcaaaccagcaagtcggtctgccgtcagcatgttggcaggttgatcggcatcccaacgggcctgatccgatcccattggccatgagttaaaaaggctggcattcgtgattgggccgcttcaggtacctgctgccaaactgcaggcgacaaagccgcggcgatccgaaactgttgaggttcggctagcaccagtcttagggcaccatagccgcccatcgacacgccgccaaccgcatgggcatccgcctgcgataaaagcgcaaattgttgctttaaatgtggtagtaaatcttgcatgattgccgtctgcattttttctgctggcgaatcaacgtaaaaactattgccaccatccacaaacaccaccactgctgggtgaccagtcgaattaacagcttcatcaagtaagcttttcgaatccactaactggaccagattggtgtcatcgccatccatgccgtgcagcatgagcactaatggataacgtttgtgcggatcgtagccagctggcacataggccatatatgaccaagatcgctgtagggttggcgcggaaaaggtgaacgccgccaagctgctacttgtttgcgctaccgttgaacccgcaatagaaggagcggtctgtgacggtgtcgatgctgcttgcgtcttcctgctagaccgcttagttatggctgactgccgctgacgactaacagtcgcaggcgcgtgcggctccgccgattgagaatgtcgaataaatgctcctattagcaaaaacatcaacacaccgaaaccagctaagacccatgtcttaccgcgatgcacaggttaagcccccacgatataccagcaaccaagcacgccttgaccttcctttatcttttttcaagtgcctacccccaggaactgacgacagttgtgacctacttcttaatcctacaacactgacggcatttacagaacatcttttattttttgatcgaaaacaccatcagtctctgggcaacaaccgggcggtgacgaacataaccaacgccgcgccaataccgacagaaaacccgatgccgggattcagcaaaccttgaatttggttgttggcactgctcatcaacggcgcataggcaaaatataaggccccgtagcctaacaaacctaacatgccagcaaaccgcatcattccgcgtgaccgaaaaagtccgaacaaaaggcctaacactgggcctatccccgctaaaataagcgctaagtatggcagattggtttgaggcgaagcaacgccagtattggttgcagcagtttccgccaaggtgacagcactgcggacaagatcatacaaactgccgccaacattggccgtggcgacactgccagcaccaaatggccaggcataggccgctgtaaatgccactaacgacgcgattaagtaaaccagccaaatgatgccgcctcttcgtctcggttggcctgctgtagttccaaggtgcgaccaccaatgcggcgaacgattgctcattttctgtgcttgctgcgccatcgggccattgtccggctgcgtcatatacggattaggatacggtggcaccgattgacccgctgctggccgcggcgctgtccaaatatcatcatctgagtcacctgaatcgtcatcgttaaagcgactagtataagacgccactggtcggcgatttgcaacaacataaatggcgacagcacagccaactgccaacacccatccagcgatcgttgaaaaactaaagacacaaaaaagtaccatgactccgatcaaggtatacaccatgtgagttgccaaccaatcgataaaatgatcgaaactatcgtcagttaggaccagactctttttgatgctggttgaaccactttgccgctgtcggcgtgagcgttctcctcgtacctgttcacgaaccggttcagatgcagctggttgttgtgactgctcacgaccaaagtccgtctcgccagcaacccgagcattgaagattgttaaatctgcgccgcaattcggacagaatttggtcccagccggtattttgaaaccgcaatttggacaataacgcatcgtctctgccaagctagttccctccattttcatactattagattcatcttgcatggttcgcggctaatagtaaagtttcggcgaagttttttaacgaaaactcacttagttgtcagtattggccaactttattcgccaactgtttagcaaagatgcgcgattggatcatggaaaaagctgcagactaaaagttctttgtcgtcccaaatgccacaacctctggtcagagagggctgacgacgcggggctagcgcggtgccggtgcttcgagccgcctcatctagccgtcgactactctgccttggcactgtgatctttatctccaaaatatccacgagaaaacaaaagccgactgatttccctatgaattgcggaaaatcagccgtctatattgacagctgtcaattaaatcgcagcctgtccattcaagtcactatttagaatcgatggtcaaagcctcgtgggccgccgccgaagccacctgggtagccgcgacgtgggccatgctcgtgatgaccgtgatggaaccgtgcggcccattcgcgcatatcatcgaactgtttgccttctggccagctaaggtcatccctagttgccaaatcggcagacaatttttcaatcaacgtcagtaattgcgcctgctcttcttcggacaaaccactgaaaatttgatcaggtaaatccgtcttcagtttacccgtcgtttcaataaattttttaccgtcatcagtgagcgcaattagctgaacgcgcttatcggtttcggactcgcggcggctgatcaaccctaaatcctctagtttctgaactaaagcggacaccgaacttggccgaatgtccaacgcctcaaccaaatctgaattcgtcagttcacctttattatcaagcagccgcaagagtcttaattgatttggttggcgctgtcgatcaccaaaacgcaagctgctagccacggcacccatgaatggacgcttttgaattaagccgccaaaggccttcaataaatcttctgatgtttttgtcatcgctattctccttgtcttttagttagtctactattccatgaactaatagcacgagtataatccgttagttagtttttgtcaagactacctacttttaacgtttacgcggcctttccgaactgatctttaacatactcgcgataaattggatgcgacttgatcaggtcctcatgtgtgccgcttccgctcaccgtgccattttcaatgaagtagatccgattagcattcataatcgtgcttagccgatgggcaatcacaatcgttgtacgaccatgcattaatttagttaatgctttttgaaccatcatttctgattcggcatcaagactagcggttgcttcatcgagcattaaaatcttgggatcccgaagaaatgcgcgggcaatggcgagtcgctgtcgctgaccgccggaaaccttgacgccacgttcgccgacttcagtatcgagtccctgcggcatggcctcaacaaaagtttttgagtacgccatatcaagcacatgccataattcttcatctgtatagttgcgcgtcgccccatacgtcaagttataacgaatggtacctgccataattgttgcgtcttgcccaaccagcccaatctgttcacgccaatcttcaacattcagatttgcgatgtcctgatccccgatcaaaatgtggccgctatcaggcgagtagaagcgttctaaaaggctgataatcgttgacttgccgccaccagacggaccggcaaaggcaatgacctgattaggtgcagctgtcaccgtgacatcttttagcaccggcgtttcctgatcataactaaagctgacatgcgacattgtcaaagcttgaccactggcatcttttagcgggcgacctgtacgactttcctcaggttgttgcagtaactcatcaatccgcgccgttgacccgctcgctttcgctgtctccgcaaaaaactgtccaagcgttgaaaaaggcccaatcaactgggtgagatacattaagaaagcaaacaaggtccccatattcattgacccgcttgcaacccgactggcaccatatgcgagcacgcccacaatcatacccatcattaacgtcgtcattactggctgggcaaccgcgtcataaactgcttccttcaagcccaagcgatacaaacgatcaatgcgggcatcaccggttttcttttcgactgcttcagcattggaacttttgaccaagcgcacagcgcccaacacatccccagcctcgccactaaaagctgccagattctcttgtcgtgaaaaagcaatcttacgcgactgagtagcaactggcaggaagatcagaataacaagcggcacaacggcaaacataatggccgtcattttccaatccatcatcaacatcaaaatcagcgcaccgatcagttgcatcaaggctgtgaccatgcgcggtaccgagttggcgagtaaatccttgacttgagtagaatcattcaccagtcgcgacgtgatttcgccagacttggtgatatcgaaataactgactggtaataccaaaagcttggcccacagcttattgcgtaatttagcaacgacatcttcgccaaaaaagcctaaaacggcgcctgaacccgcgctgatcaacgctgaaccaataaacagcccgacaacgccaatcaccaaattcatgttgaccgcatgccccaacgcattaatcagcgacttggcaatggttggcacaattaattggccggccgtcgccactaatcccaaaagcagtccaagaccaagctgccagtaatgtgggtgaatggtactgattagtttcatgaaactacggaaatcgaacttttttggtgttgactgccttttttcggctgccatcatcgtggttgaacgttgcatatgcatgtgcctccagttatcagctatttaaaatagttagttgcttatatgtctaactaacattgtgctagcctaatccttttgttagtctatgtcaacaacaactaacaaaaagaactgaacaaattttgtccagttcttaaatcaccttgaatttccatgtcctcggctagtgtgcttgctgcgtttgcaaatatgcctgaacgaaactaatcatgtcgcgcgactgttgattaaacaatggcggcagttgatcaaagtcaaagtattggaatgccaacgtttctttgggatccgcttcagccaaactgccgccgactggtttgacgagataaaaacggcagatgatttgggcctgatcaccattgggataagttgtaaatccttggtcgaaagtatgcagtgccttgactggttccaccagtaaaccggcatcctctttcatctctcgttgcaaggtttcgacaaaggtctcaccgtactccatcatcccacctggcaagctccagttaccggcatctgtccgcttttgcaataatatctgcccttgctcgttcaccaccgcaccggcaacagcgtttaaaaaaatcggcatgtgtcctactttgctgcgaatctctcgaatataatttgccacttaactgcctcttttctcgaatcggttaatctgattatcaagcagtcagccaattggcgcaactagctgcaagacaattcgaacactttgtctagacgccggtatgcttaaaacaataagctcacggtaaatggtccagtcaaacaaccccaaccaaatttgaccgcaaacaaatagacgaccatcctcgcaactaaaagtcgcaatgacagccgtctttttcaatcacttaagcaattgatttttggattagtccagcttgttcttgctgttgacgttcaacttttcgtcgaagtcataaacaacaggttcgccagtcgccatttccaagttcatgatgtctgcatcggaaatgttttcgatgtacttggtcaaggcgcgcagtgagttaccgtgggcagcgatgataacattcttgccagccaacagatctggtgcaatatgatcttcccagaacgggataacccgttcgagggtcactttcaggttttcgccgccaggaatgatccgtgggtcaagatcagcgtaacgacgatccttagcagctgaaccttcgtcagttgctttcaacaatggtggcaaaacgtcatacgaacgacgccagatgtgaacttgatcggcaccgtatttatcagcggtttccttcttgttcaagccttgcaaagcgccatagtgacgttcgttcaggcgccatgtcttcatttctggaatccaaagttgatcggattcttccaagacgtaatgcagggtcttgatcgcgcgggtcaaaactgaggtgtaagcctgatcgaattcaagaccagcttgcttaaccaattggccagcatgctttgcttcttcgacacccttttcactcagatcaacatccacccagccggtaaattggttggacaaattccattcactttgcccgtgacggatcaatactaatttcgccatatcagagaatacctcgcttttatgatttgacagtcttctgcctgtttacagaatctcatgttacaccattttcagtaagttcgcacccgctttctctggtatattggaaagggattgttgccaaaagaacatacgacgcaaattaactgcggcttgatttgcttttggcaacttttagcaggcatcataatcataattgtcaccttttactgaaaatatttctggaggttcatgtgaaaaaaatttggctatcaattgctggcgtttggctcatcagcgtcatttactttatcgtctatctgacagttcccgccatgcaggttgcggttaatgcaagcggcctgttgtcattggttcatggtgtcatggatctaatcttacttggctgtgcgtttgccttaatcgcaggcgcgttatatcgaatgtttcatcgtcgttaatgataaagacagttttttgttatactctttttgtacaactttaatttcattctttatattcagcactcatacatatctttggagggaacactatgtttaagatttgtccaaattgtggtgcgcataatactgccaccgctaaattttgtacccgatgcggcaccagtttagccggtgtcgttgcaacagccgaaaaggcggttcaaagaagtgcacaaccgacttctgagaatgaagcctcaaccgcgaacacagcagctgttagcgaacaatcttcagtgccaagcagtctaacttcatcgtcagctcagaatcaacctgtaacgccgcaacaagcgcaaagtcaggtcacaccgcctgacaacagtcagcagcaagtgccaccacaaccagctagcacacagacacaaagtcagcaaacggctcaaggaccagcaccgacagcgcagccttaccagcaggctgatcaaacgcagcaacaagcacaaacaccgccagaggagccgaatcccacggtggaggctaccaaaaagtatgctggcagttactggcgctatctagtcgacagcattaaacatcctgcgactgtgacgcgaccatatcaccagtattttgggctaaccagtttagccatcacgattgttagtttggcattaaccattgccttgatgactggttccgcagtgtcgtcattgccaggcgcaattgctagtaatgtcttgatgaccttcctaaaattagtctttctagtggcggtcctgatgattgcggtggtcgccgtctattacttagtcgtcaacggcatgcttggcgaccggcgtcgatcttttctgacatttaccactgagtatgcctttcactgcaactggatggtctttttctcagtgttcacgctgctcatgcaaatgcttggtatgattaacatcggttcaatcttcctgatttggttgctgctatcgctgggcagcgggttattcgtcatctctggcacgtatatgttgttcaccgctcagtcaaccaaccgttttgataaaatctacgcctatctaatcgttggtattttactagtcatcgtgttcttgatcatcatgacgttcggcctttcaagtattctcggcggcattggtcaaggtatcaatgattttggccgcagctttaacttttagacaagtatctactgcctaatccaacggctttttagacaaaaataggccttaagacctgacacatgggtagtgtcgtgatcttaaggcctatttttttggtcgtcactcaattgaccaatgcctctaggttttgtgcaagactcacggtatcagttgacattgtatgattgccaaacaagaccacaccgcttttcgcatcggctcgaaaataggctaaggtgctgaaactttccggattgtcgttgtacattccctgtaataaccgctggtcgtctaaccacatcacgccactggcatatggattaccatccccataattggcgttaatcagctgatgatagacttttaacggcatgattttcccagtctctgccgcaatgatgactttagccaagtccgttgcgctcatatacacactgccgctgcccaacaaagtcgacaacagggcgttgctcggctcatctggttgataatcgttatcaccggctgttaagtagccctgcgcaacaggcatctgcgccgtcaacgccgtaaagttatgggtgtgcgtcagttgtagcggggtgatgatcgtttgttgtaagacacttgcaaaacttttacccgtaacttgacgcacaattcccgctagtactgcatagttagcattagcataaatgaagctgtggtcgccagtcgatcccatctgctcgaatgtccagcccaaaatagcctgctccgaggttaaggtttgatcaggcgttagttcgtccatttgaataccagaacggtgatctaataactgacgaatcgagatgtccttactatgatcaattttcgggaaaaacttggctagtttggtattaaatgacagtttgtgctcggcaatcaaatgaccgatcaccagtgccgttaagtatttttcaaccgacgccaaaggaaacattgtctcgccgttattggcttcatgtttaccttgatccgcgtcaccgacgccgccagtataaacaatctgcccgtttttgatcaaagccacactacccgtgaacgccgtttttttaatcaaggcttgggcatgtttgccgacttgcgcttgcggcaccggacgcgccacaattttactagcttggcgttgatgatacacccacgccatcgttaagcccgttgcaaccaccaacgctaccgccaatacaatcacaatcagccaacggtgtttatgcatcgtcatcgtgctccttgggctgcggcacactcgcgtatgttgattgcttgtgcgccgtaccagcaattttcttgacgcccaatacatctaggaaaaaggtaaagatcggaatgccgacaatcaatccccaagtgccaaataaccgctctgccactaacaaaacgacaaaggtaaagaaaactggcagctgtgttcggctgctcatgaacttcggattcaggacataagcttctagcacatgaatagctgcaatcatgatcaaaatggtgaggacatcttgccaaccgccgacggtataaccaataatcgtgagcggaatcaaggaaataatcgctccggcaactgggatcaaggaaagtaaaaagaccataatcgcgagactaggggtgttcggcatttttaagaatagtagcgtaatcgttgtgatcacggtattcacaactgcaataaaaatttgtgcttccatcacaacgccaaaagtattgataaacttcatcgcgaaatattgcagatctttgaaataccagccgaacggtgaatccagaaacagttggccaaacgcaggcaagctatcaagctcaatcgtgaaaaagaaactaagaatgaaggagacaaacagcgtcaatcccatggcaccgatattgccagcgtattgtagcactgtggtcacgccagtcttaagttgttccgtcaagttgagactcttcgtgctttgcagcacccattgcatgacctgattgttggcgaacgcctcactgttataaaagttttgcacagaattaaacaagccaatcgtctgatgaataatcgctggcacgtaatgcactgcagcgtagactaagcctaggatcacaagtatgtaaactggcaccacaatcacaaatgggcgaatatgaacatgccgctgaacagcgtggactaagcggctgactaggaacgcgaaaatgaaggtcaacaaaatatcgctcataatgctgcgagcaaaccacaacaagagaaagactgaaaacaacaccgctgtgcgcctaaccggaagattattgatgaacttttcgtaacctgacatacttttccccacattcttaacgagatacactaagcctgccgcaaaatcaaaaaaagcgcaagcattcgctcgcgcttgccgaaattataagaaaaccttcaagtgttgcttcgttgcctttttaactgactgaagctggccttgaataataatgcgatccacttcgccttcagttggcgatgcacacgtcaccattgtaatcagtttcttaccggcaacatcatcaatccactgaacttgggtttcattaacaacctgtttactggtcactttatacgagtaaactttcttcatatcggtgatataaatgatgtcgtcttgcttcacatttttgagcggtgaaaacaaaataccttgattggtcatgtagtgaccagctaaagcataattaccttcgcccattttttgatcggctttcatcgtgcctgcccccgcactgagattctcgtttgataatcctttaaaaataggcaatttcaaaccgacactgcgaatggcaactttgccaataggatgcaggtcacggttaagcgcggcattgccaactgtattgatatcaagcgctttgacccctttgaaatcaaaggttgctttgcgtttttcatttttgttgacattgtcacggtcaacttgtgccatcgtccactggctaagatgatcgaccacaaataatttaatgggttcattgaagatcagcgctaatcccagaaggataccgagcgtaaaaatggttcgccaaagccaacgatgtttacgcggtggctgttttttattagactgtgtcatcgtcatcctcctcggggaaatcataccttgaaacgttgtgagattcaagcaagggtgcttgggtgaatggctcaattgcggtttgttattttgataaataagttgtttttctgttctgctgtcgttgggaggttatccttagtgtccgagctggctacgcggcgattcggggtggcgaccgcgaagctagagtggtgggcacgacttcgagcccatcgccgctccgccagctctccagattctattttaattttaaaacggtattctgatctactcatgcaagaacgactcacaattgaagttctacatgccacacctgccatggtatactattgaaagtttgcataggaggcgcctgttttgaagaagctttttcaactctataagcgttatgaaatgatcatcaattacctgtttatcggcggtttgaccacgttgattaactttgtcacgttcttcgccatgcggtattttggtattggcttagttttgaccaatacaacggcgaatatcgtcagtgttatttttgctttttttgccaacaaaagtgtcgttttccacagtgactactcaagtaagaaaaagttctggttcgagttaatcagctttcttgtgttgcgtggggtctccttgttgctggataacttgatcatgatcatcggggtcgattggctgcatggtaatgagattctcgtcaaaattttagatcaggtcatcatcgtgatcgccaattatctcttctcaaaattgattttcttacgcaaaaaataacttcatgaagtgtgctgacccttgtctttgttgcaggcggctagcacgcttttttaagttggcagcaaaaatagttgcttggtttggtgcagtgtcacctgaatcggggttgaatattcttcgccgtcaatttgaatcggtacagtcgctgatgtggcaaattcaaacgtttgcccttgtgaatggtgcatggcgcggtgaactgaacggccactgagaatggcaaataggacctgaagcaaaatacccaatttttcgcgatgcacctgtacaaaagacaaggtgctgcgattatctgctttatttgggaacagtcgcaacccgccgcctaagaatggatgattagtaaagacattgagataagcattgtcgattgccgtggttttactgtctacttgccaagtcgcacgaaactttttttgttgtcgcagtgcttttagaatactggcagcatacgaaaaatgaccgagttttagggcatttaatgctgccttgtgatcagaatggttcgtttggtaaacgatttgggcatccattccaatgccaaagttattaataaaatactgagtcccgtacttggccgagtctgccaccccgattttcaaggcatgcggcattgccgttgtcaaacccgccgcagcttttttcgggtccagaggaatgtggttggcgcgggcaaaatcatcgccggttccggttggcacatagccaatggcgatttctggatgaccttgtcgctgcaacccattcacaacatcgtgtagcgtcccatcaccaccaatcacgatcagttgaagatcgtccatcttgtgttgataagccttgatgagtcgttcagtcaccaatctggcatcgccggctttgcgcgtctgactaatatgcagtggcgcaaagtgggactcaatgattgcaactaactcaggtaattgctttttccagcgggcattccccgcactgggattcataatcacttcagcaaaaggcattttccttactccgtctcattagataattggtcaagaagcgatgatattctttatcggtgatgaccacttttatcatatgatacctttttcaaggcagctagacacgtattgcgcttgccaaactgactcacttagcttactagtagcatggtgattaaaaacagcacggcccgcgccgtgctgttgtttaatcccttttttaatcactagttaagccacaggcaccttgtgtgttttcaagaattcactcagcggtaccaatttttccgcgtagtaacgcttcttgaacgcagcaatcgtgtctgcgtcaaactggttaggatctagttgcagatgctcaactggaattggccgttcgttggtgattttggcatcgatcaaggttggtttgccggcagcccggttggcttctgctgtttcgaaagccgctggtaattcgtcaacttgggtgacagtaatgccggtcatacccatgcctttcgcaaccgtcgcaaaatcaatcgctggcatgtcgatcccaaaccacgcgtgaccatcgtcctcctgctcatcttcaatgtaacctagcgcattatttgaaaagatcacattgatgatcggcaaatcataacggacttcggtgtccaagtcctgcatcaccatcgccgcggcaccatccccagccaggttaaagacctgtcgctttgggaagctcaattgaccggctaatgcggccggcaatccagcgcccatcgtggcaaacaacccactggtggtccacgcttggcgcccattgactttcagtaaccggacagcattttgggtaacatccccgacatcaatcgcaaaaatggcatcatcagtagcaatgcggttaatttggccgaaaactggttcgaagcgcattttcccggttgtccgggtcatcatatcgtcattatactgatgccaatttttcacgttgtcgacattggcttgataccagccgctgcgtggtgcatcgtcactacgatcaatcattttcttcaaggttgccggagcatccgccaaaatggcaacatctgtgtgatggcgcttgcccaatgtcttcggatctgcctcgatctgaataaacttggcgttcggtgagaacatgacttcagcaaacgggtaattcgaaccgacaaacatgatcaagtcagcaactcgcaacgcttcattcgctggttttgaagccacccgagctgcagaaccaagcagtgattcaaattcataagggataatcggcttgccaagtgctgtcgtaatgactggcatttgtagctttcttgccagcgtcatcaccgtatcagcagccccacggacgccttggccaacgtacatcacgggccgttgcgctgcgccaattaggcgcaacgccgcatctacttgctcgtcgctgccagctggtaaaactggggtggcgtgggtagctgctgcactgtagtagccatcggctggaatttcttcggctgccaaatcattgggaatcacaacaatcgcagctccacggccggcataagcacggcgaatagcctcgtcaataatatgcggcagactagccgccgtggtaaccgtccgcgcatacaaagcggcatcttgaaacatcggatcttcatccagctcttggaagaaatcgtaattcatgaagcgttgttcaacttgacccacaagaaataacgtcggcaccttatccattttagcgtcatacgccccttgaaatagatgggttgcgccgggtcccgctgatccaaatgccacgccaatatgcccagtcaatttaccatccgctactgcagctagcgcaccgacctcttcatgtcggacgtgaatatactttaaattgtctttctcttcatccagcgcatacatcatattgttaaaagtaccgccggggattccgtaaacatgtgtcacaccccagctctcaagtgtcttcaacgcggcgacaccagccttaatggtctttaccataagaatccctcccaaaaagtgatcgcgaacaggcacgtttagaagtcggcacatatgtgggcttctgcgacgacgagcgcgttattcagtatctctcgcggttatactagatttgttttaggcataaagcaattattttgttcagagcacgaggtgaggttgggacatcattcacagccaacaacaaggcgacaatttccatacaaagctgaaatagttggccttattctcatggatcatttttattgagatttaaagataccagtgccaaggcggagcaatcgtaggccagatggggctcagccgtgcaaacaacacagcgaccgggctttgtcgctgatgttgttaggcgacttcgagaccgggctttgggctcgaagcgccgtcacgctctagctccgcgtcgcaagccacatctggccggagattgcggagtttggcacggcaaagaatgttagtcttaagcttccgctcgattagccgtcatcatttaaaccgcccaatcgcataacaaaaaaacggcgaaccccccatatcaaggaaagcattcgccgtcatcaaacttatttcaaatcttcaatactattaatattcttcatatacttcggcactgccaagccgacctttgcaccatctaagttcacgccaagatcaacaacttgattcttataatcagaataaagttttgctgacgtattcggtaaccaagcagaaacctgagcatcggcagctttagttgcaactgaagcccaaactggttgtggttccattgcccgaatcgtcacgttataccctatttgccgcaaaacagttgcaacaacattggtggacgcgatttccgaatcccacgcaatataggtcatcgtcagtttaggtttgccgctaacatgcgtcacacccttggtccactgtgcgatttgttctgggtgcttcttaacgaaagctttggctgcctcggcaggatctttgccgccgttgaccgccagcatcacactggacatttcttcaggcgtccagtggaactgatccaatacctgataagcttgcggtgcatcttgcttaaggcccttccgcacgattgtatgaatctgttcggttttgccgtaaacatttttaggatccttgagaaactttagtggaaacttggtgaacatccagtgcggcgtccagccagtgaccacaatcggacgtttgtcggcaatcgccttttgcaacgtactggtcatagcggcggtggaacttggttgcaactgccactttttatccacaagaccataagctttcagcgctttatctgtactggtcatgaccccagcgccagcatcaatcccagtaatggtgtaattgatttgcggtcccagcggctctttagcgtcatacttaggctgcgtgctgctgcaggcggcaagggcaccgactgtgatcaacaccgctagcgccgcggcaatctttttcaaaaaagtcaaacggccacctcctaacgactacgattgagactttgcgtgatccggtcaagaatgatggccaaaatcacgatggcaagcccggcgacaaaaccgccgccagcatcattacggccgactgcaaagtaaaccttcgtacctaagcccatcgcaccaatcatcgaagcaataacaaccattgacaggtccaacatcatactttggttgatcccggccataatggttccgcgggcaaacggcaactgcaccttcaacaattgttgccaaccggttgccccaaatgcgaccgctgcttcatttaaatcagctggtacttgcgtaatgccaagctgcgtcatacgaactgtcggtggcatcgcgaagataaccgaggctacaaccccgggtaccatcccgataccaaagaaagcaacggctggaatcaggtaaacaaaggctggcatcgtctgcatgaagtccatcaatggtttcaccactgcggaaactgacttgctttcggccgcccaaattcccagcggtaccccgatgacaatcgctaacaaacttgcggtcaacactaaggttaacgtttgggtcatgtcacgccagaaaccaaggttccaaatcaacagtaaaccaagcaattcaaaaatcagtaagctgcgatatttctggtcgcgtttcagataccaagttaacgcaagtactagaatgatgaataaccagatgggaataaaatcaaaaacagcttggaaagcattcacaatgccgccgatgaagttcgttaaacccccgaagaagccggaaaactgggttaaccacgcaacaaatgaatcgacccagtgggccaatggtaatgtgggaatgctgattaaaatgttagacattgacattgacctcctgtccagataatgcacctaagacggcaccgcgaatgatgatcccgcgtaagcgatcatgatcgtctaccactgcaaatggtaccggtgtggtggaaacggcgtctagtaagtctgccaacggcgtatccattttagtcgttggcacatcagacttaacaattgagcgcagatccttttgaccggcatcaatagctgaccgcacgtcgtcggcatccaaaataccgacgagtttacgtttagtatccacaacatacaaacttgaaatttcattgtcccgcatccgccgggcagccaaacgaggaccatctctatcaatattgactgtgttggcccgaatcatcacattggcagccgtataaacctggctgcgatcaacaccttcaatgaatttctcaacataatcgtcagcaggctggctcaaaatttcttcaggcgtgccaatctgaacgatttcgccatctttcataatcataatgtgatcgccaattcggagcgcttcgttgaggtcatgcgaaatgaagacaatggttttttgcatatcttcttgcaagtccaataattcatcttgcatatcgcgacgattcagcggatcaagtgctgaaaaagcttcgtccatcagcagaatttcggcatcgctagccagcgcgcgggctaaaccaacacgttgctgcatgccaccagacaactgatctggatattgatcggcaaaaccatttaagccaaccaaatcgagtgctttgttggctttcatctcgcgttcatctttctccatcccttgaatctcaagtccaaaggcagcattttgcagaacggtccgattcggcagtaaggcaaagccttggaaaaccatgctgagcttttgccgtctaacttcacgcaatgcctgcttatcaagtttggcaatgtcatcaccgtcaatcagtacttgcccgtctgtcggttcaatcaaccggttcagcatccgtaaggtcgttgatttaccagaaccggaaagtcccataatcacaaaaatttcaccggttttaatcgaaaaatcagcacgatcaacaccaaccgttgcgccggttgcttttaaaatttcaggcttggtcttgccggccttcaacatttctttcgcgcgattcacgcgcttaccgaaaatcttggttagcccgcgaacctcaatttttgtctcggcattactttcaactttgtgttgcatctactcactccttgttttgaaaaacgtttgtcatcgaattgaaacaatgctatccattctagagatagtttgtgtgtgattcaaatcacggaatctcattttcattttcgccgccattaagcgccacatgacgttctgcaattgttgcgcacaaaaaaagcccgtatccgcatgaggttatgggctagggacaatcagcgattcgaattttgagagcttctctgaaagtcaaggatagatgaaatttagatgggatctttttcattattcacaagctgttaagattaatctctgaaaaaggcaagtgttcgtcgaatggtatttcgttgcctaatgtgatttgatctgggccagtcatggtgtcataagccagcacgcgaacgccattttgtttagcagtcgtgatggcagtcactagttcaggaaaacggtcccgataaatggtcatttggcgaatatccggtaattgcacgatgaacaataaaaatgcctgatacccttctgcctgcgccatcgtcagcgtatggacatgcttgacggcgcgagttgttggcgcatctgggaaagctgctagggtgccattagccaacgtgacgcccttcgtttcaacaaaccacgactggccatcagcggctttcccagcaaagtccagtcgcgaatcgcgccaagtcgattctggatgaacggcgtatggcaaagcgagtcccggcaattttaaggtgccagcctctaaacattccttggcaacatgattgggtgccagactgtcgatgttgatccagcgaccttgccgttgaacagccagcaagtcatagtgcgttttgcgatttgggttatcaacatagcggacactggctaatgatcccggaatcaaaatttctttattgcgtccggtattattcatgtggacaggttcgacggtgccattcaggtcaatttcaacggtaaagcgactcacccgtttgatgagctgcccgacgctgacattttggtagtacatgcgttacttcctccccttgttgggtgttggccgccatgaaaatagcagtcgcaacgatccatgaagaatcggtacgactgctcatttttgctgcacttgaccgaaatcagcgaacgataatcaccgagaccgatgcatcgcgagcaacttcgctcgcaacatgaccaagacgtaaccgaccgcggcgaacatgggaacccataatcaccaaatccggtttgaaggctgggatcacttcgtcaagaatggcagctgctggccgcccttctgcaacgatgggttgtgcgttttgaacgccaaatgccgttgctttttcgacgtaagtgttcagatccttagccagtgtttcccgggccgcatcaacatcatcaggtgtcaatgattggaaaatattgaggtcgccggtttcaagtaccgacacgatccccaacggaatgtcataaatcttggcaaccgtgcaggcgtagttcaatgccttgcgcgaggagtcgtcgtcatcatcatcaaccgccaataacaaccggttataatgcatggattcaatcgtcaaatcatcttcagtaaccaaaagaaatgcccccttgcaagtttaggtatccctaacaatgccattttatcacatgtcgcccttattttccgcaaaatactgcttaaaccgaccaacataattatggaacatatatttcatcaataaccagcgcttgaatgtcatgtccggtttataaaagaccgtcgtaccatagcgtttctctttaagtaactgcaaggcttcctttttagcttcgttatctgcagaatactgcttgaaaacacgctctggaacccctagccacaatttatacttgctgtggtcatcattaccataaaccgttggctcgtccttcaaatctcccacgatgtaatcgcgaacaggccagctggcaagattatacccatttaaagtgacgaaaaagctactccggccttgacgaatattaatttcaaacagcttgaacgtcttgtcacgatgatcatacttcatatcaaagttagcaaaaccggtgaacttaattgcttcgaggaatgttttgatctgatcgtacaaatcctgatcgaaagctggcatgatcgcgacatagttaccgattgaagaaggcgtaggatcctcaagtagcggatgacctaagcacatcattttaacgtgatgatattgatcaacataacagttcaaagtccgcatgttactgtcatcacctggtacaaagtcctgcaagatgagatcagacgtatagccgttatcatagattttggcaatcgtattcgtcagttcaacttgcgagtgaatcgtaaacgcctttttgcggccttcaaagcgaatgtttaaccattcaacggaatcagtcggcttgagtgctactggaaattcaaacggtgccgtgatggttgcgttgctttcatacatcgacttggtgacgattttggttgccggatatggcaaatgatactcttcgcaaacttgatagaagctctccttactattcaggcgcttcaacaattcataatcaacatatgggcagatgaaccactggctcaactcatccttatgtttggaaacaagttgggcataggtgtccccgcaagcgattaacaacagtttgcctggagcatctgcatgtatcttggctacctgccgcatattttcaataaaagtcggatcggaatcaaaatgctcgatcagatggacattcacgatccgcgaaaaacgcgttggagcaagttgttcgcgcgcataaacatcaatcgccccaccgatcatctcgtggaacgaacgcgccataccatacacattcatgtcactgccaagcaggatgggggtaaaactgggtgcatctttcatctgaatgataatctcctcgttcaataagacgcgaattcggtcaactgtgcgtcttgaaattttcattttaaaaccttgtctgccgattcaattattgacatcaggcatcgttagactcgttttgtaagacgcgaagttgattttatcaatcagcttccgtccgttgcccccgaattataccataatgccccaccacgttcacttgcgtcaggataccataacactttttcaataatcatgaatcaaaaaatactaggtcatggctacctagtattttctgaaactcactcaaacgttcaacttgtacgccttgttgacttggcgccaccacctgtacttgccactttttccaactttcttgagcttgcgcctgtaactgggcggcagccgcagatgagtctgtgatcgccagcatggtcgaaccagaaccagaaatcaaaagaacaccgccggccgtctgcaccacttgatgagccgctgaatagtctggtattaattccgcgcggtaaggctcctgcatccgatcagtcgcaacttggcgtaataacgacatgtcgccatcagccagtgcccgggtcatcaaggtacaacggcccatttgataggtagcatctgcataagtcatggttcgcggtaaaattcggcgggcatcagcggtactgacagcatagtcagggatcaaggtcacaaaatgcaactttgagctgaccgtatactgccgaacgactggttcattttgcgccatgatcgtggcacatagctgcccgtaaatcgctggtgccgcattatctggatggccttccatttcagtagcaaatcgcaacagcgccgtatcatcccaaccggcttgataccacgcattagcagcggcgataccaccaaccacacatattgctgaactgcccaaaccgcgggcactcggcaccgctgaatcaaccacaatccgcagattaggaacaggctgatcaatcgcctcggcaaatttgctaaacgcctgataaatcaagttctcactattggcgaaagctgggtcatcgccaatgatctcaagcttttgggtgctcatttcaaacgtaaaatgagctttgagatctaaggcaagtcccaacacatcaaagccaaccgctaagttagcgctcgttgccggaacggacacgctgatcatcgttgaatacctccttcgccgccccaataatagcttggcccatatcggttggtgccacaacaaccttttcctgcggtcttagctgttgaaggcgagcaagattcggcggaatcggcacaccgctaacctgttgcaacatttgcattgcagcaaagtcatcatccggtacgtgcgattgtagtgctttggccaccacgcgtggaaatttataagggcttgcggtggctaaaagcacattcggggtgttatccccagacgccgcccggtactgctgttgaaccgcataaccaacagcagtgtgcggatccagcaaatacccatcccgatgccaaacctcgcgaatggcatctgccacctcttcatcaacagcaaaaccgccagcaaagtccgcttgaatcgcggtcaacacatccggccgaacttgatagcgaccagtcgtctcaagttcctgcattaaatgcgcaacatacgcgctatcttcgccactcttataatacaacaggcgttccagattactggaaatttgaatgtccatgctaggtgccactgttttcaaaaacggtcggttgcgatcatacacaccggttgccagaaaatcagccaattcgctgttggcattggcggccgcgattagtttatgaacaggcaagcctagactcttagcatagtagcccgccaacacatcgccaaaattcccggttggaacagtgaaattaacctcatctcccattgaaatggcctgtgttttaaccagttggctgtacgctgcaaaataatacacaacttgcggaatcagtcggccaatattgatggaattggctgctgacagggttacttgctctgcctgcaaccgagcagcaaagctagtgtcagtgaacagggttttcactgcgctttgggcctgatcaaaattgccagcgattgggaaaactcgtgtattgtcactgcccacggtcaacatttggcgctcctgaattggactgacaccatgattaggatagaaaaccgtgatcccagtctgcgcgacatctttaaacccttgcagagccgccgttcccgtatcaccgctggttgccgctaaaatcatgacccgatcatcaggatcaagtgccaactgcatcaagcgcggaagcaactgcaagccgacatccttaaaggcactggttggtccatgaaataactctaagacatgaaaatccccgacagaacgaactggcgtgatgcgatcatcggaaaaatgctgatgataggcaaaatgaatcgctttttttagtgagtcggtgttaaaatcaggcaacaggatcatgagaactcgctgagcaatcgtttcataatctaaatctaacagttcatgaatgttcagcgtctgatcggccaaatgcggcaggacaaacaaaccgccttcttcagaaataccttgtttgattgcctctttgctggttttgctaacctgatgatcccgtgtgctcgtatatcgcatttgaagaactcctatctcattcggcttgaattaacgatatggatatgataatctgttcgcattagaaaaacaagtgtctatattttataaacaaggagctgagaatttatgaaaattgccatcttaggttttgggactgtcggcagcggcgtttacgatattattgcaaatggtgatacccgaatgcgcgtcaccgctattttcattcggccaacgcaccctgcgaccatgcctgagatgacaacagaccttgacgccatcttaaacgatcctactattgatgtgatcgttgaaacaatgggcggtcttcatccagcacatgattatattttacaggctttgcagcacggtaagcacgtggttaccgctaataaagccgttgtcgctaaatatttgccggagtttaccgctgttgctgcccagcatcacgtgcaattttacttcgaagccactactggcggcggcatcccgtggattcgcaaccttgaacgcgccgcacgcattgatcagatcgataccatcgaaggcattttcaatggcactagtaattatattctcgatcagatgcaacgcgcccacctcgattttgaccccgtgctcctagccgctaaagatatgggctatgccgaagccgatcccagtgctgatattgatggcgaggatgtggtcaacaagctgaaaatttcggcagcacttgcctacaacatggccccaccacgtgatgtcccaacttttggtattcgcaatgtcagcaaagccgacattgactttttcgcaagtcaacatcaggttttacggttgattggtaaaagtaaacgtgacggtgaccactatagtatggtcgtggaaccgcgcttgtattcagaaaccgccttggcggccaatacatttgaaaacttcaatctaattcgcctgcatggacaaacgattggcgacctgcaattttatggccaaggcgccggaaaatacccgacagccaacgctatcgtgcaagatctgtacgatatccttgaaaatgccccgcatctggaccgtagcttcgatcagccgctgcattttgacgccaacctgaatgtcaccgattacgttttgcgcgccgatcccatgaccttcgcgatgttcaatgatcgcgaaaccgagatcgtcaatgaccggctggtgatcaagcaaataccaactggcgacatgcacaaactcatgcgcggcgttttggccattgatgccgatgcttttatggcagcaatcggagacagtgagttggctgctaaagacgtccttcaccagcaagatcaggaggtgatcggatgaaggtcgttaaatttggcggtagttccgtggccgatgccggtcaattccagaaagttaaagccataatcgatcaggatgcgaatcggcaaatcgtcgtgattagcgcagctggaaaatatggtaatgctacccgaaaattaactgatacgctctatttaattgctgacggcatggaagccggtcgagatgtcgaaccgctgtttaatcaggtcttggctcggctagaggccatcaacattgcgctgcagctcaatgtgccgctcatcaaactgttgcatacaattcgccatcatctggccattcgctattctcgagactatctggtctctcgcggtgagttcttgacggcccacttaatggcagcctacttaggctatacttttgtggacgccgccaatcttttgtttttcaataaaacaggcgccattgatgaagccaaaactcagactgcttatcaacaactagccagccatcatggtatcgtcgttcccggtttttatggtcgcgacgcagacggacatgtcaagctgatgccgcgcggcggttctgacatttctggtgcatggctagcacgcttggcccacgctgatctctatgaaaattggaccgatgtttcaggcattaaaatggccgatccgcgtatcattgaagatgccgacagtattgatgtgatgagttacgacgaattacgcgaactcacctacatgggatttagtgttttccaagaagaagcggtgcaaccggtccgtgaatgtggcatcccgacgcgtattttgaacaccaatgcgccagaagacccaggcacgctgatcattcatgatgatgaccccgccaatgatctcaaaacaatcactggtattgctggccgtaaacattatttggtcatcacggtccgcaagtaccagctggccttgcacttagaagtcattcaacatgcgctcggggtagttgcagcgcaccatctcgttgtcgattatctgcccacgggcattgacagtttcagtctgctcattcgtgaaccgcgtcgtcaagtctcggtacaggagctgaccgctgaaatcgccgctgcctgtcaaccagacaaaatggaagtcaccgaaaatgttgcgttaatcgccatggtttctcgtaaacttcgacaacgaccagccattgccggaaaagtcctcgcttatctggatgataacctgctcaacgtacaactcgttagtcagaccaatgacgatatcaatttgctaatcggcgtacatgatcttgattacgacaaagctgttcgggtcatttatagcagtattcatcaaaactttcagcgcccggcgccttatattgaggggattgcctagcgcgttacaagtcttgaatcgcatttaataaaaaagcatcctttccgcaaaaatttaccggaaaggatgcttttttgttaatctaaccttttgtcactagcaagttaacaacttataggttacttattcttttctgccatccgcgatggtgtcggttttgggtcatcatcagtggtttcctttttagggaccgttgttgcttttgctggcggcttcggtgcatctgcatgttgatccttgatggcatcgacaacgggttgattcccagcttgatgcatcaaggcgccgttcagcatcccgcgaatatcaattccggcaacttcttgcaacatgtccaattgtttgaccagactgccgctggtttgaccggtcagatcaccgtcaccataaagcttgatcgaatcgacattggcatatggactcatcgcggcttcgataatctttggcattgcctcaatggtcatcttaaaccgaccggattcgtctaactgacgggctgcttctgcttgcttggcaatggcttccgcttgcgccagcccaattgcccgcgttttgccagcttctgcttccccgatggccttagtggcattagcgttggcttcggcggctaattctacctgcttggctgatgcctcagctgccgcgatctgcgtagctttttgcgcttcagctgcacgctgcgccttatacagatcggcgtcggcttgtttacgcacgctggcattcaattcttgctcttgtaattcagcgtctttttgggcaagttcaatatctttttctttttgaacttgcttggccttcatttgctcaacaatagcagcctgatctgcctgcgcttgggcgatttcttgctgtttcttgaaatcagccattttgacttgctgttcgcgttcggcatcagccacctgtgtctgccgctcaatttcttgttgcttagcttcttgatccgcctgcgcttgctgaattcgagtatcacgacttgccgccgcttcagccaccgctgcatttttcttaacttcagcgatttgctttttacccagcgaatccagataaccgtttttatcggcaatatccttgatcgtgaatgaaatgatctgcaagcccatttttgccaagtctgagctagccacatcctggactttctccgcgaaggcatcgcgattttggtacgtgtcttccacggttaaggtgcctaaaatagcgcgcagatggccttcaaggatttcggttgcttccgaattgatttgttcgtcattcttgcccagaaattgttctgccgctgtcgcgacctcttcttgactggaaccaattttcaaaataacggttccgttaacgatgattggcaccccttgttgtgtgtacacttctggggttgcgacttcaatcgtgcgcgtattcagactcaaaacatcccagcgctgcaggattggcagaatgaacgaaccgccattcgtaatcagcttaactcgattgccgttaacatctctaaaactgtgcttgcccgaaatcatggctccagagataattaacacttcgttgggcagtgcggttttgcgatgggtcgccaagaaaataaaaatcaaaatcaagacgatggccgcaatgatccacggcatataatcagttagaatttccataagtcccctcctctaaatgcgatggctaaccgcgccagttcacgctctcctaaatgcatcaacatatgcgatgccttgcttgagttcaatgatgacgaccttggtgccttgagccagtgtttgatgcgtgccggaccacaatttggcgggataggtttgccgcgccaaaccaccgccagtcaccatcacttcaccagtgtgaccatcagaaacagctaatgtaacagtccccaacaaataatcgcgatcactgacggatgtcgtgttctcaacgggtgccagtaatcgttgcaagaacgcgatcagcggcagtaagactaaagaaaaaagcatccacaataagccaatcgccaaaagcatggcaccaatgatcacaagaatttgtaaccaaaaaacttgttgggtcagccatgccaccatcgtcatcacctcactttttaatcacattaaatccctttcattttatcatgcaagccgtccataacctataccattatcgacacaacgtgcgttttttattttaacttagcgaattcttcatcccaaaccaatttagttatcaaaaaataaattttcgcaaaagatatgcctttagacgttacaaattttactgacagcattgaaccgttaaagctacagaatttcttttgttgatccaagattatgtgcattcacaaccaggctttaggcgggattgatagaaacctatcagttgtaattcaaagcatagtcttcagggtcttgataatgcagcgtcttggtgaacaagacatgactcgcataggccaacgcaatcggcaagataaagaataacaaggtcaattcaaggacgttgccaactgtgacactgcccatagcatcaagcgctgccaaggggccgactaagccagaaaatccaaaaccggcactggccggggtgccttgaatgttcaacgccgccccaataccgcctagaatgccagcattaatcgccatcggcaaaaagagctttggccgagaaagaatgttagccatctgcatttttggcgaaccgaggaagtgagccagcgacgtgccaaaagagtttgccttccagccataggtcgccaaggcaaaacctgcccccacaataccgaggttagcagaacccgcaccgataccggtcaacgagattgccgtggcaataccgaccgtactgatcgggctcacaatcaacacggcgaaaatgatccccatgagcacacccatcacgattggctgcaaggccgtcacatcatggacaacgacaccaatatacttcgtgatgcttgaaaccggcccaagcgttaacatgccaatcccgccagcaatgaccagcaccagtgatggaatgagcaaaatcgtataagctttcaaggcgtcaccaagcagcactatcaacaaataaccaatggctaaggtgatcgcaaggttaatgacatcgccagtaccagcaaccgtcaatcctgttttagtcagatggtagttgcccgccccgacgatcgcagccaaagctaacgaactggtttgaatcggcgtaaatttggccaacatgccgacacagacagccgacagtgccggcaacaaagtcattgcagcccctgtcatgtaggtaaccaccgccaattgcggaaagcttggcagcaacagtttgacaattgcgttcaaaatagcgccgggtaccaaggcgacaataattcccacggataatccgttcaaaatgttcatagtaatggttttagcatcttgtttcattgacttgtcctccaagttagttgacttgatgcgctgacttgccgccttcaagaatggttttaacatcgtccagtgaaatatcaatcatatttttgaccgccgcatccgtataaaaaccgatatgtggtgaaatttcaacattcggcatagcctttaaagtttcaagtgcctgattatcaacgagcgtttgactgcggtcttctccgaaaataccggcttcgccttcaatcgtatccaaggctgctccggcaatcgtgtgatcattaagtgcttttatcagcgcttccgtgtcgacaatcggaccgcgtgctgcattgatcagataagcggtcggtttcattttacgtaacgcatccgcatcaatgaggtgggtggtcacgccgtccaacggtgtatggaccgtcacgacatcagatatggtgagtaaggtgtttagatccacataactgaccgtatccgccaattcaggccgcttcactggatcactgacgatcacagtcgctcccaatgcccgaaaaatacgggccacagcactgccgattttaccagcaccaataataccgaccgtcaagttatgaatttcaggtgcttcaaggccggtccaactataatcatccttcgcttcgcgggcgcttgcttcccctaaatgccgaatcaaccgcatgacttgggctaaaaccagttcggaaaccgatcgtggcgaataggccggtacattggtcacaactaatccgtttgcagtggcagcaccaaggttcacaatatcgtaaccggtaatgcgcaatgtcagctgtttgatgccaaatgccttcagtttttggtaaaccatttcgtcaggaatcgcaccatgctgttgaatcacgacaccgtcataccccttggctaaatcaacggtgtccggtccaaattcaaccgtgttggtatcaacttgaatatcattagcagcgacccaagcatcaatcgcagcccgctcatcaggtcggacggtatacattagaatttttgtcatatttgcctccagattgttagcccagcactttccaatcggctcattaatgcgttgccatatagttggcgatgcgctcggccgccaacttgagatccgccattgaagctgcataagaaatccgcacgtacccttcaccgccggggccaaaactagcgccaggaattaccgcaaccttcgcctcgcgcgccaaagcgtagacgaacttccaactatcatgcattcgctccggcagcttggcaaaaatgtagaaagccccatctggattcggcacagtcaaccctgcggcagttaaggctttgatcaagaagtcacggcgtttcatataagcttccttcattggctgcgtatcatccatgccgtttttcaaggcttcttcagcggcgcgctgcgcattggtggtgacactcgtgatcgtgaattcacttactttgccaatctgctgaatcacatcagctggtcctgcggtgattccgacccgccaaccggtcatggcatgggactttgagaccccattcaatacaaccgcttgatcaggtaaaatttcacccatcgacacatgtttgcctgtatacgtcagctcggagtatatttcatcactcaagacgaagatttcgtattgcttgatcaccgctgccaaggcttccaaatccgtgcgatcgtatgtcacacctgtcggattcgtcggatagttcaaaacaacggcttttaccgtgtctttgtttgcctcaattgccttctgcaacttctccggtttcaaaatgaaaccatcttctgacgtatcaataaaaatcggcttggcaccatttaacaagacaattggaatatacaacggaaaaattggcgtcgggataatgacggtatcgcctttattcagcatcgctgtcaaactcgaatagatgccgcctgtcgcaccggcagtgatcaaaatttggctttccgggtcatatttggtgttgtatttcgtcgccagataatggctggcagcagcccgcaatcctggaagtcctttgctttgcgtgtaatgactctcattgttttcaatcgatgcaataccggccgccttcacatgttcaggtgtcggaaaatccggctcgccaagtgtcagcttgacaataccttcaatcccgctgatcgcagcattaaattgcaaaatatcgctgggcttgagctgcttaacttcctgattcatccgatcaactaatgccatattattttcctccaatatttttccttatagttctatcataacgtgtttcatggggaagacctaggcgtccgaactttgccgccatggtcaattgtccccttcttgagaccattttgattagcgagtcactcgttctgctgcttgaagtcaaacaaaaaccccacagtcacaagccgactgtggggtaagataatgggaatgattctcctgatctccgccacacagtcaattgcttgatctgtgtgaccgctcactcaaaggtaactggtcccacagatcgtgtctgaaaaaccagaaataaaaggactgttcgctttgagtcagctttttggtcattatgagaacctcctaagaattagattagttacaggttactgggttgtgaagcatttgtcaaatgatttatgaggtgtcattagcaattcatttttttaaacgactttttgagatcactttaaaagaggtttatcccagaaagtgctaagccaggctggaaatttcgttcaatgtctagtgtctgaccttccatatcaagaagaacagtttgttgctctgccgtgagttgatagtgatattcacgcatttcatctctaataaagtagccgattgaccgcacttgcgggccaatgttcatcccttgtgttcgtttacttgctagtttatcaatcgcctgttttatttttaggacaatcatttgggcggtgccatctgtttgttctccaaaaaggtgttgtagttctaacatcttaacaatgattgcttgcttttcatccattcagaatcgctccttcattcgggcaacgagttgttaaatcttaacgatatacaaaatttgccttttaattgcttgccgtcttattatcgcagtattccttccaacatctgccaactgccaattttggttatcttatccaaaatatacgcctgaggaacagttcgggattcatttaaatttaaacgtcggtattttcaggtttttcgtcgttctttcctttaattcgtataaggacaccacggaaaatgcagttttgccaaacgacaacaaccaacactgacccttcagaataggctacaatgaccttaattagtggctggtgaattaggcaacatttcggctacctgaaacgtgaatttgataatgaattaagatggattcctgcttatattttacaaaaatcaaaattggtccattaaaaagccttagtagcatctttagattggctagattgatcgcaatatcaaccgtcactgcgatgctggctaccgttttagtccgcaccaatgaaaggcccaaagggcctttcatgaaggcaaaaccgctcctccaatcttcttgatagaccaagtatagagggaggattttgacaattataggtactgcactatgtgacgcttacgcttaatcagtcaggagaaatgaccatgtttgtgtttttgatcgcgtttcgccaagtggcttggtgcaactttgaatttggatctaacggtactcagtcatgggcccggatgaccttacattggagaagcacgtgagaaggcccagaaaccgagcctgctcaggcgttcctgcacgaaaaaacccgcaagcaagcttgcgggttcatgcatatattcagaaattagtcaaggatttcggaaacaacgccggcaccaacagtacggccgccttcacggacggtgaacttggtacctttttcgatagcaaccggagcaatcaggtcaacttcgaaagtaacgttatcgccaggcataaccatttcaacgccatctggcaattcaatcacaccggtaacatcagtggtgtggaagtagaactgcggacgatagtttgagaagaatggcgtatgacggccaccttcttcttttgtcaagatataaacttcacccttgaacttgttgtgcaattggattgaacctggctttgccaaaacttggccacgttcaacttgttcgcggttaacaccacgaagcaagacaccaacgttatcgccggcttcaccaagatccaaggtcttacggaacatttcaagaccagtaacggtagacttgataacatctggcttcaagccgatgatttcaacttcgtcaccaatcttaaccgtcccacgatcgatacggccagaagcaactgtaccacgaccagtgatggtgaagacatcttcaacaggcatcaagaaaggcttgtctgtttcacgaacaggtgttgggatatattcatcgatggtatccatcaattccatgataaccttttcctgttctggatcgccttcaagggccttcaaagcagaaccacggataacaggaatatcatcaccaggataatcgtattcgctgagcagttcccggacttccatttcaaccaagtcgatcaattctggatcgtcaaccaagtctgtcttgttcaggaaaacaacgatgtaatcaacgccgacctgacgagccaacaagatatgctcacgggtctgtggcattgggccatcagttgccgcaacaaccaagatcgcaccatccatctgtgcagcaccggtgatcatgttcttaacgtagtcagcatgccctggcgcatcaatatgtgcgtagtggcgcttttcggtttcatattcaacgtgggcggtgttgattgtgatgccacgttccttttcttctggagcagcatcgatagaagcgtagtcttgcgctttggcaaggcccttttctgacaataccttagtgatagccgcggtcaaagtagtcttaccgtggtcaacgtgcccgatcgtaccaatgtttacgtggggctttgtgcgttcatagtgttctttttcagccatgaaaaaacgaacctcctgtatttttcgtaagaatacaggataccttgtgtaccctgataatcctttacgtttaagtgtactacatttgagcgtaaataccaaaacaaatatctacgctggaaatgaattccagcaatgagtatacatggtcaatttcactttgtaaacagatagcgtcaagtttctttcatttacagtgaaaacgtatcgttacgcctgttccgacaattttgccgtttcggcggtctgccatgcaaaaagttgatcaaataccgtgcttttaccttggtgatgatccaaataagcttggacgaatgcagctggatctggaatcagacggtcaatatcgggatagagaaaggcaatttgcacccgcgccatcagaaccaatgccgtccctagttcctgatcatcatcgcccaaggcagcttgcaactgagtcaaaatggccggtccgcttttttcctccgccattccaggcaactcatttggcacaagggtttcaatgcggtcatatgcctgatatctgacaggttggttataactgatacttgtcaacaaatctagcaaagacacgcgcatcgcaacaggaaccgtttgatcggccaaattaggcacagctgcttcaactaacgccgcttttggcaaaatgccaatttggctgaacaaatcttgctgctcctgccgcgaaaagccgccgagatggctgatttttcgcaccaatgaagcaatctgttcaccatggctacttaaagcaagtgcctcggcagcgtcaatttgtcggtcaaaagtagcacgccgcaccgcatcaaaatggcgcaacatgccacgtgccatgacaaaattgagtgtccctaaccaggcatccaacattaactgaacgtctgcgtctgtctgcatgaaagcttgatagtgtggcaacatcacatttaagctttcgtgaaactgcttcaagccattcaaacttgcggccaacggttgggcaattgcatacgattgatctgcttcataggctttttcaaaatgagccgctgccgaagcataattgcccttctgcaaagcttgctcgccgatgtcaaaatgacgtttttcattatccggtaatgaaaccatttttgccataagaaccctcctgtcgtgctgtagaaagcgtgtcatcactgcaaaaataaaaaatccggaaatggtgatccgaattttctttttgattattggcgcttggcgctattttgattaacttccataatgaccggcaggataactgggcggcgtttcgtctgttcaaacagaaaacgactaagtttatcgcggacatcctgcttcaaatgtgtccagtcgaattctttgttgtccaagttcttttggaccgtatcagtcactagtgtgccgctttcggcaagcagatcacgactggtcttcagataaacgaatccgcgactcgtgactttcggctttgatacgacgcgttttttcttgcgatcaatcgtcacaactgcaatgaaaatgccgtcttccgcaagcattttacgatctcgtaaaacgatattgccaatatcaccgacaccgatcccgtcaatcatggtgttacctgcattaacatgacccgatgcagtcattttacctttttcataacgtaaaatgtcgcccattccaacaataaagatattggcagttgggataccggcttcatgcgcaatctccgcgtgagcagccatcagacggtattcgccttgcactggcacaagatattgaggttttaacaagtcgatcataagctgaagatcgtttttgtaggcgtggccagatgaatgaatatcatccccaagcactttcacatctccgccagcacgataaatcatgtctttcgtacgtgctgccatggtttccatggcatgggcgatggtggtcgtaataaagactaaatcaccttcatgaatgtgaatcaaacgatgccgagaagtcgccatgcgttgcaaggacttcatcggttcacccatacgaccagtttccaaaataaccgttttttctggggcaagcgctttgagttccttggttttagcaaggacgtcctcattcggcagcttgatgtagtccatgcgaattgcagtcttgactactttttcaacatctcggccggtcaaaacgacgcgtcgtccgagcgaagcggccgcattaataacctgctgaatgcgctgaatgttgctggcaacaccggcaacaatgatccggccatcctgatactcgaatgtttctttaatgtgatcataaatttcatgttcattagcatttggataaggagattccgcattggccgaatccgaaagcaaggccaatacctttttattcccaatctgtgccaagcgcgcccaatcagtttgatacatcggtgtggcactggggtcaaatttgaaatcaccggtataaacaatctgaccttcgctggtttcaatatcgatccccaacgatccgggaatactatgtgttgtcctaaagaaggagacagacacatcgccaaaatcaatgaccgacttctcatcaatcacatgaaagtctttgaactttttagcctgagcatcatgttgcatgaataccttggccatcgcgatcgtcaattccgagccaaaaactggcacaggatgttccaccaaaaaatatggtaaggcaccaaccgcatccgcatgtccgtggctcaggaaaatcccggcaatccgatcagcattttcagttaaataactaaaatcagggataacaacatcaatgccaagtaactcattatcagggtattttaacccaaaatcgcatacaaaaatttggtcgtcaacttcgacggcgtacatgttttttccgttttcacgtaccccaccaagagcgaccagattgatcttcgtcatggtttcacctcgtggttaatttatggaagcgcggcaatgatgatcactcaaacccgcttccgccgaataaattcttatacaagtgtaccacatgacagaaggaaaacctatagagcgcaattggatgcatttcaaagacttcatgccaaatgagcctaagtacagatgtttctttctaaacgtgattctcaaagaaacgttgcacaacgtggtgattttgtttggccgctgcaacggctgtctgatagccagcatcactcgtctgtgccgcgtcaagatgataggccgctacttcatgatccgccattaaaacgactgcaacttctgatgagcaaccagctgctagatgtttgccatggtcgttggctaggatcgccaacgctgcttgcccggttactgggccgaagcccatgccatgagcttgtggtaggatattttgcacccacgctttcaaatctatcggttgcaagcgatcatccggtacagttaaaaacgcggtatcaccagcaagccaaaagtccaccattgtaccagccacttgaggcatgatcgtcagtcctgtcggcgttgctgtcattagcagttcacgattttgtaaaatagtggttaccgttttttgcaactctgacggcaacaacgataaggttggtgttttaccaattaagccaatcgcaatcgcctgcactaattgctgaagaggcagtgcaataccctctgcggcggtctgtactgctccttttttagtgatccccgcagcggcccactgatcagcagccattgctgcaaagacaaccgttatctgatgtgtcgctgctaaaaccgtgattctcaacaaatgatcctcataacgttgacgatattccgctcccatgatgcttactcctttgtctggcattccggttttcataacgcgctcgtagtcgcaaatagtctacacctaaaaggcttgaacacaaggacgtttcccagactacatttaaaagcccttcacacgccgctttctaatcagactagtttgtaaccatcaaaaaaaggccgccaaggcgacctttcaaagttaaattaacgacgcagacccaatgctttaatcagatcacggtaacgcgtaatatccttgttacgtagatatgcaagcaagttacgacgatgaccgatcttcttcatcaaaccaacgtaactatgatgatccttcttatgaacggacaaatggtcattcaaggccaaaatttctgcagttaaaactgcgatttggacttcgggtgaacccgtatccccatcatgccgtgcatactgcttgatgatttcatctttttgtgtttgttcaattgccattgtgtgtaccacctttctgagtattgcctgaaactgagtaaagcgtcggtggttcgctaaactaagtatcaggttcaaaagtacttacttactttaccggagctgcccaatgattgcaagtctttttgcctatcaagcattttccctttacaactttttattgcattgcccccaagccttctgtataatagcgactgttgaaacttatgcagttttatcataatccactgttggaggtgaacatctcatgccacaaatcaaatctgcaatcaagcgcgttaagacgcaagaagctgctcgtgtacgtaacattgcgcaaatgaacgcaatgcgtaccgctgttaagaagttcaagaccgcaaccgaacaaaatgctgacaacagtcaggatctttacaaggctgctgcccgtgctatcgacatggcaaacagcaaaggcctgatcaagaagaacaaggccggccgcgacaagagtcgtctttctgcactacttaacaagtaattaaggcgtcatgccaaataaaatcccctcgggtttctatccgaggggatttttgcgtctaacgatcatttgcaatccgcacgatgttgcttaaccgcgcacatgcttgccagactgctgtcctgtgtactttagcataaatagttcaaaagccaacgccttatcgatagttcccgttttcattgctgtttcagtatcaaccaagccactgtaggcagtcgcgagctgctgataaggtaagcgatccacttgccgcatggctaacttaacccgatatggatgggccttgagggtgccagcaatatcgccttgactataccctttttttgctaataatttcacctgcagcaatagtcgaaactggcctagcatcaatgcgttcaaacgaatgggttcttcacgctgagccaataaatcacgatacagcgccaaagcggccgcagcatttttgcgcaaaacatcagtcaccaagtcaaacacccgatcattgagctgcttaggtactagggcttcgaccgcggcaacggtcagcgggctgccatcactggcataggtcagcagtttgcgaacctcacccatcatgatcgaatactggccgttagtgcgctgcacaagggtatccaatgccggtgcatcaatggtcacttggtgcttcttaaatgtttgggctaaagcagcacgcgcctcccgttcatcaagcggtgctgcattcacaatgagcgccgcctttttcaatgccttggtcaaccttttccgttcatcaagtttcttataaggcgcgatgatgaccatcatcgttgacggtactgggttctcaaaataagcctgcaaaccagcaagatcatgatcgattttgtcggcatttttttcgcctgtcaaaaaatacggatcgtcaataacgacttcccgataatccccaaaaaagggcatcgaggtcgcatcattcaaggctgcaccaacaggcgtttgctgcatatcatagcggccaaagttcatggcctgttgatcttccggaatcatgctggctatcgcgtgttgtgcctgctgacgcaatgcggattcttcaccgagaatcaatgtcagcggcggtcgttcgccattcttaagatgtttgataaaatcacggacctgcattgctgctttgctcctttgttggtaaccagccaaaaagctgatcttcctgtttgttttgccccggctcaacccacagcattcctcgctcgctagtgctagcccatggaacgtgggctgcagccaacgttgcaagggtttctggatggggatgaccataccgattatcgacaccggcggaaataagtgctgcttttaaatgcaagctattgatcaatgccggggtacttgatgttttcgaaccatgatggccgacttttaaataatcggccgttagctgacgcggcatgatattcttttcttccgcttctttttcggcgtcgccagttaacaaccaactgctgttgcctattttaccatagagcacaattgaatcggcgtttgtcttggtaggatcgccggatgtctgcgctttcggtgatacgacctgaaatttagcgggtccaatgcgcaaccagtcatcagccgccacgagctgcacatgttgcacttgcttggcaactttttgaatcatttgatgctgaacgcttgtcgctgtggtgatcagtcgaccgactggcattagctgagatagcaacggggcatcgccaacatggtccatatccggatgcgtcagtaataaggtatccagccgagcatagccgcgagcatgcaaatatggcacaatggctcgtcggacaggtggattggtcgtcttcccgaaaattcgcccaccagtatcaatcaacaaagcaccttgatgaaaaggggtttcaatcaaaattgcgtccccttgtccaacgtcaaacatgaccacccgataatttggctgataccaacaccagccaaagacagtcacgaaccagcaagccgccgccaaccagcgtttagcaacaatcaccgtcagcatcacgacaataccgataagtgctaaccaacttggaaaagcgccagtgactatttggccaggtacacggcttaaactaactaagccattttccaacaattgcaaaccatcgtcaaaggtggcgtgtggcaaaagcaacgcgatcgcaagccctggcatgaccccaagttcaaagatcggcattaacagccagttaaaaagaaccgtcaatatattgaagctgaacgtgtgccaagcaatcactggcatactggcaagtaccagtcgccagttgagctgccacgaacgcatggcaggaagcgccactaataaaccggttaacagataagttagttgaccacccatggttaacaaaacccgcggttgccaaaataaattaaccattaaaacgaagctaaataagtcaagcccgctgaagccaagttgcaaatgatcattcacaataccggccaatcgcatccaaactgcgcgccacaatccagcaccaagtggcaataggagtaacaacaacggcagtaggacgattagactcagatcaactaacccttgaggcactcgcaagcgcgccgcaaaccagtataaaccggcagtaattgcaaaaagatgcatccctgaaacagagaaaacgtgaaagatccctaagtcaacgaaagcttgccgctgagtcaaaaagtcctcatcaagttggcctagaaataggccttttgcatattgacgaacttttgttggcaattgctcaaaatagtcaaataaatgaacccgccaaccatcaactagctctgctatattttgtggcgaccttaactcgaaattcaattgcggtttcactaactcgtaggctaactgctgtgtttgccaaacataagtcgcgtaatcaaactcaaactgatttcgtgccggcgctagacgttttatttgatgctgaccttgcagcacgagtggttgattatttgattttagtcgggcagcgacggcctgattgacactgccgcgaccactaacaatcaccccattagctgctcgaccagtaaaacttgcgtaaccttctttaagtttgagtgctgtcgcagggatcacaattgatccttggggaacaggcggttgccgccactgctgggcatcaatcaaaccacgtcctaacccaacgagaatagccaaacttacgactatgaccagattgcgagtcgttttaacgagtagccaaagcaacaataaacaagctggcaaccatcccccaatgccaatcaagataccagcaagcaaacctgctgccattaaaataaaccgaccactcatgggccaaccgttagctgaggtgctaaagtctcaaacgttttatcgccaatgccgtgaacctcttttaattcggccacatccttaaatccaccatgactatcgcgataactgataatgtcagcggcttttttcggaccgatgccgctgattgtctggagttggctaacatcagctgtgtttagattcacaactgcacgactaccagcagtcgcatttgtttggccagcagtgccgccagtgctggcagtctttgaagctggcgcggtggcaacagcgccacctttctctggaatctgaagactttcttgatccaccgctagcttggcaaaattcacctgactgatatcagctttgtctgtgagcccaccagcggctttaaccaccgcatcccaacgcgtatcagcacgaaccggatataacccaggcttttggactgctcctttgatatgcacaaatccgcgggttggtcggctggtactgcttcttgtctgactactggacgctatggtggtcgactgaccatgaacattagatgcatgactgcgagtggtgtgaacactaacggccagctgggattgtgcttgggctgccttagtttgctgccagaaaaagaaccctccgacaagcaccaccagcggtacataccaataagttttcaaccaaaacataagtgtcgtcatctctctcacctcaccaacacattacgcaggccaagaaaaaaagaactgccttggttggcagttcttcatcatcaccatctcttcatgccaatgttcgatcaactggcaagcgcttatgatgctgattttgcataagtttccatgtaacgaatgacatcttgcaatgttttgaccgggacaatcttcatcttggtcttaatctgcttcgctgtttcgacggcttcagcgtagttgttgacgtaattgggatcataatgttttagcttttttgtagctggctgattgggggcaaaaaagagttttgcgcctttggcatcggcagcaaccaccttcttatcaatcccgccaatttgccccacattaccatcgctatcgatcgtcccggtaccggcaatcactgctccccgccgcagattctggtgtgtaatttgcgtgtaaatctgtaaggcaaacatcgtaccggcactcggtccgccgatgttaccggcatcaatagtcactttcggttcacttgtgaccgccgtgttctccgtcagtgtgataccaatacccgcccgttttgtttgcggtaaccgcatcagcttgccagttgcttgtttggtctttcccttgtgctggtatgtcagtgtcagacttgatccgacctttttagatttgatcgcattgacataggcatcagcggttgtatagtgctggccattcaattcggtaatcgtgtctcctaacgccagcttacctttgaatggcgactgcggcagcacggacatgacataaatacccaaatgttccgttttcactggcattttggccgctttgaatgctgccgcaaccgcgttattagcggcacttttcatatagtaggcttgcagctgatcatactcagcgctactatcattgcccatcagatcctgtttcgacacaatatcggtgtgcgcctgcaccttactgagcagaagtaatgccggagatgctggccctacgacacccactgtcgtcaacatataggcacccttggcatcatctttattgccactgactttaacgtacggcttcaaagattccgctgaaccgggcacttctagatagtaattggttgggatcaaaaagaagacatccaacaaaacgactgctattaacagtccgataagccaacgccagcgccgacgtttctgattacttggtttgatgagcgtcacctagtttcgcatacaaagctgcttcgacaggcgcaggcacaaaacgatgaacgtcaccgccaaaggccgcgacctctttgatgatggtactggataaggcatcatattgcttgtctgccagcaagaaaactgtttcgatttcaggatcgagatcatgattcaccgtcgcaatatcagcctcgtaaccaaagtccgcgacattgcggataccacgaatcataaactgggcaccgattgaccgggcaaattcaactgttaatcgtttaggcgctgccatggctttaacatttggtagcccagcggtgctttcactgatcagcgccaatttctcttcactggaaaaaagcggctttttgctcgtgttggtcatggctgctacaaccacttcatcaaacaaccgactagctcttttgacggtatcaagatgaccgttcgtgaaaggatcaaaactaccgggaaacactgcaatttttttagtcattgttttcctcgcttcgctctaaaattaagacctgcgccaccccataggtttggcgccgtagcttgatgtagccggggatctcatcaggataagtcacatccataccggtttcaactaaaacacgtgcgcctggccgcagcaaattagtactgataaacgccgcaagttgtgccaatacttgctgttgcgcatagggtggatccatcatgattaagtcaaactgttggccagcttccgcaaactggcggatagccttattgaccggttgcttcaaaacggtgaagtgctcaggctgtttggttagtgcaagattggttttgatcgttttgattgcggcgtactgccgatcaaccaacgtcgcgtgaaccataccacgcgagactgcttcaatgcccaacgcaccggtgccagcatacaagtcgagtgcctgtccgccgtcaaagtatggtcccagcatgttaaacatggattccttgactttatctgcagttggccgggtttggttacctgccactgccgtcagccgcaatccccgaaatgctccactaatgacgcgcatcgtgatcacctactgatgtctcatcgccagccgaacttggccgcaagcgacgttttggcttggctttcacctcaagatcctcttcagtcggcttaaattggccgatgttgctaccgaattcagtcgccaattctggccgatgggagggctcaacacgtttaacaaatcgtaatttactgagtttggcgcttgtctgagccaactcgtcttgatccaaataaagataaacatacttcatgcggcgcgagacatacataatcgtgccatatcgacgcagcgtttttaattgtttgagggaatacacccaaacgacaagtccttgccgctgtttgatagcaaacattttttcaccttccaaactcactgcttggtcacaccgggttgaagcttggccagcagttcctgactcttaattaaggcgcctgcctccacgtaaagatgagtgacggtacctgcaaatggtgcatgaaccgtcgtctccatcttcatggcttcaatgacaaacaaggcatccccttgtgccacttcttgaccggacttaacggcaactgaaacaattttccctgccatcggtgcaccaatttgattacgatcagtcggttccgccaactgatgccgcaaccccgcgctcttctgatgcgcatcgcggatttgaacttcctgcttttgaccatcaacagtaaagtacagcgtcttcataccacttgcatccgcctcgccgatcgcgttgagctggataatcattgtcttacctgctttaatcggcacagacacggtttcgcctatccgcattccttggaaatacgatggcgaatccaacatcgtcaccggtccaatctgccgttgcttgcgggcgtatgcattaaagacatccggatacagaattgcactcaaaacgtcttctgtgctgggttcattcatcccggcttgtactaacgccgcgcgaacagccttcaggtcagccggcttcgccaattgccctggacgtaccgtcaacggtttttgtcctttcagaatttttgcttggagcgctttcggaaaaccaccaaccggctgcccgagatcgcctttaaagaatgccacgaccgaggccggaaaatcatattgctcaccatgcgccaacacttcatcgggtgtcaagtgattttgcagcatgaacaacgccatatcacccaccacctttgaggatggcgttactttgatgatatcgccaaataaggtatttacctgagcatacatcgttttaacggcctcaaaatccgttatccccatgctacgcgcttgttgctgcaagttactatactggccacctggcatctggactgcataaatatccgttagcggacccgtcacaccattactaaaatcggcatagtaaggcctgattgcctgaaaatagcgattcaacttctgcgccttttcaatggcaacatctggctgtcgctgattgccacttaatgcatagtaaagactttctagactaggctgactggtcgttccggaaaaactgctttgcgccacatcaacgatatcgacccccgcattagcagcggctacataagtcgcgataccgttaccagtggtgtcatgtgtgtgcaaatgaatcggcacactgaccgcatctttgagcgccgttactaactctgtcgccgcttgcggtttcaacaagccggccatgtctttaatcgcaagcatgtcggcaccagctgccactaattgtttggccagatcaacataataagctagctgatacttagggtgggcatgacttagaatgtcgcctgtgtaacacatcgtcgcctcagcaagcttgcctgtttgtttgacggtatcaatactgagcgtcatctgtggcaaccagttcaaactgtcaaaaattcgaaaaacatcaacgccatcgtcagctgctttttgaatgaaagctttaatcacattgtccggatagttttgatagccgaccgcgttactgccacggaataacatctgtaacaaggtatgcggcaaggctgcccgcaattttttcaaacgggtccacggatcctcgttcaaaaaccgataagcgacatcgaacgtcgccccgccccatacttccatggaaaaaagatttggcaagccattgcccatatcctgtgcgaccgtcaacatgtctcgagtgcgcatccgggtagcaaaaagactttgatgggcatcacgaaaagtcgtgtccgttaacagcaactggttttgtgccttaatccaatcagtaaccccttgcgcaccgtcagaatgcagcaaggcaactaaatctttttgcggcttggcagcaggaaaatgaacatcatagcgcaattcagggtaatatttttgtgcctgtcgttcaacacctttgaacccattaaccgtcacatcactgatgtaccacagtaaccgcgaagccgtgtcgggctttgcctgaacttgcaagagttctggatgggcatcaataaacgcggtttctgcttcacctgtccggaaagtttctgtcgctaataagtgctcaaggaaagcaacattggttttgacgccggtgatttgaaattcatgtaaagcgcgttgcattttggctacggcagcggtgaaattcggtgcgtgaacactggcctttactaataaggagtcgaaataaggactgacaactgccccagcataggcattcccgacatcaaggcggatcccgaagccgcctggtgaccgataagtattaatggtgcctgtgtctggcatgaaattgttttcaggatcctcagtcgtaatccggcactggatcgccgcgccattttcatgcaaatctgcctgctttggcaaatgcaagtctgcaaaaagatcggcgcctgctgcaatctttaactgtgactgcacaatatccacatcggtaatcagttcggtgatcgtgtgttccacttgtacccgcggattaacttcaatgaagtagtactgatcgccatcaaccaaaaattcaacggtaccggcattttcatagtgcaaaccttgcattaaatcaacagcgctttggcaaattcgcgcccgcaaggctgttggcaatgccacagctggggcaatttcaaccactttttgttggcggcgctgtactgaacaatcacgttcgaagaggtgcaacaaatggccatgctcatcgccaagaacttggacttcgatatgtttggcggaggcaatgtacttttcaacgtacatccgatcatcgccaaaactagctttcgcttcattcaccgcattttgatacacggcctcaagttcagcttcagagtgaacgattcgcatacctttcccgccgccgcctgatgctgctttaagcatcaccggaaaaccgtgtgtggctgtgaaatcctgaatttcgctaaaatcgcgcgttggttccggcgtgccgggaatagtcgccaagcctgccttgtgagcagcttccttggccgcaactttatcgccaaaaatatcgagtaattccgaacgcgggccaacaaaaatgagcccggctgcccgaactttccgggcaaactcagcattttctgaaagcaggccataacccgggtgaatcgcgtccgcgccgctttgcttggcaatgcggataatatcgtccatatccaaataggcagcgataggcgcttttcctgctccgacctgataactttcctgcgctttgaatcgatgaattgacaaagcgtcctctttagcaaaaataccgactgttttaagaccaagctcttcacaggcacgaaaaatccgaatggcgatttcgccacgattagcgactaaaactttatgcatgcgtcttctctacctttcgttgcgtacgttcactatgataactgatatttaacataatgccgatcgccattgacagcacgatcatactcgaaccgccgtaactgataaacggcagcgtcaccccggtaactggcaaaaccccagtcacagcaccaacgttgaaaacggtttgcaccagcatcatcgtggcaatgccgtacgcgatcaacgtgtgatagatgttcttggagcgaattccgatcagataaaaacgcatgatcaggaaaaacagcaaactcaatacgacaaatgtcccaaccaagccaagttcctcggcaatcacggccaaaataaagtcagtataaggctcaggcagatagcctaacttttggctgcccatgcctagtccaacaccaaacagcccaccgtgattgatcgcatacaaggagttaacaacctgattgccaaccgtattcgctttagcaaacggatgaatggcggccactaatcgttgatagccgtaattcttctccaatccgggaaaatgataatgcgacacgatgtagtagcccagtgctgtgatcgcgatcaacatcaagacccacaaaaaaccgtaacgcatcggtatcccgctggacataaccacgaccaatgtaatcaagaaaagaatggcaaatccaccggtatccggttcgacaaaaaccagaagcatgatcataccagcgacaaacaatggctgccacatctgccttagccgaaagtcctcttgttgaaagcgatcctcgcgcgatgtcagcatgtgcgccagataaaaaatcaaaatcattttagcaaattctgatggctgtaagcgaaacccgccaatcgtgatccatgcagcggccccgttaacggcgcggccgtgcacaatgagatagatcagcatcacaactagtccggccattaaagtcaacagaacccaacgattgtggaccaccttcaaggacatattataaaagaaaaacacagtcgcgataccgagcaggacaaacagtgcctgttgaatcaagtatttcgtttcggcaacgccatattgccgttgaacccaataagcgctggcagagtacaccatgacaataccgatcgcacataaaacgaggtacggaactaatatgaagtaatccacgtgccgtaatttattcatcaatgaaaacgcggcctttcaagcaattaatggactaattatagcatatcgccttcacgctccaagccgtgttctgcggtaatcactaaaaactgttttttcaggcggtcatttacaccaatacatgctgatttaacaaccgctcagtcgacaagttaagccttgtctaacaatcacaattattgtgatcaagacatcaaaaaagccgccttttacagacgactttttgatcaacttatttacttggatgcggcaattttcttgcgcttagccgctttttgacgttcgcctgtgttaaggatcttcttacgcaagcgaatgttcttaggggtaacttcgcagtattcgtcatcattcaagaattcaatggattcttcaagcgtcatatcttttggcgtcttgatggctgctgcgtggtctttcccggctgcacgggtgttggtcaagttcttacctttggtgacattgactgcaatgtcattttcacgcgagttttgaccaacaatcatgccttcataaacctcggtgccggcattgataaacaactggccacggtcttcaacggattgcagactgtacgtcgttgctgaaccagcgttgatggaaaccaaagcaccttgtgtacggcctggttcccaattcttgataaccggagcgtatttttcgaaggtatggttcatgatgccgtaaccgccagtagcagagagaaattcggttgagtacccgatcagaccacgagaaggcgccaagaatgtcaaacgggtttgaccgttgccttcgttctccatgttctgcatttcgcctttacgttggctcatcgcatcaatgactgtcccagtatattgttcaggagtgtcaatttggacgctttcgaacggttccatcatgacaccatcaatgtcacgatagataacttcaggacgacctaattgcaattcaaaaccttcgcgccgcatctcttcaaccaaaattgaaagatgcaattcgccacgaccggaaaccatccaggcacctgcctgatcagtgtcgtcaacgcgcagcgacacatctgtctgcaattgcgacttcagacgctcctcaagtttacgagcagtcacatttttaccttcacgacctgcaaatggactgtcattcgcaacaaacatcatctgcaaagttggttcatcaatccgcaaaatcggcaaagcttccggcgtatcagctgcagtcaccgtttcaccaacgaagatgtcatccatcccagaaaccgcgatcaaatcgccggctttagcagagttgatttcggttcgggtcaagccaaagaaaccaaagagttttgtcacgcggaagttcttttgagaaccatccagcttcataacggtaacattgtcgccgattttaatcttgccgcggaaaatccgaccaatcccaattcgaccaacgtaatcgttgtaatcaagcatcgcaacttggaactgcaaaggttcgtcactgttgtcgatgggtgccggaatggttttgacgatggtctcaaacaacggggtcatggtgtgcttttgcgttgacaaatcggaatccatgctggaagtgccattgacagcggaagcatagacaaccgggaattccagttgtgcatcatcagcgcccaattcaatgaacaattcgagaacttcatcaacgacttcttcagggcgcgcacctggacgatcgaccttgttgatgacaacgatcggtgtcaaatgctgttcaagcgcctttttcaagacaaaccgcgtttgcggcattgggccttcaaaagcgtcaacgacaagcaaaacgccgtcaaccatcttcataactcgttccacttcaccaccaaagtcagcatgccccggggtatcgaggatgttgatggtcgtatcgccgaacttaactgccgtgtttttactcaggatggtgatcccacgttctttttcaatggcgttggtatccattgcccgatcctgtaattgaatgtgttgatcaagtgtatctgattgtttaagcatttcgttaaccaatgtggtcttaccatggtcaacgtgggcaatgatcgcaatgttgcgaatatcgtcacgtgttttcacgatttatacttcctttctgctggcactactggccgcctaccgcattaaaaaagtgccagcaactgacacagttatacgatttgaaattataacacacaatgacaagtctgtctggattttctgaaaagtgaagtgcttcacgcaatcacagacattgcattttcttataaagcgggctatcacgcgacccttttattaagaaaaaaactggcgccacttagtttgcgccagaaatcatgatttgtctattggtttagcttaagcctctttgccgccatccgccatcatcgtcaaaatcgtttgatgtgcctttggtgtagcagcaaccacaacgcctggttgctgcaagttgattggtgcgccatcttcacggctgaaaacaacgccaagacccttagtaatcgccattccagccgctacgtcccacggctgtaagtaagacacatacccgatctgtcgacccagcgcaatttcgatgaattccattcctgcactgccgctcattctagcgccagaactggtcaacgcgatatcgcctagatgcaaccgattcttaatcgtcatcggaccattgacacctaacaagccatctttaagcggcaagtctggcaaaaccttcacttgttgtccagcatgggtgacgggaatcattgggcccccgctaagcacttcatttcgcatgacgtccataatcgcgccgacaacaggttcaccgtcctgataaacaccaatcataatggcaaaatgtgcttgttgtttgacgaaattcatggtgccgtctattggatcgacaaagaagacgagaccagctaaatcagtgtcatcgtgctcatgtccttcttcgccaatgataccggcttcaggatacgcctctctgattttgccaatcaaaaattgttgattcgccttgtcgacattggtgaccaaatcgttgcgattacttttggtggcaacatctaatggggcggccattgcggttagaatttgtttgcgactagcagcaaaccagctaataatcgtttgccgcaacatttctggatcttgtgtcatggttaactcacccttaccctaatcttttggctcacgcctttgcgggccatctgtataacagtatacatggaataaccggacagtgcttcaaactcccgatccaatttgcgctcggttcctttatctggcacaacttccttaaatccacggtacgctgcaagcagattatcacgatcaacaccgtgttcatatgcatcttcgactaaggtataaaaggtcgtgacttttactttttcggcagttgtccagtcaatgtcgagtggataggcataattaggtttcatgtttactagctccttgttctatcgccttaatttgatcctgtacagtttgtttcgtttgactcaacgcagcttcctcatcatccgaaccagcaactgtggcgagcgtcacaacgccgctatcattcaagaggactggcgaactataaacctgacctgtgtcatcctctacatccatcagatgcgtcagcgtgccaatcaaactatcgccactatacgccgcaataatcggaatcaccaacctcccaagcaagacagtcaagggactcctcaaaaagcttcgaaccgcatccaagccatcagtaaaaatcgtctgatcatttaataagcgcaaaaccggcgttgcaccaacgtaagctcggctccaaatcaacactggggcttgtcgcgtacctaccacataagccgtcacatgtttcgccggtactgccaacctagcagccagaaattgttcaaatcgccacgttgcaccgaacgtaccaagtccaacaacctgacttttattcactccggaaaaacgttgcgcaaaatacgtaaaaagttcatcacgtgtcatcgcaacaatgattctacctgtgaagcccgccgccatcgctgaattgagaactttgcgaattgccgcaatattcgtctcaataaaatcatcggcatcaggtgaccccgcatcggtcaagattaaaatatccgccgcttttaaaactttcggcgtgacttttgcaaatgtgttttgacatatttgacttaaagctgtcaacccaaccatatcaatcaatgattcatctggttcataacaacccaccgtcaacagcaactgtgatgcaatcaatgtttctaaaagcccttgggtcccgatactggcaccgctcaccacgactctttgcatgaaaacccttcccctccactccattagttacattttaacggaagcagaatcttaagacaaaattaaaaaggggtttagacgcaattgttaactaactgaaatattagccgtttctcatcttcttgtaaaaattagctgttgccatgctcacagcattcaccattagcgataaccaaatgacacaaaaacagcctgatcaaggagatcagactgcctcatgacatctctatcagatactaaatattgattgggagtcccaatgcaacttcagcgtcatccatgataacttcactcagtgttgggtgcggatgaatggtcaaggcaagatcctcaacgttcaaaccgccttcaacagcaacggtcagttcggaaatcaaatcactagcaccggcgccagcaacttggccgccgataaccgtaccgttttcattagtgaccaagcggacaaacccttctgtctgggcaagactgagggcacgaccattggcagcaaatgggaacttgctggctttagccttgatccctttatccttcgcctcggcaactgtcatcccagttgttgcaagttcagggtccgtgaagcaaacggcaggcatcgctttgtagtcaaccgcactggctttgccgctgatggcctcagcagcgactttaccttcatagctagccttatgcgccaatgctgcacctggcacaatgtcgccaatcgcatagatattcggtttgttggtccggccttgagcatcgaccttgattaaaccgcgatcagttgtttcgaccccgacaatatcgagaccaagatcgtcagtatttggccgccgtccgaccgtcaccataacataatcggcggcaatcgtctgttccttaccatcggccgtgtacgtcactttgacacctttgccagtgtcttcagcttctttagccatcgcattggtaataactgttacgccacgttttttgaaggaattcagaactagctgaaccatatccttctcaaagtttggcagaatcgaacttgtgccttcaagaatcgtgacatgcgcgccaagattagcatacgcactcgccaactcggagccgatatagccgccgccaatgacgacaaattcttttggtacttcaggaagattcagaccccctgttgaatctaaaatgcgcttgccaaacttaaagcctttaatttcgattggccggctgccagtcgcgatgatcagattcttgaacgtataggtctgagctgaatctttttgcatcacgcgcaggctatggtcatcttttaagaacgccgtgcccataatcgtgtcaatcttgtgtttcttgaatagcatcgacacaccgcttgtcagcgtatgcacaaccttattttgcttccattcctgggttttcgtgaaatcaaggtcagcacctttggcattaatgccaaacgtacttgcttccaaggcgtcttgatagcgatgacctgcgttgatcaaagcctttgatgggatgcagccgacattcaaacaaacaccgccaatgaacgtgctctcaatcacggtcaccttttgacccatttcagctgcgcgaatcgcagcaacataaccgccggggccggaaccaatgacgacggtatccaaatcgattgcaaaatcgcctacaaccatgcttatccctccatcaacagcagatcaggatctgccaacaatttatccatcagattcaaggcggtttgtgctaacgcgccgtcaatcaaacgatggtcatagctcaaacttaatttcaacatgttgccaaccacaatttcgttgtcttcgttgacataaggctccttagcaattttgcccactccgagaatcgcaacttcaggttgattgatcactggggtgaaccagccgccgccaattgacccaacgttactgatggtcatggagccaccgcgcatttcatccggctttagtttgctgtcataagccttctgggcattttcactaatttccttagcaatttcaaacatactctttgcatcggcattcttgatcacaggcacatacaagccgtgatccgtatttgttgcaatcccaatgttgaagtaatgcttatagacaatttcatccgttgtatcatcaatggacgcattgaattctggatattcacgcaacaccgtcacaagtgctttgacgatatacggcaggaaggttaacttgatacccttatcagctgcgtattgcttgtacttcttgcgatgagccattaacttagaaacttcaacgtcatcaaaactcgtcacatgcgggctacgttgcttagaagcaagcatcgccttagcaatcgctttccgagttggggtcatcttttcacgggtttcaagttcagcttcattaccactcgaaacgtatggtgcaactgcttgcggctttggtgctgccggtgcagctggctttgctgtggctggttgcggttgtgcctgagcagcaggggctgctggctgtgcagatgcagctggtgcgcccgtcttgaatgcatcgacatcagccttggtaattcggccatgtttgccggttgctggcacttgtgagatgtcaatgccctgttcgcgtgcatactgacgcacagatggcattgctaaaatttcccggttcggatcggtgatggccgtcacgccacccgctgctggtgcagctggcgtcgcagccggtgttgcagcaaccggctgcggtgcagcgccagcctcagtagcaaccgatgtgtcattatgacccggtgcatcaatatcaaccagcgcttcaccgactgtcgcggtttcgccttctggtaccagaatcttaacaaccgttccggcaactggagaaggaatttcttcgacactcttgtcgctttgaacttctaacagcgtgtcgtcctctttgatttgatcgccaggcttgactgaccatttaacaatttcgccttctgccaaaccttcgcctagttcgggtaacttaaactgataaaccgattgcgcaggtgcaggttgcacagcaggcgttgctggagcgggtgtcgcaggggctgctgttgcagtcgcaggtgcagctgccggtccggagccatcatcgatttcaaccaatagatcaccaactgacgcggtttccccttctggaacaagaatttttaaaattttgccggagaccggagatggaatctcttcaacacttttatcactttgaacctcaagtaaggtatcgtcttccttgatgtcatcaccaggtttgacgtcccacttaacgatttcgccttctgccaaaccttcgccaagttctggcagtttgaattcaaaagccatgttggcacctcttctttctagaaattaacggtttcccggactttagcttcaatatccttagcatttggcagccaaatgttttcagcttggccaaatgggaacggggtatccggagcggcaacccgaccaatcggtgtctcaagcgacagaatcgcccgttcggaaatctcactgatcaccgttgatgcaacaccggccatgcgttgtgcttcttgcaccacaacaaccttatgcgtctttttgaccgaattgatgatcgtttcgacatcaagtggcgcaattgtccgcaagtcaacaatttcagcctgaatcccatctttggctaaattatcagcagctttcagtgcttcgcgaaccatcgcaccatacgtgatgatcgatacatctgaaccttcgcgggtcaccgccgctttgtccaacggtaccgtgtacgtgccctctggaacatcttgccggaaggaacgatatagtttcatatgctcaaggaacaataccggatcattgctccggatcgaactaatcagcaaacctttggcatcatatggattgcttggaataacgacacgcataccaggaaattgcgcaattaacccttcaaagttgtcactgtgcatttccggggtgtgaacaccaccgccaaaaggcgcccgaatcgtgatcggcattgagcgagtgccgcccatccggtaacgcatccgtgacatctgaccaccaatgctgtccatcgtttcaaaaacgaatccgaaaaactgaatttcaggaattggccgccaaccggtcaatgccaacccaatcgacaaaccgccgatgccagattccgccagtggggtatcgaaaacccgatcctcaccgtattttgcttgcaaaccatcagttgcacggaaaacaccaccgtttttcccgacatcttcgccgaataccaaggtcttagggtcgttcgccaactcaacatcaagcgcatccgtgatggcttggatcattgttttttgtgccatggttacttcgaatcctttccttgaaattctgccagctgttcagcaacattttgcggtgcggtctcgtacgtgtcctttaggaagcgggataccgtctgctgtggtgccttatcagctttgttaattgcgtccttaatttcatccttaacttgatcaattaaggcgtcttccttgtctttgttccaaagtcccttatcagtcaggtagttccgcattcgaattaacggatcgcgcttttgccataactcatctgtctccttggaacgataacgcgtcggatcatcgccagataacgtatgtggcccataacgataggtcagcgtctcaatcaagacagggccattaccagcggcggtccatgcccgcgcttcttttgtcacttcatagacagctagggcatccataccgtcaacttgcacacctggaataccagcagcaactgctttttgcgctaaagtcttcgcagccgtctgactggcccgcggtacagaaatcgcaaagccgttatcttgcacaataaagattgctggggctttgaaatggccagcaaagttgacaccttcgtagaaatcaccttgtgacgtgccaccatcaccggtatacgtgaaggctacttcatcgctgccattcttctttaagccgagtgcaacgccggctgtctggacgtactgcgcaccaataataatctgaggcggtaacgcgtgaaaatcttctgggtattcattaccggcaacatgaccacgagaccataagaatgctttatccagtggcaagccatgttgaatcaactgtggcaagtcacggtaagcaggtaacaaccagtccgttgttttcatggccgaatggctgccaatcatgctggcctcttcaccagcgcttggcgcataaaaacctaatcgtccttgccgattcaacgcggttgctcgttgatcaagaacccgctgccaaaccattttggacatcaagtcgaccaactgatcatcactcagatcgggcatgatatcaggattgacgaccttgcccgcttcatccagaatttggatggtcggcttaaaatcggcatcttgattttccaacagtttcttgaaatcaactgcagcatgctgttttgccataatcagaacctctttccattcctgttgtcattaacgcaggaaaactgtactaatgaaaatctttacaaaccaagcgtaacattgcggttttatccttgcaagcgttttatttcagcactggcgggaatccttttccgagcttgttgtgcctcattttttaacgaatgggactataacagaaccttataaaaaataagacacaaaaagagcacgtcgcttcacaagcgcgtgcctcttttaatggattcattcatcgtgcttcacgagaccggatcttggttgtgccgaaaatcacttgttttactgtgatgtttcatggcgccaaccaaggtggcgtgttgggcaaggtcggcatgtaaccgaacctgctgtgcacgatttacttgtttacttcttaacaattcacttgccaggagtgatacagcaatgccggatacccgaaaaatctgttttagcgcaaggacaaaaccaactgccgcactcgttacaagtgaagctggcgcatgattttccgtctttccgttcaattgtgcaaaggcatggtcgacaagaccatcacgcaaaaccgccgtgacggttgcttgggcatcggtcgccatcacagcgccagcaatgcctacccccgctggtacctgccgaccaatcaaagccagcagcccggccaaatcacttggcaaggaaacgtgtgcatcgggagccaacgcaacgtcaacaggcagtttttctcctgtcgtcaacatcagcacgtcaccgacgacaaggtcatttgcgctcacttggcgaaccaagccctcgcgtacaaccaaaaccgtctgtttgggatcgccctgatgtcgggtagcagctgtgagcagataaacgatcacagccatcatcatactaagcaacacgccgataacaactgtaagaagccagttgcgagtgatcacactgatcaagccactgacaccggcagtcatgatcaacaacggtaagaagagacttgccttgttgatcgtattaggacgtggtgtaactgtttgttgggccttttgcgcttcgtagcgtgacaggccactcgaaaccatcatcaacatcgacaaactccttcccgtttcccgagaaggaccgcgatgctgccaaatccattaatttcacttaagagatcgtagcggcagcacaatgggccttccgggatcagctaaatcgctactactaccgctactctttgaagattgttccattatgctcaccaccttttcctcagcttttcattaggcaaaaaaattgcacgccgattgagagcgtgcagaaaaagcatcccaatcgtttagttttagcactatacgcctagaagcgagcttcagctacattagcgtaagccttaatgggcagacgcagttgactcaattggcatctctcgatgtttctgagcagcagcattgttcgtataggagcctcacctaacggaaagcaccgtatttgtttaaccttctatatagtagggtaaaaaaaaccgaatgtcaaatgtttcaccgaatcgagcacagctgaacaatcatggcgattcaaaaaggttgttggttagaacataaaacttgcgaatcatcaattagacaaaaaacattttgtatttgtctttgtaagtgatacagagctattattttttctgtaactttatgaatcgaaatagcgtgaattccttgaaaatgagcaaagcttcaaaaatagtttttttcttgcttatcacccagacacagaaaaagtttctgctattgcagcatttaaggcaaacctcttgcacgcgaagcttttcagccttctggtcctgtgctaatctagtagaagaaatgaacggaggtacagattgtgtatttgatgaaggatatcacgcgcgatggggccaaggtcctgcgtgaaacggcaaagccagtcacgttcccactttctgacgaggacaagcaactggcgcatgatatgatggcttacttggtcatcagccaagatgaagaacaaaacgaaaagtatcatttgcgtcctggcgttggactagctgcgccacaagttgggcaaagtaaggcgatggctgctgttttggttcccggtgacgataatgaaatcctctttaaagaagttttgattaatccgcggatcatcagcaacagcgttcaacatgctgctttggctgaaggcgaaggttgcctgtccgttgataaggatgttcccggatatgtcgtccgggctgatcggattaccatcagttatcaaaatgaagccggtgaacataaaaagattcgtctgaagaactatccggctatcgtttcccagcacgaaatcgatcacttaaatggcgtcctgttttacgatcatattaataaggaacatcctttcaccatcgacccggatgccgtcattatcaagtaaaatacgcttgtactaaaaagaaggcttaaagccttctttttttgacactatttttcacccaacttacgattctttatacacaaatcgttgtccctgcaaccatgccgttaagtcttcgtactgtcgtcgcgataagcgggtgtcccgccatgttgtcaaaagtgctttagctgccgaaaagccattttccttcacttcggttatcagttttgcttgatagctggccaagctgacttccgcatcgtggaaaacgacgactggatcatcttggcgtcgatctttcttactcatcgcagcgcctaatccttgggcaaaacttttgatctgacgcatcaataaatcctgatcatcgttcacttgaacccctccattcggcactttctaaaattaagcaacgcgattcacatcgcggacatattctatggtagcctcattagcaataaaagcgagatcaacatgttgctgcccctctagttcaaagtaatccgtgatcacaaagggcggtaatgccggatcggaactggcaatatccaattcttcagccgctttttgcaaagcgtcggctaattgatgctgatcaatggtggaaaagctcttggggaaaatataggagaacgccatcacaccatgaccccaaatgtccgtaattggttttgaagtcaaaggttcttggacagggattttaagtgatgttaaagcagcatccatgacctgatcacttagtcgctggctatgatgaagcagaatttggattgctttattacgccgccagcgcttcctgagcacccacaaaacgatgagcacgatcagaactagaacaacgataagccagaccacaacgtccactcccttcaaaagccaatatgttattgattcttacctttattatacccagaacaaccatgctatcgccaatgtgattcttgcaatcggaggttagcttgacaataatagctggtcataaactcgtgggcatcatctggtttgattcctaagagagtactaggatcagtgtgccagccgcattagcaccacaaggatagaccttacaattgccgcataaccgcggtcgccagttcagaaacctacgtataacaaccttgaacgcaatagcctcactccggacatcacgttgagtagcacttacactccgatttttctaaccgggctggttcacgctctggtctgttcacaccgtttcaaatatgatagactgttgctagctgttgttttcacaacaaatcgatcggtcataaagtatttaggagttgtgacagaaatagaacgacgaaatagcgcaggtatgcctgttttcgggttcgaacgacgagaaatatcggccatcccaataagatagaccatgtctgttgtggttttccatcttgatggtatgtcctttttttcggaagccgttttgttgcacttcctttctttttgtaccacggaaggagtccatcatgatctacaaagtcttatatcagaaagacaagattcaaaatccacgacgggaaacaacccagacgctttacctcgaggcgccatctgcggttgaagcgcgtgcgcttgttgaaaagaacacgccttataatattgaattcatccaggagttatccggaaacttcctggaatacgaggaaaagtcagccaactttaagctgacaactttctaattatatgaaattaaatattaagaataacgaaaccgccgtctttgctgtcggcggtttaggtgaaattgggaagaacatgtacggggttcaattccaagatgaaatcatcgtgattgatgcagggatcaagttccctgaagatgatctgcttgggattgattatgtcatttccgattattcctacttggttcaaaacaaagacaagatcaaagcactggttattactcacggacatgaagatcatattggtggtattccctacttcttacagcaggtaccgaatgtgccaatttacgctggtccgttagcagcagctttgattcgtggcaaacttgaagaacacggtttgttacgcactaccaaattaactgaaattaacgaagacaccgtgttgaagttcaaaaaacttagtgttgagttcttccgcacgacccacagtattccggatacgctgggcatcgcggttcatacaccgcaaggcatcgtcattcaaaccggggacttcaagtttgatctcacgccggttggcgatcagccatcccctaacttccaaaaaatgtgccggttcgccgaagaaggcgtgctggtactgatgtcggattcaaccaacgcggaagtaccgacatttactaagtcagaacgatttgttggcaagtcaattcgccacatttttgatcgaattgatggtcgcatcatatttgccacctttgcgtcaaacatttcacggatcgcccaagcagctgatgcggcaatggcacacggtcgtaaaattgctgtttttggccgttcaatggaaactgcgatggtcaatggccgcgaacttggctaccttaacatccctgatgatgtcttgattgatgcccatcaacttaattcgatgccagctgataaagtgatgatcctctgtaccggttcacaaggcgaaccaatggcagcgctgagccgaattgctaatggcacgcatcgacaaatcagtattcaacctggggataccgtcatcttctccagtaatccgattcccggcaatactgtcagtgttaatcacgtgatcaatcagctaagtgaagctggtgccgaggtcatccatggcaaggtcaacaacgtccacacttccggtcatggcggtcaagaagaccagaagcttatgttgcggctaatcaagccaaaattctttatggcctgccatggtgaataccggatgcaaaagattcattgcgaacttgcccaacaatgcggcgtccctgaaaagaattgctacattatggaaaatggcgatgtattagcccttacgcaagatagtgctcgaattgcaggtcacttccctgctggcgatgtttacattgatggtaatggtgtcggcgacatcggtaatgctgtcattcgcgatcggcgcatgttgtctgaggaaggcttggttgtggtcgttgccacgatcaatatgcaaaaacaagcggtcttagctggtcctgatctgctttctcgcggcttcatctatatgcgtgaatccggcgagttgattaatcaggctcagcggcgcgtctatcgcaccattaagtcaaccttctcaagcagtgaaaaggtgacggaagctagcttaaaagatgcaatcaccagcaacttgcaagaatttttgttcgacaaaacagaacgacacccggttattttaccgatgctgattttgctctaaattccggtcagatagctggcaacgtcactcattaactgaaaatgattaacagtcacgcgacaaccacttaggtgcttgtcgagtggcttttttattagcattttttgccaaaaatcatgattaaaatcctgttatcgccttgctaggtgctggaccgacactttgctggtttgtagtcatctgcctcttcaaaaaatgttcgtttgatgacaataaggtcgtcactgttccattgtttttcgccttattttcggtataattgagtgcgtgtctattaggaggaaagctgatgacggctgttttttattatattatctataatccggcggctggcggtggttcgtcgattccaatttataaacaagtgaaggccgttttggatcagcgtcatttggcttatgccatcaaaacttcccgctatcccggacataccaacgtgatcacaaagcaaattggtgatttcaatcgacgtgagcatccggttttgttagtcattggcggggatggcaccttgaatcaagcgatcaatgggttagctggcacacgccagtcagagattcctgttgcttacgtaccagccggatcgggtaatgatttcgctcgcggtatcggtatgtctgaagatccgatgcatgcgctggaacaagtattacaggctacagaagcggtcacgattgatatcgggcgatttcatgaacgcacccgcggcgaaagtggctatttcgtgaataatatcggtattggctttgacgctgccgttgttaacgctgctaaccgtagtgatagtaagcaattgctcaataggctgcatcttggtaaactcacctacttatttcatgttgtcggtatgctgatgactcgccgtcctttcccggttgccgtctatgaaaaaggcgttcgccatttttttcatcgcgcctatatctgcaccaccaccaacattccttattttggcggcggcattcgtctttacaaaccggctaacccaaacgacgggaaacttgatctcgtgattgttgagtggtttaatatcgtctcatgggcgttggcgatgattcaactcatgcgtggtaaaaaaccgacaagtcgggctactcacattttccacgcagacaagttaacagttgagaccagttcgctcgagtttggtcagatggatggcgaggaaatgggaacacggccgtttgaaatcgacttctcaatggccaaacaaaaattttggattgatcgcagtatttaaaccgatcaaaaagcgctgtaccgccagttttcttctggtaggtgcagcgcttttctgtgattgaacatgacgatcaaaaataatctgaaaaataaggttcttccattggaatggcattttccagcaacttaatcgcatgcttactagcaaaaagtcgttcaatctgagccaaatacgatggccgccgataactcatcaacatggttgttagggtttggatatcagtttttatctcctcacccaccggccggtcagtaatttgaacttgatttttttcgtcccaataaaccccaaaggtcccattgttccacggcgccaaaggatcagttacgacaaaatgaaacgactcaggcgtttcagccgcaaacggatactgcttcagaaaagccttcacatccacaatccgggccataaagtatggtttgatcgtctgatagatatcaccatcatctaacaaaaagtgcaacggttcatttttgtaaatgttacctttaacgtgcgtcaccattgaaaaatgagcactaataaagttccataagccgactcgggcttcttggttggtgtaaatcatttccttgacgtggaagacctcgtcggcaatccaataaagaacatagccttgtggttcatcgttggcgtcataataaacaccagccgtacgctcctcctcgttttcccaacgccagtattcgtcccaattcaactggttgcggatcatcgccccatgatttttcatggcgaaccgattatacgtttcaatcacatcaggatcatcgatttccagacgctcaacatgtccgggcacattcacctgtttaggtaattgtgtgtctttcacgtcaaaagtgagatgatcggacatgatttcccatcccttttttcggtaaaaagggatgctgtaaggatataaatacgaaatccactgcttgtggtcacgcatatgctgcaagccaagtcggacaagatcgtgcatcaaaccgtggccggcatactctggatacgtgccaacccctgtcaaaccagccattttgtataatgtgccgtgaatattcactgtgcaaggataaatggccagtgaactgacaagctcatctttgtgaaaccagcccaaaacatccgatttctctaaaactggacgcttagctcgttctaactccccttcctcataaccggattgttccaagtccttttgagtcacttgaaacacataagttaatagatcgttgaactgctcgagatcctgaggcgtcactggcttaatcaccagtgacttgcgtatgttgtcctccatagctagttaattctccttcgtcataaacatttgcggagtgataccatccatcccaatcatgggatcgattcgttgagaagccaccaaggcaggcgttaattggtgcgctgccggtggttgttgtttaacttcattatccaagtcaagtgcagttgtgtcaatttgcggctcactgggacttgctgaaatatccttggttgctgaatcatcagcaacctgaggggcaacggttttgccaaacacggtcatgagccgatcgaccagcccagtatgtcgattaacggctacttcactgactgcttcctgaaaggctgccagttcgccaaccaaaatcaaaaatgatttagcccgcgtaatggcggtgtacaacaagttacgtcgcaacatccggcggctttgcaaggttagcggcaaaatcaccatcggaaactcactgccttgggctttatgaatcgaggtggcataagcaagcgtaatcttattaaaatcactgcgtttgcaagtgatttcattgccgtcaaaatcaatcgttaattcgtccgttttgctttcggcttccttgcccaaagtaatgccgacaatctgaccgatttcaccgttaaaaacattttggttgggatcattgaccagttgcaacaccttatcaccaattcgatattccgtttctccaaactgaattgctttcgttcgggcactgcgttttggattcaaaatgttttgcagtaacggattcaaacgatcaatgccagcggttccgcggtacataggtgccaacacttgaatatccgcgatcgagaattgtttgactgcggctcgttgcaccacttgtccgacaacttcaggtacctgactaggcgcacacgccaaaaaactgcgatcaacttgcggcttggtaaaatcatccggcaacttgccagcattcactgcatgcgctagcggaataattgaactgtcggcatcctgacgatgaatatgcgtcagcgctgtttgcggcagcacgccgctgcgcaataaatcagcgaatacttgtccaggaccgacacttggtaattggtctttatcgccaaccaagacaattttcattccgggatgtaatgccgttaaaagcgtccggaacaagtaagtgtcaaccattgacatctcatcaataatcaacaggccatttggtaactcattaggtgcaaattcttgcgtgtcaacacctaaaccgagcaggcgatgaatcgtactggctggcagttgggtggtttcactaatccgtttcgctgcccgtcctgttggcgctgccagcatgattggaaatggctcgtcagtcgtatactgatcaagatccaatgaaaggtcatgcaaccgtgcatacgtccgcacgataccatctgttactgtggttttcccagtacccggtcctccagtcaacagaaaaatgggcgactgtaacgccgtgacaatggcttttctttgtgtcgcatcatacgcaataccggtatccgcctcgaccgccgctaacgttttttcaatctcagccaattcaggttcggtagccgttgcgtctgcctctgccagtccttttagttgccgaccaatctgccattcagcatcgaataatcgtttcgggaaaatgcggtcgccttctgcaatcagggcgttgtctttagccagcgtcacaattgcctgtcctactgcgtctggcgaaacggcaacgtttctcgcccgttccaataaatcaagtgtctgagtgaccaatgacttcagcgtcacataggtatcaccttcgccatcagtcaaccgctgcagggtatccatcactgcaccgccaagacgaagctgcgaagtcggggcaatcgccaattttgccgcaatctgatcagcccgagtaaagccgataccatcaatatcgttaatcaattgatacggattgtgcttaatcacatctaaagcgtcattttgatattgttggtaaatacgacctgccatattgctagtaaagccgtaatcgttaagaccaataataacccgttccatgccttggttcgatttcagattcgtcgccaacatatcacgcttggcagctgtcatgcctaagcccgccaaaaccttcggatcatccagaatcttgtcaatagcatccatacccaaatgatcgataattttcgttgccgttttcggaccgatccccgggaacttatccgaactcaaataatcgaccagcccacttttattcgtcggctgatccgcatggtaattgtctgcttgaaactgctgcccatacttaggatgatccacgacatgcccagtgaacgtgtaggtcgcatcttccttaatatcaccaaacgttcctgtcaccacaatatctgactctgtccaggtgatagtcgtcgcagagatttcgatcagcagaattttaaaaaaatttgttggattctggaaaaagatacttttgacccgaccggtgacagtctcctcacgcgtgtccatcttgaccctcctgcaatcgcaagaatcggttgatatcagcgacaatgttagctttttgatcatacccttttggatcgagttccttggccttgttcaaataatgactgccatctttaccagcggcgctcagtgccatgccgtacgtgaacagaacctgtggctgttcggttgccaacaatggtttcaacactcgggctgctgcatcaaatacatcgtttgccatcagcaaatcagctgctaaaagggcggcatcaagctgctttggcgccaagtcatgcgccgttaatgcaaacgccaatgccttcgttggctggccagcttgttggtagcttaaagccaacatgtaggtagcatcatttttcaaagtctggtcggttctaaccttggcaaaccatgagactgcagccgcaaagtccgcttgagcatacgcaaacaagccagcggtgtattgcaattccagatcctctggaaaaagctggcgcgctttggccagcaattcaccggcctgatccagcgctttgatactaatcagcattgttgccaacatcgcatagcgtttcggatcatcaggggcagcatcaatggctttgactgccgcttgaatcgcctcctcatgcttgccttggttgaacatggttaaaatttttgaatccatttgaccctcttatctcgttgttgacagccgtagcaactcaaatcgtatccgttgcttttggcggttccggtaagaaactggtttcattccaatccagcaaggtaaacggcaaggtcggtccatctgcgtgcaaaatggtcacactgctattggtcaaacctccgtctttgcgaatatccgccagtggtgtgcccaacagactttgaatcaccgcagcgagtgcggccccgtggctgacgtacagcaaattagcctcaccagtgcgatccatggccacagtcgccacgatcgccggaatagcccgattaatcagttgtgaaaaagattccccatgtatttttcgtggatcataggctgccggttcatgacgaaaggcatgcagctcctgaggaaaatgcttacctacatcagtaaacgtcatcccttccattttaccgagattgaactcccgcaaagctggcataatggtcaacggaattgactcatccaaatctttaatcaaggtttgggcagttgttcgtgcacgctttaatggactgacataagcatgcataaaaggaattccttgcaaataaccggccaacgccttaatttgcgcataactctccggcaataacggcgagtccccattagcgccttgataacgcccttgattattccattctgttttgccatgacgtacaaaatacaacttcgtcacaagtcaatcccctttagtcacgaccaatgattcaaaagtcccaatcaatgaccgtactatcctttcgcatcttaactctttcattatcgagattttgaaggaaaatttcaagcagagcgtgagccaccccggttagaaatcggagtgtaagtggccttgaccgtgatggcccgggtttggccattgcggtcaaggtccttacacgcaggtttctggggtggcaaacgcgtttcagacaagagcgtgagccaccccggttagaaaccgaagcataagcggccttgaccgtgatggcccgggtttgaccattgcgatcaaggtccttatgtgcaggtttctgcgcctgcgaacgcgtttcaagcagcaatcagccgccgctatgtaaaaaagccgacataatcgccgactttctttttgcactcagtttaattaaacgtactgtaactcattcgtgtgtgcgtatgcagcatctatggttccgccacccaagcactcgtcgccgtcataaaagacaaccgcctgacccggtgtgattgcgcggactggcacgtcaaagtcaacggtggcggtgccatcatcatgataatgaagcgtcacgccagtatcccgttgacgataacggaacttggccgtcatgtgggtgccttctgccggtgcctgaccagtcgtccagttaaggttagaagcgctcaaactggtggccatcaaggctgggttgtcaaacccttggccgacatacaagatgttcttgtctaaatctttgcctaccacaaaccatggctcagaattatctgagttaccgcctatgccgaggccttggcgttgaccgattgtgtaatacatcaagccatcatgggtaccaatctcgacaccatccaccgtcatcattttgcccggctgagctggcagatacgtgctcaaaaactgcttgaaattgcgctcgccgataaagcaaataccagtcgagtccttcttctttgccgttgccagtcccgctgcctcggcgattttacgaacctcgggtttctgcaaatgaccaattgggaaaagcgacttcttaagctgatcctgtgaaagctggctcaaaaagtacgtttgatccttattgccatcagcgccgcgaagcatgtgcacgatcccgttttcgtctgtcttaacctgcgcatagtgacccatcgcaatataatccgcgttgagctgatcagcgtagtccaagaaagccttaaatttgatctccttgttgcacatcacgtcagggtttggtgtgcggccagccttgtactcatcgaggaagtattgaaaaacccgatcccaatattccttctcaaagttaatcgagtaatatgggatgccgatttcactagcaaccttggcgacgtcctcatagtccgttgttgctgtacagacgccattctcgtctgtgtcgtcccagttcttcataaagaccccgacgacatcataaccttgttgtttcagcaacagcgccgtgacactcgagtccacgccgccggacatgccgacaacaacacggatgttggaattgtccaaaacaatcaccatcatttcatcagattctggagatatccgatttgaaggtcgaattccagtaaaaaccattataacagtgaatgatgagatagcaaccgttagagcgtgagcaggcgcgggtagaaaccggagcataagtggcctcaagcctaaatggctggtctttggccatttagacttgaggtccttctgtgcaggtttctgcgcctgcgaacgcgtttcagcaagagcgtgacccaccccggttagaaaccggagcataagtggcctcaagcctaaatggctggtctttggccatttggcttgaggtccttatgtgcaggtttctggggtggcgaacgcgtttcagtcaaaaataacaagcttgccaatagcgatctagacataagcagccgccagtccaaatagccaagctttggttatttaggctggcggctgcttacgcggaactgcaaaccatcattttctggtctatgctagtttagtttttctctgatgatccaagcaaacaacaagtcaccagctcattcttgtttcagtgcaacgtgacgcagaacggtcaatacaaatacatcaagtttggcgtcaatgcctattattttgttgccgttccggcgcctgattgtattgtttcatggcttggcccgttcgtgattgtttgacagtcatgctattttcaggtgtccccgtatagcggacttgaccaccatagatgccagcgtctggacccatgtcaatgagccagtctgcctgactaatgacctctaagttgtgttcaacgatgatcaacgagttgccatctgcgacaagttcgtcaaatagctggatcaactttttcacatcttgcaaatgtaggccagcggttggctcatcaagcaagtacaaggtaccggtgcggttcaattcgacagccaactttaaacgctgcttttcgccaccggaaagtgtggtcaatggttgcccaagtgttagatagtcgaggccaacccgtgccatatttcgcaatggtgcggcaatagctggtacatccgtaaaaaagttttgtgcttttgtaatcggcatgcgcagcacgtcagagatatttttatcatgataagtgtagctcagggcctgatcattgtaacgtcgtccatgacattgttcacaagtctgtacaaccggatccatgaacgccatattggtaatggtcacgcctttacccttacaacgtgggcaagcgccgcgaccgttgtaactaaaccaactgctagccacatgattcgcgtcagcaaagactttgcgaattggatcgaggattgagagatatgtggcaggcgctgagcggatattagcaccgatatcggcttgtgccaaatcaatatatggtgcggttaactgatcacgtaaagcagataccaacgtactcttcccggaaccagcgaccccggaaatcacagtttcaatgcccagcggtactgcgacactaacatcttttaaattatgtcgatgaatatgctgcaatgaaatcgttgatgtggctggccgcggctggcgaaaagtcaatggctgtttcaacagtttccctgtcaaagtgtcactgtctaaaagggcttggtaggtacctgtaaaggtgatatgcccgcccgttgtccccgctccgggacccacttcgacaatattatcgccaatcgcaatcagtgccggattgtgttcaacgattaaaatagtgttgcctttctccttcaaacgcaaaatggcacgcttgattaattcaatatcatgcggatgcaagccaacactgggctcatccaaaatgtaaaccatatcgactaaggcactagtcaaaaacttggcaattttaatgcgctgggtttcgccgcccgacaatgtctcagtcggtcgatcaagggataggtagcctaacccaatgtcaatcaaagaatcgatttttcgtaacagctcacggatcacgtcctgaacaagtggttcttgaatgccattcagaaaatggcgaaccttgacgagatccatttgcagcacttgagcaatattcgtttgattgatgagacaagtcagaacctctggccgcaaacgtgttccatggcaggttggacatggcatacgagtgacaatttctgccaacgccgtcttatgatgttcagcctctttcttaccaataatggaccgcctgattcgcggcacaacgccttcgtacaaagctgttttaggccactttgttggcgcatgatctagtgtttgctgcggggcatacaataaggtgtccatttcctgctttgtatagtcgcccaatcgtttgtcattatcaaataaaccactgtaagcgtagcgtttccaccgccacgtgtctggtccaaaactgacaaacgtaatcgcgccctgattcaacgatttgttcgggtcaattaactttttaacatcaatgtcatccacatacccgagtccctgacatgtcttgcacattccctgtggcaggttaaaagaaaaagtgtccgaatagccaataaacggcttgccagctcgtgaaaacaacaaccgcaacaaggaataaatacccgtataggtggcaagcgttgaccgcgcatttttaccaatgcgcttctgctcgacaacaattgccactggtaaatggtcgatttggccgacatccggctgaccatatttaggtagatactgttgggtaaagctcggaaaagtctcattcagttcgcggcgggactcagcggcaatggtatcaaaaactaaagaagacttacctgaacctgatcggccgacgaaaacactaatcgcatccttaggaatctttacgttgacgtgttgcaagttattttggttagcatcgtggacctcaatgaagccgtggtcaaacatattatccctccatttcttctcttcgttaatttcagcttatcactttagcgtttctgataatcataaaaaccaatttgctacagattgacatttttactgtgaatacgatcgcttcgtaaggtttgatctaatcaaaagaaagcaaaaaagctgctaagctgtcagcctccctgaggccaacatcgtggcagcttaatgttaaagcgcggcatacatcctattttgcttcaatcacaccgcgctcaatcaaattattgatccaatattgatattgctcgacattttcttttgtggcatcggttttgaaaatgttaatcgctttaagaccattgcccgttgtgacatcgagctggaacttatctaaattctttgccaccgtcattttcagcttgtttgccgttgtgtacggtgaatttggatcaagcgagcgttgcagttgaaaattgccgttcttagtttgaacaaagcctaaatctatcaaggtaaatcgtttcaacgttgacccgatttgataggttttcggatcgccttgtgcggatccggttgctgctagtgccatacaaaaacctcccctaaacagtttcaccagcaaaaaggtggtgaaactgtttttatttcagcgcatgcgaggaacacgcttaactgtttataagtttagcatattggtcgcaacactggggaggttgataaggattattaggtggtgaaagacaatcttgagctttttaactgttgagacgcatggtaacgggtcactcgcaaaccaaacttatcgcgccgattgttttgcctgaagccgttgcacgattggtaacagggcatcaataaaggcctgaatgtctgctttggttgtttgcgcgccaaatgacaaacgaatcgactcgccaagccgcgggctatcagcgccaaacatggcagttaaaacgtgtgaaggctcaagtgaaccagctgtgcaggcagaaccaccagaaactgcaatgccagccaaatcaaggttggtctgcaaagcgtatgttgagatccccttcaaccagatattgaaaacgtgattgacattatctggccgaatatcaccattaactgcatagggaatctccgcatcatccaatgcacccataatctgctgcttaaaaccaagatactttgactgccgcttagccttctcatcagaagtgatcagactaaccgccgttgcaaacccggcaatgccagcaatgttttctgtaccagcacgacgtttcaactcctgctcgccacctttcaacaaagacgggaactgaaccttaggatcgcggtaaagaaaaccgatgcctttgggtccgttaattttgtgcgccgaaacacttaacatatcaatgtgttgcgcttgaacatcgatgtctagtaagccaaaagcctgggttgcatctgtatgaaaccaagcttgatgatcgactagtcgcgcaccaatttcactgattggcatccgactgccaacctcattattgcccatcatgatggtcactaagatagtgtcatcgtccaaagccgcgtcaaaatcagctaaactgattcggccattttcgtcgactggcagataggtcacccgaaagccttccttttccaaggcttttagcggctgcaaaacggaaggatgttcaatagccgttgtaatgatgtgcttccccaaactagcacgcgtatgcgccgtttgagtgatcgccgtattgttactttctgttgcgccgctggtgatcaccatattcccgggctgtgcatggattgcatcggccaaaattttgcgactcttgtccatgacagtatgagctgttcggccaaaccaatgagtcgaactggcattaccaaaatcgtgctccatttggtccatcatggtctgaatcacttctggggccatgggtgtggtcgccgcgttatcaagataaacatgttgcatattaacaatcaactcctaagactgaggtgatgcctgtaggtgagcaaaaaagctaagaagcatcgcggcactttgttcgcccgccttgatcacaaatttgtcaaaatccactccggactgctcgtcagcgacatcgctcattgcccggatgacaacaaacggggtatggaactctttggccacctgaccgatagccgccccttccatttcgcttgctaacgcctgcggatagattttcagaattgccgcaatcgcatcctgaccgttaacaaacttgtcgcctgtcacaatgaggccaacctttgacgttaaaccggttgtgctggctgccgcctgaattttagccacatagtctaaaccggcttcaaaaatttgcggctgttgtggcaactgccctggtaagtaaccaaaagccgttgcatctacatcatgatacgcaaccccgctcgaaataacaacatcaccgatcgccagaccttgaccaataccgccggcacttccggtgttaatcacaacatccggtttaaaagttcccaacaacaaagccgccgtcatggccgcttgaaccttgccaataccagactgaaccaaaatcacatcaatcccgtcaatttggccctcaaaataatgttgactggcaatcaccgtttcatgttgctgagtctgtttggccagtaaggtcctgatttcttcttccatggcacaaataacgccgacttttatcaaaatatcgctccgttctttcttctataatattagtgaatcaactttcttccactgcgcttgcgctacagtagccatttctggtaagtgccaagaatagctagcttacccaaaatagagtaccagaaaaacaatcaccaacaagccaaagacaatcccgatggcccaattcaatctttttttgagactgttgaccttcctgaaggtcacctcgtcaaaacgggcattcttgatttcgggtttgcctttggttttgcgagcatagtctttttcaacttcaactcgtttggcctcgcgggcgcgcgccgcgtgttgttctttttcctgtgcctcacgatatgctttgcgcgtgttaacttccgccatgttgccctcctttaacgcgtttgccaagccagaagcctgcggataaggatcatcattgcactcgttaaaaaatgaccatcacacttacgacctcttatataccaagccggttcacgctcctattccttgctgctgccaataaagtaaagccagcaaggttttgctatcgcagatgcgaccgtcatcgactgctcgccaagcttctggcagtgtcaaccattcgcctttgacgaactcatccggatcctgatgcaattgattggttgccaaatgcagctcgctggccagaaacaaagccatggtcgcatcagaaaaacctagtgactgaaagtaactcgccaaaggttgccacttcatcgccgtcatgccggtttcttcatttaattcccggcgtgcagctgtgagcggtgcttctccttgattgattttacctgctggaatctctaatgtcatctgaccgattgttgatcgaaactggctgacaaacagcgccttgtcgtcttttaaggccaaaacaccagcagctggttgggcgcgtacaatttctcgctgtgcgattgtgttgtttggcaacttaactgtgagttcatccacagcaattaattgcccagtaaaaacgcgttgctgagcgatcggttcttcgtccacttgatttttcctccttaactgcattcgcaggcgcagaaatcttcacataaagaccccggccatcatgaccaaaaaatggtcatcaccgcctaaacccgtttaagtgctggtttctaaccgcgcgagtccatgctcccttctaaagcttcaaaatggccaaacaaccctaattatcagcttacaccagccaacctacaaccgtgcatccttaataaaataattactaatatccaacttccggctgatagtcaagccgcggggttgtgctacactaaatgcaaacgaaagaggaagtgatctcgtggccacaagcaaacgtattcgcatatggcgaattatactctgggccgccatgggtgcggcaataggtgcactgtccggacgttgggtgatcgccttgtccattggtgtggtctttgccttcgcccgctatatcggtgaactaagccggcctaagccaaaatcaaccagtctcccgtcacttgatccgaagatggctgaacattatgctgcatccggtttaagtgatgaggaaatcaaactttttagaaaaacaatggccgatcttgccgaacaaattcgaactatcgaggcactcacaaaagaagtaccaaagttgcgtgcgctcacattaaataccgatttggttgacctgctgcatgcctattttgaggcacttgttcaagcaccacaacgcttaaccgatgccggcacgttcgtttatcagcaggtacctaatttactggatctgatgcaaaaatatgcccagattacgcatcacgaggttaagacggcagatacgtacgaaaccttagacaaagcattttcgaccatgacttctatggcaggcaaaatcaagtcagactatcaagccttcattaaagatgatcttgatgatctcgatagcgatgttcgtcttgccaaaaaacaccttgatccagataaggcgcatgaaacggagtgaataatgtgaatgatgacaaacaaaccaatctgacagatgatttattagccgatcctttcagtacgtcagaagcttcaatgaccaacaacaattcggctgaggctgttcaagcagcggccacagcgaggccaaaactaagtgctgaacaagaagcaaaagcacaagaattagccagcaaaatcgatgtgacgaaaggcgaaactgttttgaattatggcgctgatgcccaaaaacaacttggcgtcttttcacaaaacatgttaactaaagttcaaagtcaggataccggcgcagtcggtgatgccttgacaagtctcatgacgagattgaacgaggctaacccagacgaattaaaagctgaaaataataatattttccgcaaattatttggccgtgtcaagcgatcaatctatgaaatcactgcgaagtatcaaaagatcggtgctcaaattgatacgattgccaatcgccttgaaacatcacaacgcgggttactcaatgataacaagctgttagacgaattatatgatcaaaacaaagcttattttgatgctctgaatatttatattgaagcggccaatcttaagttgcgtgaactcaatgacaaaaccattcctgaagcggtgaaagcagccgaagcagccaatgaccaaatggcaattcagcaagtcaatgatctgaaacaattcgcgtcacgtttggataaacgtgcttacgatctgcaattggctcgacaaattaccattcaacaaacaccccagattcgcctgattcaaaacacgaatcaggctttggccgaaaaaattcaagccagcatcaacacagcaatcccactgtggaaaaatcaagtggccatcgccctcaccttgttgcggcaaaaagatgctgtcacggcccagcgacaagtctcgcaaaccaccaatgacctgttaaagaagaacagtgacatgttgaagatcagttcgattgaaactgcgaaggaaaatgaacgcggtgttgtcgacattgagacgttaacgcaaacacaaaacgacttgattaacactttgaaacagaccttgcagattcaacaagacggtcgggttaaacgccaaaatgccgaaaagcaactggtccaaatggaaggcgaactgaaggaacaactgctaaattatacgcacggtgatatgagtcatcaaggccccaaagacgtcacaccagacaactgatcagtcagttgtctgctataaaaacatttcgccaattaaaaaagcatccccgcaatgaagctaaaaaagccgggatgctttttttatgtctttcacttagacagctgtctcatgacgtacctgccacatgcgatagccggttaaaatcaccgctagtatgcacaaccccgtcgcaacccaaaaagaaacatgcataccagaaatgaaaatgtccggttgcccagccagataagtggttacttttttcccagcagtatgactcatggaagaaaacagcactgtggtggccgttgagatgccgacgaccattcctaaattacgcgccaacgcattcataccgccagcaattcctaaatcacgtgtcggcacactcgacatcaccacagtattatttggtgcttgaaacagcccattgccaaatccaactaagccgatcatcaacgcaacaaacataaacgatgtctgcaaattgaagaaagcatacccaatctgactggcaacaatgatcaacaatcctaccattgtgatgcgataaggaccgatgcgatcagcaatgctacccgccaccggagccacaatcacttgcacaatcggaaaaatcatcaataagtacccagctttttctggtgataatccccgcgcattctgaagataaaacggcgaaatgacgttgaagaaaaagttcgtgacgaaaataaaaaacgcagacaacaaactcagggtaaacgcactgttttgaaaaatcttgaagctgaccaatggatcggttttatgattttcaatatgaacaaaggcagcgaacgccacgatagctaatgcaaacagcccaagaatgaggggatcggtaaagccgcgttcctgtcccaaaaagatccccataaaaagggacaagatcaagactagaaacgtcacaaaaccagcccaattaatcggcacgcgcctgctgggtagatcttttggcaaaacaatcgttccgaggatcaaagcgacaatcccaatcggaatattgatccaaaaaatatacccccaaggcaactggcctaaaatcaaaccaccaatcccaggaccagcaattgcaccaatcgacacaaaggaaccgatcagacccaaggcgcgaccgcgctcattcattggaaaaatctccgttacgatcccattattgttcgccatggtcatagatgcaccagtagcttgaacaattcgcgcagcaagcaacaaggcaaggctattgttgaaaccggcaaaaagcgaaccaattaagaatagcaccatcccaactcggaaaactttgattttgccaattgaatcacctagccggccaaaaaacagcaacaaaccacagatcatcatcagataaatcgaaaccacccactccgcttgattcattggaatatgtaaatcgcgactcatcactggtaaagcaatgttgacaattgacccatctagcgtcgacataattgtaaacattccgatagcagttaggatccaccaccgatttttctgaacatttttgtcctcaatgtaatttttcacgtgttccgctcctttaataaagcctatctgcgtcattatacgccgagtgttgtcggcatttcaaaggaaccgttacagcctttacaaaagtaaaacgtattctttacagcaacgtggcgaagtctttacacagcaaccttatgcttaggttattcaagtattggagggaaaagtaatgaagcattcgaaattgttcgtcggtttgaccgtggccttagccgccaccttagtattggcaggctgcgggtccaaatccgccagcagttcaagcaaatccagctctgccccaatcaagcagagcaagattttggcagttggttcaacagctttacagcctttggttgaacaggcagctaagcaatatcaaacagacaatcctaaggcagaaatcaccgtgcaaggtggtggttcaggcgccggtttgagtcaagttgcagccggttcagttacaatcggtaattcagacatttttgcccaagaaaaatctgatttgaaagctgatgatctggttgaccatcaggtagccgttgttgcgattgcaccagttgtcaacaaggacgccggcgtcaaaaacatctccacgcagcaattagttgatattttccaaggcaagatcactaactggaaagaagttggtggtaaagatcaggccatcgtattgattaaccgcgcacaaggttccgggacacgagcaacgttcgaacagttcgggatcaagacaaataaagttaaaaccagtcaggaacaagattctagcggtactgtttatcagatggtttcaacaacaccgggtgccatcagctatctcgccttctcagcaattaaagacggtgttcaaaagcttgcccttaatcatgtccaaccaacggacaagaatgtgaccaccaacacttggaagatttgggcctatgaacatatgtacaccaaaggcaaaccaaacgcctccacagcagctttcatcaattatattcagtcaaagaatgtccaaaagacattggtaccaaagctcggttacatccccgttactcagatgaccgttgcccgtacgcatgacggtaagatcgaagaaatcaacaagtaattaaagtttaaaaacttgcaccacaaaaactgaatgctgtatacaaaaacaccgcgatttgatctcgcggtgtttttttactgtctagagtttccgtaagcgccctatcgccagccgacaacggggcatcaaaaagtctattgcggagcaccatcttcagatcgatgaaccgtcacattcgctgcttgtggaccccgaggcccttcaacaataacgaaatcaaccgtttcaccgggcgtcagacttttaaatcccggttcattaatcgccgaaaagtgaacgaaaatatccggttgcccctcagcttcaataaagccatagcctttgtcaacgttaaagtttttaacgcgtccttgcatgtcttcgcctgcctacttatcaaacccgttggtgacagcatctgggaaattagcctcaacgatagctgcacaccggctgcacaattgcggcaactttggatctgtaccaatatctgtacgcaccattcggcaacgtgggcaaacttcgccgtcagcatgttttacaacaacagccatgtcatcaaactgttcggcattggccggtgcctgcgtagttgcaggcgcaatttcgaagtgacttgtgatcaaaagctgcatcacattggcatcgacgtcatccagcatatcgcgaacaggttcagaaggataaactgtgactgcagcttcaagcgacttcccgataactttgttgtcacgagcaagttccaaagccttttgcacttcagaacggaagtccataaagcctgaccagatatctaacaattggctttcatcatcaaactgttctgcttctggcatatcagccaaagcagcataggcttctggctgcttgagatatggccaaacttcttctgctgtgtgcggcagaatcggcgtgatcaacttagtgagggccaataaggcggcaaacatcacggtttgcatcccacgccgcttaggatcatctttcgcctcgatgtacacaacatctttagcgacgtccaaatagaaagcactcagatcattgacaaggaaactgctgatagtcttttcgacggtcgcaaaatcatacgcatcataagctgttttgacttgcttgatgatttggtttaagcgaaccatcatgtaacgatcaactgatccaagttcatcataagcaaccgtatctttttcaggatcgaagtcgcctgtgttagctaccataaaccgcatcgtatttcgaatctttcgataagcttcagaagtttgggcaaagttatctacagaaactcgcacatcagaggaagagtcaaccgttgcgacccacagccggatgatttcagccccaaattgcttttcaatcgtggccgggacaatcgtgttacctaggctcttactcatcttgcgtcctttgccgtccaaggtgaaaccttgcgacaaaataccgcgataaggtgcgacaccagtggcagcaacgctggtgatcaaactggaattaaaccagccgcgatactgatcagacccttccaaatacaaatcagctgggaaactgagctctggacgagccgccaaaacagcctgatgagaggaaccggaatcgaaccacacatccatgatgtctttttctttggtgaattgaccattcgggctatgcggattcgtatagccttctggcaacaagtctttcgcctctcgctcaaaccacacatttgagccatattttccgaacaaatcagcaacatgattgattgtctcttcttcaataatcggttcgccatcttcagcatagaagatcggcaacggcacgccccatgcgcgctgacgggaaataacccaatcgccgcgatcacgaatcatattgtacagccgtgtcttgccccagctcggcttaaagtcaaccgtatcaatagcctttagaatctgatcacggaaagcatcaattgacgcaaaccattgtgtcgttgcccggaaaataaccggcttctttgtccgccagtcatgcggatagctatgggtgaagaaatcaagcttcagcagggcgcccttatcagccagtgcttgggtgatctgcttgttggcatcatcataaaagacaccttcaaaaccaggcgcatattcattcatgtaacctttggcatcaaccactgagacgacaggcaagccgtatttaaccccgactttgtagtcatcttccccatgaccaggcgctgtatggacaagtccagtcccagcatccaacgtgacatgatcagcattcatgacaagactcgtgcgatcatataaaggatgctgagcagtcattttatccatatccgtgcccttaaaggttttcaggatcttcggattttcccagccaatttctccagctacgcgatcaagtaattcggcagcaaccacgtactttttgtcgccaacttgaacctgaacgtaatcgaaccgcggattaaccgtaatcccatagttagccggaatggtccaaggtgtggtggtccagatgaccagataggtatcagtgtcaagtaagcccttgccatccaccactttaaaggcaacgtaaatggatggtgatttatcatcgtgatattcaatctcggcttcggccagagtcgattcagatgaccatgaccagtaaaccggcttcaagccatgatagatgtagccctttttcgccatggcaccaaaaacccgaatttcactggcttcataatgatgctgcagcgtaatgtaaggatgttcccagtcacccatcacgcctaggcgtttaaagtcagtgcgctgtttatcgatttcctgcatggcaaactgccgacaaagttcacgataatcggtcatcgacatttccttgcgcttcacaccttgtttcgctagttgctgttcaatcggcaacccgtgagtatcccaaccaggaacgtaaggcgcccggaagccattcatggatttgtagcgaacaataatatctttactgatcttattcaaggcgtgacccatatgaatattgccattcgcaaatggcgggccatcatgtagcataaacgttggcttgccttcatttaatttttggcgttgctcatagacgtggtcctcatcccactttttctgccaaatcggttcattcttcggtaaaccagcgcgcattgggaaactggttttacccatgttcaaggtatctttaattttcacgtgacccgctcctttattaattgaaatcaaaaaagcccgccctaatattaggacgagcaaacgtggtaccacctaacttcagggaacaagtccccctcagtgattgactaacggtgatcaaccggtcccgcttaccaacttcggcaggacaactgtgaactgatatcgttcagcggtacttgtcaggctcacacctacttcctgactcgctgcaaagggaaccaccaaacgacgcgtgttcatacgttattgagcatcatgatcggttgcagactcagaatcattggtactgtcatttgtcgattctgactcagccgccgccgaactagccggtgtatctgctgctgcttgcgaggctggtgcgccactttgatcatctgggaaaatgatctcagtataggtaccatcagcgccggaaactgctccctctgagtttacgaaaccctcgtgggcattgtcaagcgaatcttgactcggatcggtcgtatcggcagcttcaggtgaactggaaagcaattccttccactctggactcttcacaacttcaagctgtgactccaacatcacttgcagacgttggcggaagacccggctttgtcgcttgaggtcttcagtttggacagaaatattctgacgtttcaatgcggcatcatgcaaggtttgttccgtttgagcttgagcttgatgcaacttctggtcagcatctgctttggccttgctcaaaatagcctgaccatcctgctgcgcctgctgcttaatcaaatcagcttcctgatgcgcgctatttttaaccttttcagcactttcctgagcgacaataatcgattgattcaaggcttccttcatatccgtgaagtactgaaccttttccttggcatctgccaattcttttttcaggccctcgttgtccttgatcaagctactataatctttaacgatctgggcaaggaggtcattgacctcgtccttatcatagccgcgcattttgctgctaaattctttattgtgaatgtctagtggactcaaagccattgatagtcctcctcatcaattcgttttctgggacaattgttgaactcggcggtgtgactacttatgaatcacggccgctgagacccttagtttaccttttttactctctccaagaatctcatcaagccgcaagcggccaaaccctcgaacagagataatatctgatgttgcaatttcagcatccggtgcatccgattcaccaaagttaagacgcaccttaccgccttgaattaaggttttggcacgttgacgcgagatgttaaagccgtgggccacaactgtatccaagcgtaaagcactgactgaaaaattgagcggctcccagtcattttccggtgtcacataatccgccagcggatgttcagtgaaatgaacacccacgcgcccgattttatcaacattgcttgtgacccaatcctgcatgtgcgcggccacaaagaactgccaaatgtcaccatccgtgatgatgtcaccgaaaacatcacgatcaaggcctgcgttcagtagggtgccttgcactgtactatggtgcagttcggcgaatttctccggataaatgatctgtaacaaccgaatatcaaaatcagccgccgttgctgagaaatagctcggtgcaaagatgattcgttgccgctcagcgtggggatacccgccaaaatgtacgagcttaatatcgtcatcggcgcttactaaactggttgcaatcaaccgttgacgtggatctgtaaagtctgtcagcactggccggtactccgttcgtgcggtttcaattagttccgcaaaatggtcgatcagtgccgcttcatcttttcgaaaatgctgatagatggcatccataagttgtcacccgattacaagcttctggactaacatgataaataatttcgtccaagccattttaataagtgaaagtacaaagaatgctaggattggtgaaaaatcaatcccagccaatggtgggatgaatcgctgaaagatgctcagaaacggatcaacaaatctgcttaaaaagcgatccagtgctgagccttgagcattgggaaaccaagatatcaaaatgtaaatgaagaccatgatgatataaaggtaaattgcccaactgcccacctgatagattgcattgagtaaattgaacacttgacacctcgttaatgttgcgaagaaaggttcaaaccgtcagagtcaatggtgctggcaagtgacccatcaatttcaaagttagctggggtcacgaggaaaatcgactcgcccacccgtttaatctcaccattaatggcgaacacagtgcctgtcaaaaaatcgacaatgcgcgtcgcatcatcggagccgatgcgatcaaagttaatgacaaccgcccgattgttcaataaatgcgacccgatttctttggcatcagagtacactcgcggttcataaaccacgatcttcgctgtcttaccagcgggcgttgccattgaaaccaccttgttgctgcgataatgattgtccaccggttgttctggtgcgggttgttgcgcctgttcgtcttcttggtcttgataatcatcttcattgtccatggcaaagaagttgctaaatttttcgcctaacttttcaaacgccatgtatcatgacctcctgactattgacgccgacgcttgaagaatggtggctgatcatcgccgccagcatcgtctgcgttagtttgattttcaaaaatgtcgaaatcttttttcttagcgttgcttatatcatcgccgcttggtgcctgacgcttgcttggttcacgccgcaagtcccagttgccaaaaggatcatcgctttttgcctgccgattctcgttggcgtcactatcagcataggctgggcgataaccgccgccttgattatcttgatccgttgtgcggttcttagcaacgttgcgacgtgaagattcctggcggggatcttcttcgatccctgtcgcaatcaccgtcacgacgacttcatcgccaagttcctcgttgatggatgtcccgaagatgatattaacatcatctttagccgagtcggccacaatctgggaagcatcttgagcttcgaacaagctcaaatctgggccgccagtgatgtttaacagtacctgtttggcaccgctaatatttacttcaagcagtggacttgagatggctttcttagtcgcttcaacggtacggttttcacccgtagcactcccaatccccatcaaagcagatccttggttagccatgactgttttcacatcggcaaagtccaagttaacgtaaccagggctggtgatcagatcggaaataccttgaacaccttggcgtaacacattatcagcagcatggaacgcttcaagcatcggcgtcttcttgtcgacaatctcaagtagacggttgttggcaataatcaccaaggtatccacatgctctttcagttgtgcaatgccctctgtcgcattctttgcgcgcttagggccttcaaaagtaaagggacgggtaaccacgccgacagtcaaggcaccttggtctttggcaattttggcaacaatcggcgctgctcctgtgccagaaccaccgcccataccagcggtaacaaaaatcatatctgcaccttgcagcgcagcaccgatggcttcttcgctttcttcagcagccttttgcccgatctccggattggaaccggcacctaggccgcgggtcaatttaggcccgagttggatcttggtttcagcgttgctggcattcaaagcctgcaaatcagtgttcgccgcaatgaactcaacacctttaacatcttcggcgatcatgcgattaatcgcattgccgcctgcaccgccgacaccgattactttaatgttggcgcctttttcattttgtgcgtccatttgaaaatccattcgtgttcctcctaggatcgagatttattcaaagaaattgccaaagaaccggcgtaatgctgaaggctccttggattttggtttatccggttgtttttcctgcttgcgcttaagtaatcgctgattgccttggtccacagcggcagccggttgctctggctgcttactttgtggttgtggacggacatcggcgccatcaaccatgaatggtgtcggcaagacgctggagaccagcatttcaatatctgtcatctgggcagcatatttgataagggcaagcccttcagtaaaggatgggtgacgcaaccccatatcatcaggaataaaccgtttgaccggtcggccgaaaatgtcctgagccaattccgtcacgcctggcaacgccgtagtgccgccagtaatcacaatgccgccgggtaaatcaagcgcattgacagcgtccaacgctttgttcagacgtttaaagatttgcgccactcgcgcctcgataatctcggaaaggtatttttcagagatcatcgctggctcgtgtttgccaacaaccgttacaggaaaagtctcttcctcactcgttgccagtgaatcagcattgccatactcacgcttgagtttctcagcgtccgtaaaactcgtgttgaggacaactgaaatatccttagtgatatactcgccgccttcttgatccaccgacgtaaacttaagcttacggtcatggatcacggcagcggtgctttgaccaccacccatgtcaatcaaaacagtgccaaaatcttgttcaccatcggttaaggccaaacgaccaatggccaaaggcgaaatcaccaaaccgccaactcgaagacccgccttttcaatggctttcttcgtgttatgaatcacggtcttaggaacagttaacatgatgccacgcatctcaagccgaacgcccaacataccacgcggatctttaatatcatcaaaaccatctacgataaactcggtcgggactaatgataatgtttcacgctctggtggtaagttgcggaccaatgctgccgctgccacgctgcgaacatcgttgtcggaaatttctttattctcttcaccgaccgcgatcatcccggaaacttgttcaatctgcagcatgttggcgggaatgccagcaacgacccgatcgatcttgatatttgccttgtcttcagcttgggcaacggccgcacgaatgacggcaactgccttatcgatatcaacgatcaccccgcggctcacgccttccgatcgctgacttcccacaccaataacattcatttgtccctttactgtttcggcaacaatgacttttattgaggtggttccgatatcaagtccaacgtaaataccttgattatccatgtatcgggaacctccttgtgtaacgtttaataggttaatttcatatttgaatggtgccattatcagtgtaacacactcgatttgccttgagaaaacaaaccttacaaaatcagtcgtttgacgacttttccgcacttgagtatgcccgccaaaatgccccaacttctaaatcgataacaccttttttcttaacctgtgaaacaattgccggataatacttgattttgttagcaattgttcgcgaatcggcaatcacgcgataaccgtcgttcatgttcatcgagatctggtaaggatttgcgtcaccacgactagcatcgatttcggaaatatctcgctgaatggcctttggaaactgctgcagcaaggaaatcatctgcggcaattccttcgctgtaaagcctgaaaaaacagggtaagtgtcaactggtgtctgcgtcccattcttcagcactttgccggttatcaaaatcttgtgataagtatgcttctgatagacgtaaccgatcgtctcatactcgctggttttgataacaatatgattcaagccggtaaacgtcagactcgcttgtttaatttctggtaaagaattttgaacacgttgagcgatcgcttttttatgcaatataacgcttaacatcaaatcatcatccgacaattttgtggcattaatcacctgctgatcaggcacggtccgcacaccctgcacactcacaagcccaaccttggatagcggactagcaaaatagccaaaaacccccagcaatatcagcagggggagcaaaatcaacgtgaggtttctaaccagcttacgccgccgtaagttctgtactttcggcagatcgacattcaattttggcttctggcgccgatcatgtcgcggcgtctgctgctggcgcgcctggtattgctgccacggtgtcagcgggtcaggttgcggtttcttttttcggggccaagccaaagttatcacctacgtttcgaaagtagcgttgtcatcactgcgatcaattgatcacttgcatctgggacacctaatttttttgatgccttagccattgcggcacgtttttcgtcatcttccatcaaggtcacaacccgacgtggaaaatgattgtctaattcatcttctgtaattgtgatcgctgccccttgtttcgttagaatttgggcatttaaaaattgatgatgatgagtcacattgggactgggaatcagaactgccggaatcccaagcgccgtgatttctgccaaagtcgtcgcccctgcccgactgatcaataacccgatatcgggtaaaatgtatggcatatcatcaatgtacgggaccactttgattgtcgctggcaaatcaggcaatttagccttaatttgatcgtaatgcgtccggccagtggcaaacagcacttgaaaatctgctttcgcccaaattggcaaggccgccacaaccgcatcattaatccgtggcgccccacgagaaccaccaaaggctaacaaagtacgaatatgcggatcaaggccgaaatcacggagccgatcgtttggcttcaaaccagcaacttgttgggcccgcggattccctgtcaccaccactttattggctggaaaagccttagcaacttcaggaaaaacgatggccacgcgatcaacgaaatgactcagaaacttgttcgtcaccccagccaccgaattggattcatgaatcacagttggaatatgcaatcgtgtcgcggcaaataagatggcaccggaaacatagccaccggtaccaaccacaatatcaggttgaaaatcctgtagcaatttttttgcttcacccaagctaccaagaaatttccggactgttgtgaaattacttaacgatagacttcgcttgaagccttgcaaatcgagagtcgcaaacttaagtccggtcgctggtacaatccgactttccaagccccttttcgtgccaacgtaaagcacatcgtcaagttttccttccgcttttaaggcttcaatcaacgccagtgccggataaatgtggccaccagtgccgcctccagagatcaccagccgcatttacttatccccactttcgactgttgcttttaattgattgacagctttaatgaaatcatcgccgcgaacttcaaaattaggatattggtcccaacttgcggccgctggcgaaagtaagatgacatcaccagggcgactgacttcataggcaagtggcaccgcagtcatcacattctcagccgtttgaactggtaccccggcatctttagcaatcttggccatcaagggtgctgtttgaccaaaaacaaccatgcttttaacgtgtttcttaaccagtggtgtcagtgtatccattggcaatccgcgatccaaaccacctgccagccagacaatcggttggtcgaatgcattcaaggcaacggtggctgcctcaacgttagtcgcttttgaatcgttgtagacccggcggccatcaatggtttctagatattgaatccgatgtttaaccccggagaatgttcgcagcacttcgcgaatagcatcgtcgccgaccccttcgagtttcacggcagcgatggcagctaacgcattttcgatattatgtaagccggggatctgcatctcgctggccttcataatccgatcgccatcaaacgtcagccaaccatcgattaactgagctcgagcgccttccgcgttctttcttgagaacgggacgatttgtgccttgctctgtttcgccaactcatgcatttctggcaaatcccagttcatgatgaaatagtcgtctggcgtttgattcatggtaattcgcattttggccgcaacataatttgcccggttgccatgccaatccagatgagcttcataaatattcgttagaacggcaatatgtggatgcaacgttttgatgccgcacagttgaaaactcgacaactcagccacaatcgtatcgtctttgccgactttttgagcgacttgactaacgggaatgccaatattgcccgcatcaaacgcatgatgtggccgctgctgattcaacatcaagccaatcagcgtggttgtggtcgttttaccgtttgtcccagtaatcccgatccattgagcttccgaaacctgataagccaactcgggttcagtgataatcggcatatgtaacgcctcagcccgcttaaccatcggattactgtatggaatgccaggatttttgaccatcaactcgaaatgctcgtctaagagctcaaccggatgcctgccggtaatgacccgcataccgtctgcaagcagttcctgagcgtctttgttgtcgtcaaattgttgtttgtcgttgactgtcattaaagcgcccaacttatgtaataggcgtgccgcattcacgccacttttcgctaatcccaaaacaagcacttttttattgcgataatccgaaatattcttcacgatttatccctctttgcttatgccttatttttaaagaaaaaatgctaaatagatgccactgccaattagcccgaccaaccagaacgtcagatcaatttgccactcagaccagcccttcatttcaaaatggtgatgaataggtgacatgagaaagattcttttgccggttaacttaaaagaacccacctgcaaaatcacgctggctgtttcggtgacataaataatcccaatcaacaacaatgaccattcgcggtgcagcaagatagcaaccactgccaacatgccacccagcgctaatgatccaagatcacccataaaaatctgagcaggtttgtgattgaacatcaagaaaccaagcatggcaccgatcgtcaccaaacaaacgatcaaaacatcagtccgaccgtcatgtgccgcgataatcgcgtaagtgccaaatgaaattgttgtttgaccggcaaccaagccatccaagccgtccgtcaaattaacagcattactgaagcctaccaaccaaacaatgacaaaaagaacgtagaaccaagcggcactgacattgccgataattggcacccatagcgtgtgatcaaagccttcatggaaataagcgattaggaaaataatcgcaccgagaatctgaccggctagcttttgccatgccttaagtccttcattgcgatgatgaaccagtttctcaaaatcgtcatagaagccaagcagtccatagagcaccaaaataaacaaggagacccagacactgagcgtcagttgatgctgccaaataccgacccaaatggccgacacaatgatcgcagcaataaaaatcaaaccacccatagtcggtgttcctgactttttctcgtgccagcttggaccctcttcgcgaatcacctgaccttcttttttgtaacgcatgtagccgatgaacaatggcatgaacataatggtaattgcaaatgccgaaaccatcgggatgagcatctgagcaagttgcatgactatccccaattctattgttgtttaaatttaatggtcccgctagtatcgcctaacaatgtgcctgcagcgatactttgctgggtcacaaaaccatcaccgacaagtttgaatttcttcccggtcagttgtacaaattttaacacatcagattttgaccaaccagttaagtcaggcatggtcatggccccgttcgtcaaaagcaaaactcgggaaccgtgcagtgccttggtaccgcttgttggtaattgttgcacaactttattacctgtacccacagttgccacgtcgaaattggcttgcttcaagctatcttgagccgttgtcaatgccgcgttagtgaccgctggaatggtggccgtgttggtatcatcagtaaccgcaccattagcagttgtatccagtgcccgctgcatcatcggtttaaaaatgctagccaaaatggattcggccggttccgtcattttttgcggttgtttcatggccagataaaggacgtactgtggatcagaagccggcgcaaccccggcaacactgaaggtatagtttgaatcacctgtcagatagccaccttgtggactggcaatttgccccgtcccggttttcacagccagatcaacaccgggcatcttgtatgcgacaccggtgccgtcttcatcgttaacaacatgccgcattgcatcaatgacttgggccgcagtttcctttgaaatgggttgcccaacgacttccggtttataaactttggttttgccgttctgagagatgactttagaaacaatctgcggtttcaacattttgccgccattggaaacggcactgatcgcctgcagcatctgcatcacattgacctcaatgccttgaccaaatgaggtgattgcttggtcgaggggccgttcaaaactaatgtgcccgctagtttcacccggcaaggtgatgccagttttctggccgaaacgaaatttatctaaatactgcttccagatgccagcccccattgcctgttcaatcttaaccatccccacgttactcgacagagggaaggctttgcttaaaggaatggatccccagccgccggttcgccagtcattaacagtaccaccatccaatttgatagatccggattgataataatcatttgggtgatacttgccactttgaatcgcagccgccagcgtcacaattttcatgaccgagcctggttcataattgtcttcaacaagcgagtcacgccacatgtcgcctaagccttcacccgttgaagcatcaaacgttggtcgttgagtcgctgccaaaatctgtccagttttagcactcatcaacactgccgtcatgccttttggttcatatttattttgcacgtcggtcatcagcgtctctaaataggcctgcaaaccactatcgagcgttgtgtagacggtaccgccattaacagccgttttcagattcgtctttgcgttaggcagcttatagccatatgcatcagtctggctgcgacgataaccattcgtaccggctaaaaccgtattgaattgcttttcaagccccatgacgcctgtcaagctggtacttttgccttgtgcctgagccagaccaatcacgtgactcgcaaagacgccatttggatacagtcgcgacggtgtttcacgaaaatggatgcccggcagtttttcagcatcaatttgtttcttgatcgccaaactcaatttggtgccaggtgtgccaaattcaacctgatacatatttttacctggcgttagtcgcgccaaaatttttgcttctgacatcgccaaataacgactcagaatcttcgccgtttttgctttatcaaccacataatcaggtttattgttgctgtctttgctttgcttgtccaaaatcgcaaaaatggtataagtattggaatcttctgcgatcacattgccagttttatcgagaatggcgccgcgcttagcctgcaagacagtatcagtttgatattgtttttgtcgctgcttcgccagattgttagaatcaacctcgccaacagtcgccacaaaagaaaaacgaagaacgaacccaccaaggatcaggagtgtgaccccgatcatccagatgccgaaaattttacggtttcgggcaggatatgcattcgttgatcgttttgatttgaaaattttcatttattatcaacacgctttatgttgccgttgataaccttaaaaccgtgtgctttggcaaaggcatcaaggcgttctgaatttgaaagttcaccaatctcctgcttgagattcgcagtcgtctgggactgtttggcaatctgcgtctgcaaatcttcatactgacgctgtgtattgctcaaccgattttgcataaacaaacagactacacaaaccacggtcgctaaaacaccacatgcaaacatcaatgtcctttcaaacccgctaaatgcaatatgtgtgttgggcgcaggtgtggtgacaggtttatgtattggcggtgtttccggctgctgcactaatggtcttgctgtactctcaagcatagattgtaccccctaatcgtgaattttttcaatgactctcaatttggcactatgagcgcggtgattcaccgcaagctcctcttcacttggtaaaatcggttttcgatttactaggcgataattcggttgtgcagaggccggaatgaccggcaagccacgcggcacatcctgaaccgaagaaacttctttaaacatcgttttgacgagtcgatcttctaaagattggaacgtgataacgctgatgcgtcccccgacgttgatcaacttcaacgcttgttctaaggacgactcaagcgctgatagctcatcattaaccgcgatccgaattgcctgaaaaacttttttagctggatgaccgcctgttcgccgagcctttgctggaatgcctgctttaatcaactcaaccaattggaaggtcgttgtaatcggctggactgttcgtgcttgctcaatgcgtcgagcgatttgtttagaaaaatgttcctcgccatatcgggaaaagatgcgaaccaaatcggcataaggccattcattgacaattgtttttgcatcgagcgtttgacgctggtccatgcgcatatcgagtggcgcgtcaaagcgataggaaaagccgcgctttgaatcatcaaattgtggtgacgaaacgccgagatcgtataaaatgccatcaacttcagttattcccagcgtcgttaatgcatcggtcaaatctcgaaaatttctatgtaccaaagtgagttgttttggcaatgttccaaaatcggctgtgaccgttgcaatcgccgcctcatcttgatcaaacgcaattaatcgaccagttgtcagctgattgagaatctgtcgagtatggccaccgcggcctaacgttgcatcaacgtaagtaccagcaggtttaaccgccaatgccgccgtcgcttcttttaatagaactgtttcatgtttatattctgtcatcgctataacccaaagtccgttagattttcagaaatatcatcaaagttttcttcagcggtttcagcaaactgttcccaccgttcggcatcccaaacttcgatacgcgtgttcacgccgactagtacgcaatctttttgcaaaccagcatgtttgaacaacggttttgggatgttgattcgtccctgcttgtcgatatcacattccgttgcggcagaaaaaagaaatcgggtaaaggttcgagcatctttttttgccaatggtaaagttgcaagtttggtctggagtttgtcccattcagcaatcggataaccgaaaaggcagccatccatcccacgggtgagcacaaaagaggcgcccagctgatcgcgaaacttagctggaataattaaacgcccttttgcatcaatactgcgttcaaattcacccatgagcatggttgacacctccctacttttttcagtctaccacaatgacccactcttctccacatgtaaccacttatgaatgaaaattgggttatttaataagctaatcattttgaagagcacaaaaaaagcccgtgatcacaaggatcacgggcgataatgagttgtgggagaaaagtggggaattaacccagaaaaaagattaaaacacccgccatccaccaacatgtggtggctaaggctaaaacacgggtcaacatgcgccaatatcgacgaacgatcagatcatattcacgtaccacctgccaaatgaccaaaatcaaggcaatcaccatcgtggtaaacaaaatgacccaaataaaatttggtgtcttggtaaaggttagtttaaaaatagcccaaaaattaacgattgcgagtaaacaaaaccacgaaccgccatgaaaatcgaattgaacgacagccgcaacgacgaccagccataccagaatgggcaaacccatcgcaagcaacaccatgatgattccctccaaaagcagcaaccgtcttcggtgccgcgtattgatacatctctcaattaaccctaaccaaagctccgtggagcgtcaagctttgcaaaataattgcgtggtaaagttgcctgcttttttgaaaaaatttaacaaaaaattgaataacaccctgttgctcgtctattaggcttttaaagaatgaagcccccgatattgcctcaatacttgaccacaattaatactgcctcgccgacctagtcgctagaaaaggccacaaaaaagcagcgattatcttgccgataccggcaaaaaccagtacaatgatagccagcagaacaacaaaggtggtgttttcggtgcagaaaaagaaaaaaagcaagttccagaagatgaccatcatcagcgcttgggtcatgatcatcattaccgttttaggcgttgttctgggtgccctagcaagtttacaattgatctaaaccgatctcaccttatacttaaagccgctgtgtgccagcggctttttatctgccctttttcaactcagcttcatggcgcggcgattacagaattggtgctagtaagcgggagagttcttcactgagttgcttaggccgcgtttttgctttgatcactttttgcgtgtaaggcattgcccgttccatgtccgctaagaacagcttttggaaagtcttcccaatccgatggtcgtaaataaatgccgcaatttcaaagttcagtttaaacgaacggatatcgaagttggcagtgccagttgaaacgtatttgccgtcaaccacaatcgttttagcatgtaaaaaaccttcttcatataaaaatgcctgtccaccatttgccacaacctgattaagataaaatagcgaagccttggccatcaagatctgattggcttttttgggaatcatcactcgaacatccacgccggcattcgccgcaatggttagcgcatccagcaaactgtcatctgggacgaaatatggcgattcgatccaaatacttctttttgcctgattaatgaggccaagatagcctagtttgattccttcaacctgctgctctggtccgccagagacaatttgcatcgtcgtgttcccagtgacaaccggttctctaaacaggacatcaacattttttactttttgttgcttgctcgttccgttccagtccatcaaaaagcgcgcctgggccacggcgaccgccttgccctgaattcgtaactgagtatcacgcaacattggcaatccgtggtgttccttgccgaggttaaaaccgcccagataggcaagctgtccgtcaataatgatcagcttacgatgattacgaaagttgattcgcggattccaacgccccagtttcgtagcgacaaaccgctcaacctgaccgccagctgccgttaattttttccaaaaattgtttggtaggtcgtgggagccaaatgtatcgtaaagcacgcgtacggtgacaccggcgtgggctttttcaattaacaagtcgcgcaactggtggccaattgcatcaggccgaatagtataagcttcgatgtgaatatgttccgttgccacagcaatatcttcgaacaattgcttaaaaaaggcttcacgcaatgctaagacttgcacatcattgtgggtggttactagcgcgtcatcagcacgcaataaggttcggactagttcggaaacaccgccactgccaggcgttccaatcaacggttggccagctgccagggcttgctgctgctgatcaactaaatcgtcgatgcccagcaaacgctgcgtcatcagatcctgcatgcgattagcccgtaacttgcggccaaaaacaaaatagatcaagaagccgaccaccggcaacagtaaaagcaccaatagccatgcccaaactgcagaaatatcacgatgcgaacgaaagaccgtgatgatcgctgtcagtgcgttgatgatgtaaagaaacccaaggaccaaccagatccacataacatttcccccccgtaactgccagcaaattttgagcctacaagtggtttcattggcgaaggttacttaagtatcataacctaattagcccagctatgcctttaaaaaatccatttccatactcacccaagtggtctcgaagttccctttttaggtgcctcttgacgaaaaaaggtcatgccctgacaattgccagcggcacaacctcattttttcttcgcaaatacgctgattactcctcgactttgccaaaccattttttctgcaactttgctacggtgccgtcagctttaagtgctttcaaaccggcattaatcttgctgcgtaagacattgtctgacttgcgcatgccaaccgcaaagttttcaggtggaaagtcgtcgctggcaatgcgatagctggacgggtccggtttgtgggcaatgtaatagcgagcgtagacttcatccattaaaattccttgaatgcgtcctgcatcgagatcaatgaaagcatcgttaaaggtgtcatacagaattggtgttttgtttgcaatgaaattcttcagcaattttggctgggcatcgagatcaaaggcgccacttgacccagtttggacacccaaggttttcccagccatatctttgatcgttttgatattacttttggtcttggtgactaaaatttggtgattaatcaaataattatcagagaaagccaccttctcttttcgttccggtgtcaccgaataaccattccagatcaaatcaattgtttgatttttcagttcagtttccttcattgaccaatcaatcgtttgaaaatcgacattaatcccatagcgtttgaataccgcttttgccagatcaatgtcatagccagccagttgaccgttcttttgacggaatcccattggaacaaaggtgtcatccaaaccgatgacgacttttttggttcgttcgatccgtggccaggaattgccgacggtttcgcgcgcacatccgctaatgacggtgcctagcaatgtgacgagtaacatgagtgccagtacgattcggcgtttcattgaccgtcaccgcctttgccaacgtgataagtcgtgtcagccacgctttcggcaaagtccatgtcatgcgtgacgacaacctgcgtcatgccagaagctttgaattggttaaccaaggcagccacattttcccgcaaaagtggatcaagcgcactggtgggttcatcgtaaagcaagatctgcggattcagtgccaacgcccgagcaatagctacccgctgcttttgaccgcctgacaatgaatacggataggcattttcctgagcgactaattcaagccgatctagcaacttcctggccgtttcatcagctttcttctgatcaacgccttgcaaggttggtgcaagcgtgatgttgcgcataacggataagttcggaaaaagttcgaagttttggaatacaacgccaatgacgccttctttgcgtaatgcttgcgctgtcgttggctgaccgttccagatcatcgtcccggaatctgcagtttctagtccactaatgattcgcaacaatgttgtcttcccagcaccgcttggtccaacaatggctaacgttttgccatcttcaatcgtcacattgatatccaccaggactggctggccattaaatgatttattaatttgtttgagttctaacataggttgcccctcctagcgataatatgaaaatgcactttcgatccgtttttgtaaaaatgtcaggatcagtgtcaacaacagataaatgatccccacaagtaccagtggcaccaaggtgacatcacgagcactggcgatattacctgctcgcagcaagtcacccaagccaatgacgtacaccaagctggaatccttcaccaagttgatgacttcattaccaattgacggtaaaacaattttgaccacttgaggaatcacaacgtaccgcagcgcctgccaacgcgtcatgttcaagacggtgctggcttcgaattggccttcatcaattgccccgaagccgccacggaaaatttcggcaaaataggcggcataatttaaaatgaaggcgaccagtgcggcggagaatcgatcaaataccaatccaataatcgggagtccgtaaaagataaacattaactgcagcagtaatggcgtgccgcggaaaacccacacataaccttcaagcagccctttccctgctttacccagtatcgattttggctttgggatcaacccaaccgatagaatcaagcctaacggaatggatccaatcagtgtgatagcaaaaatacccaacgtcattttcacaccagataataatgccggtaaaatctgaaaaatatagctcatggtgtttcctcctctaaatgcgttcactggtgcaaaacccctgctgataaggaccttggtcgcttacgctcgggtttctaatcgcaccagttcacgcccttttcgtattcaagcctaataatattcgtttcagcgctgtgtcagtgtgactgatggcgttcgcatagctgggactgttcgcgccaactcgtcaaaaaagcgcccccttgcatgctgctgcaagaggacgcttttgcgtggtaccacctcagtttgctgattgttcacacaatcagcctcacgtggttgaaaaatcatgtccaagaaagatgtccggtaaacaaaaagccgtcctcctacagcaaattgctgtaagaggacggcttttaccgcggttccacctcagatttgttaactgctcgcacagctaacctcatgtagttatctcaaccacggcgataacgagcccaaccgagacgacctacttcgttcaatcgtccactcgtggatgtgtgatcaatggatgtctatccggttcccatcatcccggactcgcttcaagacacgaccattcatcgattccactcaacgctttaatgaattgtcactaaattacaccgaatcttaatcaatgtcaactagtttctgaaaagtttcaccgatttgctgtcacgccagcacgtatttcagtcgtgacgatggaacagttttgaccaaaagccctgcttttttatccgaatatccatcaatggaacgctgtcgcctaacagccggcgagcaatgttacgataacccttgctggcaagatcgtctggattcatcacaatcgcctcacccttattcgagcttgcgatcacaccatcatcgtccacgataatcccgagcagatcgagtcccagatgactcgtaatttcatcaatatccatggagcgcccatcggctaacatgttttggcgaatgcgattaatgaccaagcgcggttttattggcatttcacgttgttcaagcaaaccaacaacacgatctgcatcactgacggcagaaatttctggtgtcgtcaccacaatcgcaccatcagcagccccagttgcatttctaaacccttgttcaataccggctggtgaatcaagaatgataaagtcaaaatcaggccgtaattgctcaacgatttcaacaacctgttctggctccaaagcatctttttccgcgttttgcgcagccggcagtaagtacaacaagtcatcaaaccgtttgtccttgatcaaagcctgatgtagtttagcgcgaccggttgccacatcgacaatgtcatagatgattcggtttgacaaacccatcacgacgtccagatttcgcaaaccaatatcaaggtccaacaaaacgacccttttcccttgcagagccaaagctgtcccgatattagcagacgatgtcgttttgccgacgccgccttttcctgatgtgacaactaacgcagtacccatctacattgcctccatttgcttgaataatcgcggtcgaatgctggccagatccgctaatcccgcatgtgtcatcgtatgtaactcattcagataagccactggtcggtcaggatcgtaatgatctgccacaatctccacgacatcagcaattcgaatctgccccgcacctttcaaatcaccgacaacaacggcacgagcgtcgccttgactgccggcttgaaccacgccgccaacctgacccatcacaaagatattaccagaagcacacaaggtagcaccagaatgaaggtcgccgagaaaaagcacgtcgcccatcaaatcgatggtttgaccagaacgaataacgccgccgatgcgatgggttgttttggctgcaatcatttcgttaacaaccgttttgtcgatcaccgcactgacaaccccattaattgaaaaacgcggaaaatcagcaaaaatcttttgaatatcggctaattgcccctcggtcagcaaacggtttccggtttcaagtcggtaactgacatcaccagttggcgtttcttcgtaaagtttgcctagtaatgttttcagtgtgcgcatgatctgctcaaaatctgctgtatcttgaagctgcagcgccagaccatcgttacgaccttttaagacgacactgtccacatcatcaccccaactattcttcagctaaattgtctaacaaacggtgcaacggcccatatacaatgacaaacaacgccaagttgactgtcagaccagggccgaggtggtttgcaataagcatcacgacatttccagtaccgaaaccgatgaaccgattcatgatgtagttcgcaatgccatacagtaataacccaataatataaaccataccgacaaacaccggtgttcgcggaatatacggccgaatctgtcgaatggtataaataactaatggaaagagcagtgcattgacccctaaaatgccagtataaaacgtatcaaacaagagtccaatgatcgcagcaatccaagtaatatacttttcctcagggacaaataacgtgatcataatgagtccaagtaatgtcagctgcggcgtgcccataaagttcgggcgcataatccattgggctaataccgatgccagactaccatcaatcaacatcagcagcaacaacaggagaacaatccaccaatgaccagtaaagtgtttttcattcagcatcttagtcacctgcaatcgtgcgcgaaatgacagtcaccacagtaacatcattcagactggcggcaggcgttaagtaaacactgttggccaaaccatagtcatcttttttgacgctggcaactttcccgatgagtaagcctttcggggtcataccgcctaacccgctggtgacaacatcgtcgccttttttaatatcagtatcagtattcagctcacccaaaatgagatcaccggacttctcgtcgtaaccagtaatgatcccgttcacttctttatcgcccttagtttcaacagcggcggcgatgcgatcactagacttgttagccgtcgacaacatctcaaccttggcgttcgtccgattgacttcaacaactcgaccaatcagtcccgaaccggccataaccggcatacctttcttgacaccagcagcgctgccttgattaatcacaaccatgttgcgccagtcacttggtgtccgtaaaatcaccgcggcactaatttgagaataatcggtcaaggtgccgtttaacttcaactgagttttcagctgcttgttttcccgcttaagtgtctgcacctgaaccttcgtctgagctaaattatccagctgactttttagccgttgattctcctgaaaggtatccaaaagattgttgatgtcatccaagccattccgagcaaaatccccaggaatggcaaccaagcgaccgccaatgcccacgacatcgttggcaatccgttgaataaatggcggggtgttacgattattactcgcatacaccgaccctgcgatcaaaccaagactgaccagcaacgcgatcatgagggcgatcaattttttattggaaaagaatttctgcattggttcctccgtcatactcgcgaaaaaaggccaggatcaaatcatcccagcctcttgccacacacgaaccatcttcatttatgggctgttaacgcttctttaggacatcaatattcttcaatgactcgccagtaccgatggcaacacaatccaatggatcttgggcaatgaagaccggtaccttggtttcatccgaaatgacatccggcaagtgcttcaataaggcaccgccacctgttaaaacaatcccatgatcaatgacatcggcagcaatttctggagaagtttcttcaagcgtctctttaattgctgtaatgatatcaagaacattttcatgaatggcactggcaatgtcagtcgctgaaatttcgattgtcttcggtaaaccactcaacaaatcacgaccgcgaaccgtcatgccgtcaatatcttttgccttttcaacagatgctgagccaatctgaatcttcatggcttcagctgttcgctcaccgattaacaggttgaaattctgccgtaagtgattgatgatcgcttcatcaaacttgtcaccggccactcgaatagaacgactggacacgataccgccaagtgagatggtcgccacgtcagtcgtgccgccgccaatatcaacaaccatgctgccggtaggatccataactggcaagccagcaccgatcgcagcagcataaggttcctcaatgacgaatgcatcgcgtgcaccagcaactttagccgcatcaatcacggcgcgtttttcaacttcggtcacaccgctaggcacacaaatcatgacctgcggatggctaccgttgccgagcgccttttgcatgaagtatttcaacatggctgccgttgtatcgtagtcagcgatgaccccatctttcattgggcggatcgccacgatattggtcggggtacgaccgatcatgtcgcgagcttcttcaccaaccgcaatgacttcttccgtttgggtattcttcgcgacaacggaaggttcgtttaaaacgatgcctttaccgtcaacgtaaaccaaggtatttgcagtgccaagatcgatcccgatattttttgatccaaatccaaacaagacgttctccccttatgctgactcatttcgtataactccatgcattatagcatatttatttctgtgacaaaatgtgaaactacccgattttcatgccagatgggcaatttgagaaaagcttacaactttgttcccctgcctaattgaactccggatcatcgcgcgcgaatgaataatagcgttccccaccaacaatgagatggtcaatcaaatgcatgccaagcaacgcggcggccaactgaaaccgagtcgtggtgtcccgatccgcctgacttggcgagggatcaccactgggatgattgtgtaccataatcaggtttgtggcgctcaactttaacgcttctctaaaaacaatacgcggatctgccatagctgaatctactgtaccaattgcagcaatctgttcagtaataatctgattcttaacatctaaaaataaaatcaacatggattcctgattcacaccagcaaaccgagaaatcatcgttttgcctaactgttcgctatttttgatttgcccgtagcgaaccgtctgccgttgcatagcccgccgccccaactccaccccagctaaaatactagcccgtttggcagcgcccagtccccgaatatgctcaagcaacccttgatccccctctgccaagccctgaagtttcggataagtcgccaaaacttcactcacgatctgcttaaccggataatgttgattccctgctcgcaccaccagctgcaaaagctcagcatccgtcaaagcctgcggaccatgtgctaataaccgttcacgtggcaattctgctgcatctgccatgaaaattccccctgttggcattttctcacttcaccgatcagttatcggtgtcattagaaaattacgcaaacgcaggctgatttttcaaccaagctggtaattcgctgattgatgacagaatcgcggtcgcttttgaatcgggtttttgcgcaataccaggaatcatgaccgctggcaggccagctccaacagccgcttcaacaccaacatgggtatcttcaacgacaacagctggcacatttcccagcttgactttcattgcttcgtacatctcaggatcaggcttatgcgcctgtacatcgctgccagtcaaaatcgggtgaaactgccactgccagccggttgctgccaagacaacatccacataatgccgcggactactcgtcgccagcgccaatggataacctgccgttgtcaatgccgctaaagttggctgtacatttggcaaaacaaaatctgcgccgccttgaatttgatcaagaacatccgccgtcgaaaacttttgaaaccaagcagcatgttcggcgccaatcatgtcggcaatcactttggcctcgctggggccggctgcacccactaacggccgaaaatcagcctcagtgcgatgcaatcccagttgagcggcagctttgacattgcttttgagataaagtgcctcggtgttcaccaaggtgccatcaagatcaaaaataatggtagtcgtcatggtctcctccttaaagtcgctcgtgacacaaaaaaactgctcacgcgctgttctaattgagctggtctcggctcttctgaaacgcgttcgcaggcgcagaaacctgcacataaggaccttgaagtctaaatggccaaggataagccatttagacttcaaggccgcttacactccggtttctacccgggttggctcacgctcttaaagtttgtcgaacatcagcggccagataaagcgagccggttaagatgattggctgatccggatcgtcagcaaggctcgcggccattgcttcttgccaggaatcctttaattggccttcatgcaaggctgcatacccagcctcaggcaaagcccgggcattgcctggtaccggtacgagatacacggtatgaaatgccttcgttagtgcatcggccatggtgtgataatccttgtcagccaaaatgccagcaatcactgtcaccggttgcttaaagagctggtgcaatgcggcaattaatcccttgatgccgtccggattatgggcgccgtcaatcacaatcagtggttcgtcacttaacttctctaatcgcgccggccatcgactggccgctagcccttggcgaatttcctgcgacttcaacggccaattcgttgcagaggcatagacttttgccgtctgaatcgcaattgccatatttcgctgttggtaatcaccaaccagcggtatatctatgtctgtcagctcaccatccttgtcggcataagtcaatcgctgaccccagccatgcaagcgcgctttaggaacggaaaagtcgcggtcaaatcgcaaccacgtgctagctgttgctacaacctttgccgccacaacagcatcagcatctggtaccaaattgccagtcacaaccgggacgtgcggtttaatgatgccagctttatgcgtggcaatctcagtaatcgtatcgccaagcagtttttgatgatctaaagctacctcagtcagcacacttacaaccggcgtgatcacattggtggaatccgtgtcgccaccaatccccacctcaatcactgccaaatccacctgtttttgatcaaaataccaaaaggccagagccgtgataaattcgaattccgtgaccccgaaatctggtgtcgcttgccgcagctgggttaaggcctgttgtccgacagcgaccgctttaacaagctcagcatcaggaatgggctgatgatcaatcatcatgcgctcattaaaccgcataatgaacggtgatgtatacaaaccgacactcaaaccgcttgcttcaaggatatgggcaatggcattggcggctgagcctttaccatttgtcccagtgacatgaatataatggccccgtttttgcgggtcacccaaggcatgcagcaaggtgagaatgcgctgatgatcgccagttttggccaagcgcggaaacgactgaatatacgcgacactttcggtgtagtccatggttaacttctttcctcagggcatgaacgcgcccggtttctatgccagcgtgcaagtgctagcttcataagtttcatgataccagaaattctggagaagttatgatgtttacccagtgatttttgaatgataactagacgtaaccttgtgccaaaagggtttaaacggtcaaccacctgtaggtaaacaaaaaagactggccatgttaccatggtcagtccccttttcaatcaatctattaaccaaaagcaaaccaacgtcaatctgatcgttactttaaagcgaaacttgattaagcctgctgcaactgtgccaaccgctgctgtgtgctgttcagttgatcggcaaaattgctgcgcttggtccgttgttcttcaacaactgcctcaggtgccttggcgaggaagccttgattgttcagctttttatcgatgcgatcgatttcttgctgaagcttcttagcgtcctttgtcaacttagcccgctcttcatcaagatccaccagttcatttaacggtacgaagattgttgctcccgtgatcacggtgctgccagccattttgggctcggcaacatcggttcctactgtgaaagctttgctgttaacaaaccgatcaataaagtcaaaattgtcctcaaaaattggcttcaaagccgggtcagtcaatttgacaataatgtcaaccttcgtcttgagtggcgcacctgcatccttacgaatgctacggacgccacgaatcaaagcgatgattgaatccatggcatcaacagcggccgaattttcaaaagcatcattagcaactggataactggctgttacaattgactgtcctgcgtgtggcaaagcaagccataacttttcagtcacaaacggcatgactgggtgcaacaggcgcagaatctggtcaagcgcataagcaaggttaactcgcttagctgctttcgctttttcgtcatcgccataaagcacttctttactcatttcaacataccagtcagcaaaaacgttccaagtaaagttataaagagtccgacccatttcgccgaattcgaagcgttcagatagatcagtgacctgcttaatcgtttcgttcaattgggcaaataaccacttatcagataaatcgaagttgcttggatctggttgttgcggcttctccaagtccccgagattcatcatcacgaatcgggagatgttccagattttgttaatgaagttccaagcggcttcaacttgtttgtaactaaagcgagtatcctgaccaggcttattccctgtaatcaagaaccagcgcaaagcatcggccccgtatttttcgatcacatccatcgggtcaatcccattgcccaaggatttactcatcttgcggccttgttcgtctcgcatcaggccatgaatcaaggtgtacttgaacggacgctcgccagtgaaatgcagcccttggaaaatcattcgagccacccagaatggaataatatcgtagccggtaaccaatgtgtccgttggatagtagcgtttgtaatctggtgaatcggtatccggccagcccatcgttgaaaatggccacaaagcacttgagaaccaagtatccaaaacatctggatcttgctgccaattttcaatgtcttttggtgcttccatgcccacataggtctcgccagtctgcttgttgtaccaagccggaatttgatgaccccaccaaagttgccgagaaataacccaatcgtgaatattttccatccattgcaaataggtgtgctcaaaccgatctggcacgaaggtcacttttttatcagcttcctgttgtgctttgatggcagcgtccgctaacggcttcattttcacaaaccattgagttgacagccgagcttcgacctgaacaccggtgcgttcactatgaccaacactatgcacaattggctcaactttcagtaacagaccttccttatccagatccgccaccatggccttccgagcttcaaaacgatccatgccattgtacttgccagcattttcgttcatcgtgccatcttcattcatcgtgttgatccgcttcaagtcatggcgatttcctacctgaaagtcattagggtcatgtgcaggcgtgattttaaccgcccctgtcccaaatgctggatcaacatacgcatcctcgatgattggaatcttgcgattagccagcggcaaaatcagctccttgccaactaagtcctgatagcgtttgtcaccaggatggacagcaacggcggtatcgcccatcatcgtttcgggacgggttgtggcgatctcaatataaccgctcccgtctgcgaatggatatttcacatggtagaaggcgcctttatcatcttcatgaatgacttcgatatccgacaacgccgtacgggcctgcggatcccagttgacgatatattcgccccgataaatcaggccttgcttatacaactcaacgaagaccttacgaacagcctcgttaagtcccttatccaaggtgaaacgctcgcggctgtaatcaagtgacaaccccatcttcgcccactgactgtgaatcgtcttggcaaattcgtctttccattcccaaactttttgaacaaatttatcgcgccctaggtcatagcggctgatgccctctttacgcaacttagcttcaactttggcttgggtcgcgattccagcatgatccattccgggcagccacaacgtatcaaaaccttgcatccgcttttcacgaatcacaatatcctgcagcgttgtgtcccatgcatggcccatgtgcaacttacccgtcacatttggcggcgggatgacaatcgagtatggcttggctttttgatcaccgctcggtttgaaaacatcctcatctagccattcttgataccggccagcttcaacggccttatgatcgtacttaggtgctaatgcttgctctttcattggctccacctcacaatttttttctgttcctgcagtaacgcggcccgcaagctgacttacgagaataaaaaaaaccgccctaattaaaaaaattaggacgagtcagctcgcggtaccacctaaattgggaaacaatcccccacttggttcgggataacggctgtcaccggccgctccctactcacttcaggacggcagctcacaagctacaaccatagcctttttcaaggtttgcaccaaccaccttgtcgctggaaaaaaagaccatgaccctcttgatcattgcattagctgaattataacccgttgattttgacgggtcaatcgctagcgctatccttttcggaaacatagcctgctacggctcagttgtgctacccttgcgacactcgtttaacctgcttttgatgatcgacaaacaataaggcttgcagttcactggtgagatcaatgtagcgaatcgtggttgtcggtttggcaggaaccggtttgggagcaaaggtcaaaattgcagtgacgttttgcgcttctaattggcgcaccactgcagcttgggccgagcttgggacgcagacaatagcggtgtgcatactcggacgcaatttttcagataaagcggccaaatcataaatcggcacgccggcaatcgttgtcccgattaattgcggatcggtgtcaaagcccatcgtgatagaaagatcagggttgcggcgaaaattattcgtcagcaaggcacggcccagattaccacaacccaccaacgccatctgttcttctgagtggacttcaagcaactcgccaaaaacctgtgcaagcaagtcaaccgaatagccatagccacttcggcctaaatcgccaaaattagaaaaatcacgtcgaatcgttgctggggcaatttgcaccaatttacttaatcgatcagaccgcacccgtttctcgccggtctgctgcaagtctttaaccgttcgataatacacgggaatccgtttaattgttgcctgtgataacgcctgcttgctgactaccactttgaacacctccgcacgcttttgttactcttttcacatattagcttaccagaattcggcttgcttggctatcttttttcaaaagtaatgactggcatgaatcgttaggattgtactgatgttatcatattatctgtcagcgaccgggctgtttggtctgtgcttctgactttatcaccacagataaccaaaagatgaaaaccgtcaaaagtctcagcttttgtgaaatgtttcctttattaaataaaaacgcccgttgtttgccatgaccactatcatcaataggcaaacaacaggcattctttttaaagtaattcagcaataacatcttgatcttgattcataaattgatccgatgacttgatctcctgaatcttcacgccagccagtgcgcgatccatcaagccggcgacatcaattttgctttcatagtaacgcgcgcgatccgtctttggcttagttttcggtgaaggcggcgcaaaaatcgtgcagcaatcttcaaatggcatgatcgacaaatcataagtgtcaattttctcggcttcggcaatgatttcattcttatccatcgttgccactggtcgaataatcggcatcgttgtcacatcattgattgccgccatcgactccaacgtttgcgaggcaacttgaccgaccgattcgccattgaaaatcgcgagatcgccacgctgctgagtaatggcttccgttagccgcaacatcaatcgccgttgaacggtcatgagataaccttctggcactttcgccttgatttcctcttgaatttccgtaaatggcacttcgataaagtaaatccggccgacatatggcgtcaactttgcggtcagctgtttagctttgttgagtgcctgctggctggtgtacggcgggctgaaaaagtgaaccatctcaatgtccacaccccgctttagcgcgtaatagccagctactggcgaatcaatgccgccacttagcatcaaagctgctttgccggcagtcccgactggcaacccacctgccccttgaatggtcttcgtggacaaataaatcgcctcgcgccggacttcaacccgcagaatcatgtcgggctgatgcattttaacaaccaaatcaggccgcttatctgtcagatagtcacccagatccaaattcatggcgtttgtatctaaggcaaaatcgtggtcactgcggcgcgtgttgaccttgtagctaatgccctttggagcggtttcgttcattaattgcaaggcaactgcatgtaccttatccatatctttttcaaccgcaatacttggtgaaaaattttgaatgccaaaaacttgtgataaccgagccatcacctgatcactcggctccccattcaattcgatatgcatccgatcacgcttaggacgaatcgtaagattggggaattcgtgcaaggcacgggtgacattgccgtttaaccggccgataaaggcttgacggttcttgccttttgtcgaaagttcgccataacgaaccataatttctgaatattgcatactataatcctttcagttaaacggtcgccttatcaagtttagcaaacttcgtataaatcgtatcaaatgccttgttaaaagcatctgcctcggccaaagtattcgcttcatctaagctaacacgaatcgctgacgttgcaatccgggaatcggtatgcattgccgcgagtgtactgctttccgtaccttttttactggagcaggcactagttgtcgaaatgtaaatgtcttttgcctcgaaggcatggacaatggtttcgccacggacaccggcaatcgcgaaacacaacacatgcggggcaaaatcaggggtcaattggctgaacatcgtcacctttggcttttgactgacatgatcgtaaattcgtttgcgaacagcttgctgacgagccacgttatccgcttcattggccaaaaggagccgtagtgacttcgccattgcggcaattgctggcacattttccgtacctgagcgccagtcattttcctggccaccgcctgtcagcaatggcgcgatcatccggccttctttggcatagatgaaccctgtgccacgcggagcatggaacttatgccccgaaaagctcataaaatcaatccgtggatcttgcaaggcagcatccagccccttgccgactgcctgcacagcatcaacatgaaaatgaatattgggataggcatccagcacgcgtgcagcttcaacaatcggctgcatactgccaatttcattgttgaccgccataatcgagaccaaaatcgtatctttgcgaatcgctgctttgagatcatcgatgttgataaacccgcgatgatcgaccggcagatacgtcacgtcaaagcccaatttttctagttgcttcatcgtattaatgaccgcaggatgctcaatgctggttgtgatcaggtgccggccgaattcacgtttcgccatcgccgttcccttgatcacccaattatcgctttcggtaccaccactggtgaagtaaatttcgtttggtttcgcaccgatcagctgagcaatctgtgcccgtgaactttgcagaacctcattcgcccgcgtacctaatgcatgcaagctactcggattaccaaaaaaatccgtgctgactttattataagtagccaatgcttccggcgaaatcttcgtcgtcgcactattatcaaaataaatcatctgccggccccttccgttattgtgactgcgttgaattatagacaaaaagttagtaagtttcaagagcgcgagccactccgggagaaaccggagtgtaagtggccttgggcgtgatggtcgaactttgaccattgcgaccaaggtccttacacgcaggtttctggactggcgagcgcgtttatgggagcctagatcacatcagaaagttcgtacaacaagtcctacgaaaattacccacaaattcgcacaacaacaacctccaaacaaaaaaccagccaccaccggctggttttcccaaatccgaatcactaatacaatgaagctttcttccgcgcaaggtacgcatcctcaaccttcttatagcttccggcttcggtttgctccaatgccgtcgctaaggtatccgcggcttgcttataatcaaattgcatatacgactcagtagcctgatgcactgcttcggcgactggtttcactgttgttttatagcggttggcatactgcatcagttcttctgtcaaacccgcagcgtcaatcaaagcgctggtagcttttttcaacgcatcaatatcgctggcaattttaatcagaaacttagcaatcgcatccatgttaattttcacttgatcaagatcatggtttaattgctcgatctcggcagtgacgtgcttgacctggctcacataatcttgtggcagaccaggtaggtgatgccgtaaaatttcgtgtttgatgttacgcatatccagttcaaaattctctgcctgcttgttggcgacaatctcgcctttctttaagcctgcgaccgcttgattaatttgaacctgctgcttctcaatcgctgtcaactcatctttggtggcatcaaaccgctcaatcacatcagaatacacggccttaccagcttcaatcgcatccgtatccttaatatagttggcattgatcgaatcaagctgcgtctttaaatctttggcaattttgatttcatcgtgattcaacgtgtagctctgattcaaatgatccagttctgtctgcaactcgcgattttgacgcaaggcgtgatcaataaattggcgcaggtctggcgcagcagcatcgacgcgctttctagcctgcatttccttttccataatcgcgtacatcttatcaatctcagcttcaatttcgctgttagccgcttctgtggcgtccacatcaagcgacttaagcgcggtgttagcgtcagccatcttttcgttaacatcctcgaccatgcccggaatatcatcagtgaaaacataatgagccgttgtcaactgccgatagccatgctcgatttcattaatctgcgccgggaattcgttcacctgttcattgacaagcggtggcaattctttaacttgacgccgcaatgccgccatctcatcgcttaactgcttaatctcgctcttagcagcttgatgatcgccatcattattaatctggtcaattttttgaaaaagttcagccagttgttgcaactgctgctccaaagccggctgggcatccccgaagacaaaacttttggcgaggatcgttttacgcgacacttgataatcatcacgtagctgcaacatcttactgcgattatccgcctcgtcatgccgaatgtcttgtaaggcttggctgatcaagtcatattgttggcgggctgtgtcaatttttgcttccagcaccttagcaattttctgggcatgatcaaagcgaaaacgcttggcctggtcctccagatcaagcagaatcttctgtaggtcagccaagtcgtcatcattcaactgatcaaaggcccgttcccacttgctgaacgttgccagactatcgccagttaactttaactgctcgatgctgcgaatctgactcgacagcgcaccaacgtcgatcgcttcgacttgcgcgtccaagttcttgattcgagtctgaaaataatgctgcagccaccagacaccgccggcagcgacaactatgatcactacgataacaaagaaccagatcatccctacaccctctgctttacctattatcatttcaattgcattttgacagcttcgcggctaaaatgccgttaagcatcaaaatgtgagaatatcctaagtacaagtatcgcaaaaaaaggcttcagttaaaaggcctacacatcgcttttcataaattctctaaaaggactgattaaatgacgacccttgatcccatcattgttgaccaattagacggcttgctaaccggcgaaactaacccaattacggtacttgccaatgccagcgctttgctaaacgacttgatgactgacctcaactgggcaggtttctacctttctaatgataaaactggccagcttgacctcgggccattccaaggtaaagtcgcctgcatgcacattcagccaggcaacggtgtcgttggcaccagttacgcccaaaacgctgtgctgcgcgtgccaaacgttcacgaatttgctggccacatcgcttgcgactctgccagcaacgctgagatcgttgttcccatcacagttgacaatcgggtggtcgccatcatggacatcgactcgccgacactggatcggtttagtgaaaatgacgaagccatcctcactaagtttggtgagacgttggcggcacaccttgacactgctgcgctaaacacggtatactagcacgcgtgtaaaataatgcagcagcggccggcatggtcggctccagtcctgcctcggcgttaagccggtgacagtagtaaccgcggctgcaaaggtgaacctttgcaggactgcccgtgtgctaaagccgcaattcgttattttactccaaataaaatcttggaggaatatctatatgtctcgttatactggtcctcgctggaagcagagccgtcgtcttggcctctccctttccggcactggtaaagaattagctcgtcgtccttatgcacctggtgatcatggtgccaacaaccgtcgtaagatctctgaatacggccaacaattgcgtgaaaagcaaaagttacgttggatgtacggcttaaacgaacgccaattccagaacttgttcctgcgcgccggcaagatcaaagaaggtacccatggtgataacttcatgatcctgctcgaaacccgtttggacaatctggttttccgcttgggtctggcttccagccgtccgcaagcacgtcaacttgttaaccacggtcacatcaccgttgatggcaagcgcgtcgatatcccttcttatgaagtagagccgggccaagtgatcgctcttcgcgaacgttcacaaaaccttgctatcgtcaatgaagccatcgagaacaccgtttcccgtccggcctacgttacttttgacgacactaagaagaccggttccctcgttcgtttaccagaacgtggcgaactcgaaccagaagttgacgaatcactggttgttgaatactataaccagaaactttaatacttcacgatcacagccaatccttaacggggttggttgtttttttgctaatataacgaacaaactttaggccggatttttaatttgccaaaaattcgccagaacataaagttcgatcctcattttcttgaaataatccctctttgctcacttttgcaaccgccagttgacaacctgcccccattgattgcttgtatggcatagatgtttatcggataattgaagtatagaaggaggcgagaaaaatgtttggcgaaagacttacgcagttacgaaaacaaaaaggactctcacaaaatgacctagcagaagccatcggcatcagtcgtcaagccatatcaaagtatgaaaacggtctagctgaacctgatcttgataaaattgcaaaattaagagacattttaggcgtttcttatgccgatcttctcggtaaagaaccaaagcagcagataacctctaataacgtttcaagcgcctcgatcacgattacttccttgatcaatgaccggctgggcagttacacaggatttcaagttgcggaaggcattcctagcaaaacggcaccttcttttctattaattggtgaaagtagccaacgtggctttctagggactacccgtctcgttgaacttggctggtatcaaacaaggcaggcagctgaaacagagatcaaaaagattcaagatgccatgcttcatggtgagactgtttatcatctcgcatatacggcaaaagttaacaaaaaaggtacgtttggtgttcgcctcacagaggatgccgatcatgaagcacaatctaactaagcttttctccagttcaagaaaaccacttgccaagcgttctccggtgcaagagtttgcgtgcagaaacgctgcgcctatggtaaaaaaccagtttgactgcgtataacgtccgcctagtttttttgatctccaagtttgcaaaattttaagcttgtacttgttatcgacacaggtaggtcaataagtaacatgacatggcacggcaacgagcaatgtccttggttcagtgatgaactggctagcttgaccttaaacaaacaccctgaaggtcacagcccagataataagaccaagtggctttactttaactgattggtatccaaaaaaagaggcattgcttttgatgtttggcttcaaaccaacatcaaaagcaacgcctcttttttaaataggttttgtaactaacagtcactctccctacgcattagctaacagccggatccaccatcgtcaactgaatccgttcgcgcgctaaatcaaccaactcaatccaaacctcaacaatgtcaccaatggcaaccacggtctttggatcacgcacaaatttgcgcgccatcttggagacatggacgagaccatcgtgtttcacaccgatgtcaacgaatgcaccgaagtcaacgacattgcggacggtgccttctagcttcatccccacttttaagtcttccattgtcaagacgtcttgtcgcagaataggcgcggccatgttgtcacgcaggtctcggcctggattttgcaggctggtgatgatatctttcgcggtttcagcaccaaccccttcacttaccaatggcgcaatgggtacctcgcgaattttagcgactgctgctgcatcgcctaaatcagcgggggtcacacctgctgccgccagaacttttttagcgactggataactttcaggatggatgtcggtgttgtctaacggatttttaccgccgataatgcggaggaacccgactgattgctcaaatgctttcggtcccaaacgtggcacctttttcaactccgcacggctgttgtagcggccgttttcatcgcggtagtgcacgatattagttgcgatggttttggataggccagaaatgtgcgtcagcagttggtaactggctgtgttcaagttcacgccgacctggttcacagcgcgttcgaccacgacatcgacttcattagacagatctttgcttggcaagtcgtgttgatactgaccaactccgaccgactctggatcaattttgacgagttcggcgagcggatcttgtaggcggcgcgcaatgctgatggcgctgcgttgttccacatgcaagtcgggaaattcatcacgcgcttcttggctcgcagagtaaacagatgcccctgcttcattcacgatcacgtaaaaaacatcacgtttgatctgcttcaacgtttcggcaacaaattgctcggattcccgactcgctgtgccattaccgatcgcgatcatcgtcacttgatacttttcaagcagcgcaatgagttctggtgcggcttcctgacgctttttttctggtgctggtttatgcggataaatcacggctttggccaagaacttaccattttcatcaacgacggccaatttacagccagtgcggtatgcagggtcaaaacctaacactaccttgcctttgattggtgcttgcatcagcaagttgtacagattttggccgaaaaccttgatggatttctcttcggcatcagttgttaacgcattccgtacttcccgctcaatcgctggcccaacaaatcgcttgtatgcatcttcgtaagcgtcctcaataaacgccgttgcttccgtactgggccgattgtcgataattttaaaatggaagtaatgcaggacagcatcagtgtcgactttgactttaaccgtcagaattttctctttttccccacgattgatcgccaacgtacgcgttgaggacatcttcttgacggtttcctcgaagtcgtagtattgctgataaacgcctttttcgtctagttctttgcccttcgttttgactgtcgcgctaatggttcctgtgcgcatggtaaaattgcgcacccagttacgaatcggagccatttcgctaaaagtctccgccaaaatttcgtgggcaccatctaaaacatcctggacggtggcaatttctttggctggatcaacgtacttctgggcttcctgctcaagagatccgtttggaaaagcaagcaaccatttggcgaatggttcaaggccgcgcgacttagccaccatcgccttggtctggcgcttctgcttgtatggtagatagatatcttccacatcttgcagtttggtactggcttgaatctgctgttccagcttggcagtcagtgctccttgctcgacgatgcttttaatgacggccgctttacgatcttgcaaagcagtcgcacgtttataagcttcctcaattgcctgaatctgtacttcatcaaggctgcctgtcatttctttacgataacgcgcgataaacggtaccgtgttgccttcttgcatcaaatgcaaaacggtattgatctgtcgatcggtgatgccggttaaactttgttgaactaattgaacagtttgttcttcaatcaagttgttgttcctcacgatttctagtcaagataattagttattcagcagtcaccattataacaaccagttgcctgatataaaacctcatgcgctcactaaccactctagttcggtgatccggtcgggaaaaatcccaaaagaacagttgcttatgccagtgatcgttgggtagcgttacccgctcgcaatgcgtgaataatcgactatttcgataagaagtcgaaaacgactcaccccatggatgcaggatcaatttgaaagcgaagaataccgctcaatcatactccgtcttcttatggagctggtacagcctctacatggaaaggaagccggtcatcacatgaacgatcggcgagtcgactctttccagttaatcttaaacctcccatctgaaatcagtctaacaagcgactttgacgcggggcgcatgccgcttgaccacatgatttttgaggacaagacggcttaagatcatcatgactgggataaactgtttgaagatccgttgctgtcagagacaggatggctgagtcctcaataataacagcagtatgtttcctatacattcggcgcgaatggatttaaaaaaatgaaaagcaggaacactgtgtcattattgggttaagcacccttcattcaaaatagagaaaacatcaaaagtgggttgaatgatatagcaaataatccaatcagcaaggtaaattattaggctatcgccagttcacatcttttattctagataattcggagttctccgtaaaagatcaagaaaacaagaatgtctcaaataaacagtcattttgtgaattctctattttttattcattcttcaattttggcgagagcgatggccacaaattgatttagttcatcatctgttgagagattgtcaatcagaaagttcattaaaagcaactggacatgtttttgcggcaaccaattcactaaaaggctataataacgccgatagataatctcaaacggataaaaacgtcgaatcaatggttcgagtcgtacatatgcatctacttcattcgtataaaacaagccttgaataatccaaataaccttttcttcagagagtcccttgcttattggcatcttaatcgtcacaggacgatcctcttcaggcgctttgacacttttcgcgacatagtctatgatcatcgcaatctcataagtcgtggggtaatcaagaaaatgccaatccgaaattttcgattttccaacatattcgccttctggaaaatcttcaagcggagtaaatttaatatcatccgcagagtcagtatttgcaaaacttaacggcacaattgaaacacaaggaaagacagctttttgagaaaaagccacagctgctctatgatgaccatcaaacaatagatttgtaaatccataaaactcataagtgagccccattcccactgtttgagatttttccagttgctgtatatgcttgaagttaagcatggatgtcggctgtgtcggaaccagataaagcggaaagctagtgccagaattcgtactgtcatagatcggagactctgtggtggcatcatcatgaatcaaaccagttcgctggatggcaaaaaaatcgccgttgccattaactggcaataggtctcgaatagtaaatagatagataccatctctcaaaagatcaaaaaaggtcaccaaactcatcaaaatttgtttaagtagaggtctgctcccttgaattgtatgacgatactcagataatcgctggtgacaagtaattttgtcagcgacatagtaattcttgtagatccactcttcggtgggagacgcatacttattaaaggcatcagcaattttgtgaccgttgaaaatcatgctttcactcacaccctccgttccccacacttgctgattaacgaaccgcagtaatcctttaccgccttttactttcagttgaatattatgagtacgttgattaaaggtcgaaaaatcaatatccggatcgttattaagttcattggattcatcgttaaaatcttctaagtaccaactgaccgtcatgtaattttctccttctgaatccgaatagagctctcgtaaaaaaagtagcacctacagatcaaggacttttaaatcgcagtcatgtcttgggttttacttttttctctcaagccactcagcaacccgcacctcataaacccccatcaactgttcctgctcaataaacttcccaaaaagtgcaatcgtcgtcatctctgcttgatagaccggcgagacgaccttgcgttgcttggtgcggcgaacgtctattttgccaagatcagctaaccaaagtcgaacatcggttggttgttgcaacgccgccacttcttcggctgatgtttgcttcaacagccttgcaaactgatcggccatttgaatgccggcgctgtcgagatcaccgaggtagacgtagcgcatcccccgcgcctcaagtcgttggatgagttggacataaacctcgttaaagtcgttgccagactgtaagattaacggccagtcgggatgttcttggtgtagtaaagcaaagacgccgttgttttcgatgacaacggcttgtttgtttttcagtggaaagtcgagcataggtgtgagctgccagggattgagggtcagcggttggggcaagtcggtgtcaaaaatattagccgaggtaaaggccataccgatgagtcgggcagtcagttcgttgacctgacccgatttaaagcagtgggtcatgacccagcgataataggcaaaaagtgctgggtcttcccgtgcgtcattaagcgtgtgcgcagttaatcccatcgcaacggcttgctgcccgcgtggcggcaacgttttcccttgtctgatttgattgaaaagttgatcgagtttgccagcttccggcggtgccggctgcccggtggccttttcaaaggcgtcaatatatgagctcacttctactaccccacgattctctgattagtcgtcctttttccaaataaagttttgttggacgcgattaaggtggaatttcccgtcaccttgttgcggggaacccatcacatcccaaacgatgttatcaaccccatcggccaagagtttgttttgcgcgccgcttggcatggtggcgataaaactgaagccaaaattgacaatcgttttcgcaaacgacttcgcagtttctggatccagtttgtccgcaaaatcgtcaaacatcaccaaatgcggggcatcagcgcgattggagcgttgtaggaccatttttggcactatgagcaatggcaagaccatggcctgcgccttttcagcgccggacccaccggattgaacgaatttgtcatcaaccacttcaaaatcatcgtcagcactttggcggcggcgaatcaagaccttgaagtcagaccactcgcgggtatcaagtagttcctccgccgtcgtaaaaaaggcttcgtcgtcattggaaatttccgtgttgttcgccaattgatcaaggcgctgtttcactaaggcttcgaggtgggggcgttgttgcagttgggcgtcgcaggcttcttgaattgcttctggggcaatgccgttgatcggcgtcagttcaactttcagcttaatgtgctggtgaccggcgccttctgccaaaatttgattgtaggtctcgataacttgatactgcgcactaatcgctgccacgtctgcctgaacaaaggtcgtgtaggccatgtcattgccgcttttttcttcagcaagcgccttttcgacagcggcgtgatcatcatatagcaatttcagcgcttcattgatatcaaaagcaacaatcgtcaagccgttttctgaaacagaacgttgttgccgcatggcgctggcttcagccgggaaaccgcggtcagcaaacaaaacatccaaggcattcaaatcttcaccgtgcccatccgatctatgaatgaggcggctaatttgattggtaatgtccgaaaagttgctgctgcggatccggctgcgattgctgtgggcaaatgccaatagctcgtcaactttcgctaaatgcacatcgtcaggaagatacggacttaaagttttcaacttcgacacaatgtcagtggcgagcaggtgcaactgtgctgagtcggtttcgattgtgacggttagtgtttggatgatcccttgccgccgattaatttccgattcaacggcctgaagctgctgcgtgaatttcttttgcttggcgattgccgctgccaaacgctgtggtaactcagggtcaattttcagagcggcgcgatctgcctttagtttggcaatggtattagcaagtttaactgcatcgaaatcaggatcaattgtgccttttagttccgcgattctgtctcgcagcgatgcttgggttcgttcgttgccagcaatttccgtcagcaagtttctcaaggtcgccactaatggtttgagttgcttccggattgctttcaactgcggcaaaattgtcgcatcttgcaacataactttcagatcaggatgtttggccaaaatggcggcctgttgatcacgtaacggttggtattgcgtattcatttgcgccgcaccagcctcgtgaatgctggtgttatccttttgcaatccttcacgaacccgattactgccgaaaccttgaacgcggtcatcaatcgcagtgcccattttagtctgcatctgtttagtaatgccgacatcggcgctcaggcgattgatcgtttcctcaataccatcatactgaaccttcgcggcagttaactgatgcatgtaatgactcaattggtcttcaatcaccgaccaatcgtcatcagccataacgctggaaaagtcattgagcacgctcgtccgcgctaaaagccgtactttaagcggcgtcagattgttctgtacatgggcatctcgttggtgcgccaacttcgcctgggctgctgttaagtcagtcagttgtttctccaaagtcgttattttgatctcagtgccgcgatattgatcgagttgagcctgactattcttaatctgctgatcatactgttcacggcgcttcaccagttggtcctgttcagctttggcctcgcgcaatacttctaaacttgccgcaatctcgtctgcagcctttttaaggtcggccagttgcgctgtatatgcaacaacttcttgcttagtatgggtcaacttttcctgattcgttgcattacgggcaaatcgttgactgtaaggatcaagttggatttcttgaatatgattcagattatgccaaaaaatccgatttttcatactttgcaagcgacgttggccttctttgatccgttttaataagcctcgatattggttcacttgccgctggctgtcagccacacggcgaatgaccatgctgtcaatgccttcttgcgcatctttcagtgccgctaaaataggcgcgaacttttcattgccagaggttaacgtcggtgaagcaagcaagcgataagcattggccagccgtcccaaaaccttgccatcactgaaaccatagacgtgggtggcggcatactcgcggtaatcttcaggacggtcaaacacgtgcaactgatcgccaagcgctgcatttgcgttcttgaatgcctccttgttaaggcttttgccatcatcatcaattgtgtgtagcgtgattgatgcagttgcactgggaacaataacgacaaaccaccatgttggccggcgcgggtcatcctgcactctagtcgctcccagacccagcaagacttgccgttggtcggaccgaaaatgaacgtaactgtacccggttcggaccttcatcgcgccaggaccccaacccagcagcatcgactcaaatgtccgcgtatcgcgactgctattgcgaacgctggcactttgcgaaaccttctcggtatttttagccggattaaatgacggcgtggtgatcgcgccatcaatcaacatcggaaaaaaacagttcgccaaggtggtcttgcccaccgcattttcgccaatcaaggttagattgccattttcggcggctgtcatgtccagcttgacgtatttattaaaattacgaagatgataactaattggcactagttgggctgtcacaatcacgtttctccttctgactgttcatctgtttcaactaaaaagcgagcgacaatcggcgtcggtacccaataatcgtcctgatcactcatcaaatcgttctcaattagtgccgctttaacctgactcggttggatggtgaacccaggaaaaagggcttcagttgccgctttgattgtcggtgtcagctcatctgcctgcacgccggcacccaactcatgggcaactgtcagcgccaccaaatatggttttgcgacactcggttgccgctgattgtccaataacaaggcatagtggtcaccgacttctaagataaaccggccgccttggcgccattggtcagcgatctcctctttatgagcaacgagcaatggccaagtttgcgggttggttttcggactcataaactgctcggccagcagcactcgattcacctgttgcagctcattcaagtcgtttgcaggcgcggattggcccaaatgattcactaagttttgggcaaactcgttaaagtccggactgacctcccaataatcgtcaatttccgctggggtgttctcctggtcttcctctaaccgatccggcgtgaacaagccaaaccgcttcacaaacaagctgtcgattaaccgcaagatttcgcgttcgtccagctccgtcacttcactgtgcacctgccgcacaattttttgcgttgcaactgcgcgatcctcatctttgccttgcaattcaggctcattgatcaccgtttttaccgttgccaaaagtacgtgcacctgcgctgaattcagcttagcggtgcccgccaacaacaataagttctcctgaaaattgtccggtgcaagaccgagcagatttttaaaataattgccgatccgttgctgcacagacggctttttaagctcagcgatggcagcacggctttgttgggtcgcggctgccaacggcgtcgttgtgaataccccgtgatcgagcaattcattgatgatcaatcgatcaagattcgtcatgttagccataaaatccccctaggcaaacgaaaaactgaaaccgcacggcaacatcaccgcgtaatcttcaccggcgacctgcaactgcaatggtggtatgttcgttattgattgcactgtctgagcatcccgaccaaacggggcaaatccagtcaagtcatcgtggtaggtcgcggcaaacaatttgacgatctcatcacgggcgctaactgttttcagggtcagatcatgatcaactcgtccgtgattgtcatcaatcatcaactgttgccggaactcacgcaaccctgctaattgtgcctgttcactcggcgcgtcatccgtcactgtcggattgtccgcttcgctcgccggctttttaaccgcggcattggctaaataacggacaggtcccatggtcgaggcatctagcaagtcgctggcatcttcaacctcgcgatcaattggcaaatgacgcggcacgcgggcgggaatctccagctgctggtaatgagataacagggtatctagttggcgcgacaacgccttgatatcaattacttggcgcttggcatgttccagttcctgactcaataaatgcacgatgcctagcaacgtattaaacacaagatagattgaatccaaactgctatcaatggccgaggaagtcgggctcatactcaaggcaagtcgggttaactgcgcggccgcccattttttcgttcgttgtaatcggacaactaaaacatcctgctgaccaacagcgtgcgccgcatcgagatcatcgctaccttgctgagaatgagcaatctggtcgggaaaagtcggatcattcgccaatccttgaatccgcgctgcctgttgcaacatcagctgataagcaggaattgccttgtcgcgcagcatcttttgcaaatgtcctgcttcctgactgccgtggttaaaggcaatatcatttgccagttcgtcaaggtcgtcttcaagtttgtgaatgcccttcatcacatcatcgtaggcatcaagcatatttttaaaatcattatagagttgcgtatcggcgcccgaacgaactggcacgctaagcttttcaactaaagcaacgtactcctgaatccggttcgtgttagcagagatagtactttctgcatcaatcaccttctgcatcattttcagatattcgctaccgctgctcgtaatatgatacacgtaggattggcgaatatgatactgaccgctgcgcattcgggcacggaccttacgcggattaacctcgaccaacccagcttgggccacaaggacatccaacacttttttcaaaacatcgtcagcgatcgggtcttcatcagtggccgcatccagatattcgttgttatacgttcgagccaagtaactcaaagtaattggctcactgctactacgagcatcatgataaagaatcgtcagcacaaaccagccggccaacggatggtgcacgcttaagccgagctgactagctaacaatagattacgcaaaggaccagttaatggtgctgccatgatgagtcgttcccttcttgttacctggttgactaacttgcattcattatacaagaagagtgacctgcacagtagcaatacaggtcgtgaatgatgaagtcataaatggtaagttttgagctctgcaatacaaagcgtttcacccacaggtatgcacgcgttaagacaaaatacttactgccagttaaattaaatcaactcacggtattagatgctcaatcaaagtatctatcaatgctatgccgccataaatcaatgcggctttatgtgttgttagcaaatacgttgccgacgacgttgccccaaatatgagtatttccgttatcacccggccaattgttggcaacctgtgaagcgacattggggccatgaaccgaccccaaaaaagaatgccgagcaccggcgctatcacacccacagttagtttaaccacaagatcgctactattgaacccagcgatgatcaaaaacacaactgttgcaatttctaacagaaaacgaatcccatctgcaattgttttaatcattaattgcccctatctttttaaataatgtcatcattgcatcatcccctgcctgcattttaatggcagtggtcatatcaaacgctatgttgctaagggcaagatccagcttcgcccggcgtttaaagacttcgcgataactttgcaaaatggccaaggtatcttcgcgacaagcctttgtcactggcgcatcatacattcgcaatatcatgctgatttcatttaaagacaacccaaccgcttttaaatttcgcgtgatctgcaacttaaccacatcatctggggtataatcgcgataatgattttcaccccttgatggcacaatcaagccaatcttttcataaaacctcaacgtatctttgctaacaccggattgttgcgcacatgtcctaatattcataagaaaatctccttttttcgtgtcatcagaataacattggagtatacatcaaggccaaggactagaaaatgatcgacaagctattcctagatctaattatcatgatgtctgtcaacaacttttttaatcgttacaccgcatctgtaaaaacagtgatcgccatctgcttaagccgctatgcagcaaaggagaaccccatgattttctattttattctcagtctttttatgattgccgtcttagtagtgatcgcgttacaacatctcaacaccaaccgaatcgtggatattcagcttgagcagcacaagatgatgtttcctagccaagtccgcggtgcccgaattgtctatgtgcgcggtatctaccgatctcatcctagcaaacgcaactggcgactcgttgccattgttctggatatactcgcggcaattggcctcgtaacagcaattgtcatgcattaccaagacgcattttccgctgacctgatgacgtcaccattcggacttcgactaaccgaaatgctcgcggcctcaaacaacgagattcaaaacatctttctttttggtggtatggccttagcgttgatcagtcgcatgatctggttttacctgacgcagtggttatttcagctacttgaaaaagcggatcaagaccatgatagcgatgcaacggacctttattggacgccgaagcatttattgaaacgacaatatcaactccggatcagtctccagggcattttgatggtcggtgccatttttctggctttaactggtgcctttaactggttgccagtcgcgtcagagatggcttcacaaacgcgcctaccaaggacggtatctagcagcagtgcctccaccgcaagtgcctcgtccgaaatcaccaatgaatcggccacttcaagttcatggacgcaaaataccgacaccacctacccgattgatgctatgaaaacagcaccatttgcacctgccagtgagctagcgggtctgacagacgctgaccgggcggccttgttcttcacggcttactggaccctcaacggcttacaacaatccgaagtcgctgactacgcaaacagtactagtgaaacctacagctatcatctcgtcccgggatctagcagcaaactcatcgtgttctctgagtttatcccttcagtcaatcagacagactatatgttttatgccctgattgatggtgagcaggttgccttctacaatatgtatcagtccaaaacgcctattaccagtcttgctagtcaatacagcctcacggtttccggtaccactttgcggcctaccatgcctgaaatccgtgacagtgacatgaacatgcggcagctcattggggcctttaagtccgataaaagtttcgatcagactaagaaaggcttgcatcaaggggcggatataccgttatagtgcgctacaactgaagcgactacctgcgaagccccactaagctttcagatagccgctttttattgaccgggcttgattaaattcaaagataggcttttttcatagggatcatgacatttgtcacataccattcatgacattcgcgactactggctagcccacccaccgcgtagtatcaatggtggaggtggacgaaatgaccacagtaattcaagcagaacatttaaaatttagctacggtgataaagcagtcctaaaagatattaatttgacggttcagccaggtgaaattgtcggcttaattggtgttaacggcgctggaaagaccacattacttaatatcttgctcggactactatcaggaacaggtaccgtcaaggtttttgatcaacaaccaggtacaactgctatcaaggggcgacttggttcaatgctgcaaggcgacatgatcattcctagcatcacggttggggatattctggctcttgctgctgccgagacgcctgatgcgcttgatccagctgcattactcgaagagctgcaactgcaacagcttaaatcgcaacggctcggcagtctttccggtggtcagttacgtcgagttacattcgccgttgccttaattggtcagcctgatttgctctttcttgatgaaccgactgtcggcatggacgccactgcacgcaaagaattctggaacaaaatcgagcaactccggcaacaagggaaaacgattatcatcaccagtcattatcttgaagaaattcaacaggtcgctgatcgtttgttgattttacaagatggtcgtttcacttttgacggctcactccaacaacttcaaaaaaagcatttaggcgctaccattacttttgaaaccgatctgcaacccgccatctttaaaggactcgctgctgttgatcaggttcacagtatcggttccaaacttgcgatccatagcaacaatggcgatcaaacgcttagatcactcgtcccaatgcttgatcgtttgcatcaaatcaacctcagtcgggaatcacttgaagatatcttcttacaattaactaaacaggaggcagaaaaatgaaaacactcttagcgcaactggcctttgacggcaagcggttagtcgtccgcaattcttcgtttattttcttctcactcttaatgcccgcaggattttatttgctctataccaaaatgatgatcagcggatctgcaactgaaattaaatattttaatatcagttatatggatcagatgattgtctatagcattttgattaatgctttcttcagcattgcatccatcttaaagcgtgaccgcgataaggggttcacaacctttctaagactatctccgcatggcactttgccctactatgtgtcaatcaccttttggatgcttatgatgagtttactctcagtcatcgtgttaggcagtattgctgttggtgtcaataatgtgagccttggtaccgaccaatggctaggactccttggtgtcgttttgattggacagctgccagtgctcatgattggcatcgcattgtcatatatccatcgcgaagaaatgctcagtcttgctagtaacctgctcacctttccaatggcgattatcagcggcttgtggtggccaatcaccatgctgccaaactggttacaagttattggcaagcagatgccaacctactttgtaaacaagctcttaaatcaactcacttcacgtgctacagtggacttaactaatttagttggtattgtggtctggtttgtgcttggcagtttgctagttgttgctatgaccaaacacgaacaacgaaagggcgtggctttgggtgaggcatagtctccgttcatggttaagaaatctcgaatggaccagctatatttggctggtctatttgccgtacatcatgtcagaatttgtgccagtaaaatcaatcaatgattggctttggataggtttaggtatcctgtttctaattgtctatatcttagtgaacgaggtcgatcattggctgccagttacgatcccgcttgaactcgccattgcaggtattttctctatttctgccctcaacaattacatgattatttaccctggttggcaagtttcttttatcttagcccgttttccacgaaaatatttccgttggtttgccgcggctttttatttaatcatttttgtaagtttatggcgcgttaatcagcttcatcccgggattatcaatatcaataatcctgatatgtttaatctgatttttccacttgtttcgcctatcatcgcctatactgtttcccggtcagttatccatcaacggcaattacgtcaaaccaatcggcgacttcaagcaattgtccggcgcggtgaacgcgaacgaatcgcccgagacttgcacgatacgctcggtcagagcttttcgatgattacgcttaaaactgaattagcaaaaaagttgctcgtgaaggcgcctgaccgcgtcgctcaagagttagacgatattgcacaaactagtcgagatgacttacagttagtccgttcgattgttaacgatctgcaccagcagtccctcagcgaaatgatgttgatgcaaggcaagaatcttgctgaggcaaatgtcgttctgctaaccagtggcgaaagtgaggccgctgaatggccgacaaaagtacaaattcgtctgagtgcggtcatttccgaggctatcaccaatgtcatccgccacgctcacgcgcatcaggtagagatgatatttgagcagaatccaaatgactatctggttgagattcaagatgatggccattccaaaagttataagcgcacaggatcaaacggcattagtggcatgcaacaacgtatgaaagaggttaatggaacgtttacgattaatcacaaccgccaaggcactcaagtttcactcactttaccaaaggagcagctatcacaatgattaccttatatctcgcggaagatcaaagtatgttaaactccgccctcacccagctactagacttggaagatgatctacacgtactaggcagtgctggtaatggtgcaaaagcatggcaggacattcagcaactcaaaccggacgttgccgttctagatattgagatgcccaagttaaccggattggacgttgccgataagattcatggcagccagttagcaacaaaaattattattttaacgaccttcgcgcagaaagcttactttgaacgcgctattgctgcccaagtgaatggttatctgctcaaagacagccccagtgatgatttgattgatgttattcgaaaagtgatgacgggccaaacggtttatgccccggaattagtcacgaatatggtgaccgctgaaagcaatccccttactgaccgcgaactcgctgttttggcagaagtcgccagcggcttatcctcaaaacaaattgctgcatcgctgtttctctcggaaggaaccgtccgcaattatttgtctgctatctttagtaagctcggtgttcataatcgaattgaggcagtgcagatggctaagaagaataagtggttggagtaacagattctatcaagcaaaacaaacaatgcccgcttcccaacatattgagaaacgggcattgttaatttgatgtcagttcaggtcaagtctatgaagcatggctcattctcgtgacgcttaatacgactgaaccgtagccccaatcagtcccggtcctgtatgaacccccaatgacggcgagatctcaccaataaaatcaaccggtcgaccagtcacttcgcgcaatttttctgccaactttttaaccaaagctggattttgaccatgggcaactcctagacgataatgagcgctatttaagcaatccgttttgacttgttcaaccaatttccgaatcgctttttcttcagatcgcgccttaaaaagagggtagtagacgccttctggatcacatgagatcaccggtttaatgtgcaaaaccgaaccgacaaggcctgccactcggccgattcgaccgccggcactgaggtacttcaaggttggcacgtagaaataaatccgacttttgacgattgaggcacgaacttttgcaatcacgtcctgaaaagattcccctgcattgatcaatgatgcggcataggctgcttggatgccactgccaatgccgatgctttttgtgtcaagaatggttacggtgtcagcgggaaaatcttgcgcggccaattgaaagacgttgttcgtcacagacaacgcgctcgaaattgtgataccgaggatttgctgataaccagccgcaaacagcctatccatcgcctctttggcagcttgcggtgacggacttgaagtctgcggcaatgtttctgccgttgctagcgccgaataaaattcatccggtgtgatatcaactgcatcaaggtaattatgcccattcatagtaatattcagcggtacgactgcaatatttttattttcatcaagaacactttgagggacatcagaacccgaatcaacgacaattgcaatttttttggtcatgttctgcctccttgcggctttaatatccatattatatggtttctaagactagatgtaaatgggttcaccacatatatctttttcgttcatgtgaatattcagccattttgccaacaaaagtcgcttccacagcaaaaagagagtcaaccagtcacggtcaactcccttttgtcctatttccgacgaagttttgtggttacatcgcactatccccattcttagaaactttcatgaagattagcaaggaaatcactgttaacgcggtcaaaatcgttgatagtgcagcggcaacgctgtaatttccacgaataacttcggtataaatggctactgtcattgtccgagtcttgacgttgtacaacagaatgtatctggataattctgagatcatcgtgacccatgaaagaatggcaccatactaatccctcgttttgaatgcgcttacgcatatcaagtttacacgagccgatggttctggtgcaaattttcctcgctgacttgattttagtatactgggtgccaagaaacgagggattgcgcgcatgaacaaactctcatataaatatgagctgttcgaatagctcgatttgttgttctagcgaattgacttcgcaaatgttacttcttgcctcggtaccgaagcaccaaggaccctgcacatttaaacgaaactttgttcagttttcaaaggacgacctcgtcaaaaggcaactttgatatattatcacaagcaatcaatgcttgtcaataactttttttcatacctgatcggtaatcgttgttgctcatttacgacgctttttatcataccaacggtttgcgccatcgtcaacaactttttcaattaaaaatcactctccgaatgctagcgaataatagcacaatattatccgtgatttgcgccacttatatcctggtgaacgtcatatctttcggaaaataaaaaatgccgccacaagggcgacatatcatgattggttatggccgcaatgttgggaacaaaaggacatcgcgaatggatggtgcatcagtcagcaacatgactaagcgatcaatcccgattccgagaccaccagttggcggcatgccgtattccaaagcttcaacgtaatcgtcatcaataccttgtgcttcgtcattaccagcactcttttcagctgcctgtgcttcaaaacgctggcgttgatcaattggatcgtttaattctgtaaaggcattggcgtattcaccgccaccaacaaatagttcaaaacgttcaacaaaccgcgggtcttttggattcttctttgccagtggtgaaacctcgattggatggcccgtgatgaaggtcggctgaatgagcgtctcttcgacaaactgatcgaaaaaggcactgataatatggcccaccttccaataagtttcatagtgaacatcatgttcatcggcaagtttacgcgcatcatcgacactcatttcaggccagaagtccacgccagtcttgtctttaatggcgtccaacatattaatccgggcaaacggtgcgtccagatcaatcgccatcccctgataggtgagcttcccggtatctagcaccttatgcgcagcaaaccggaaaatcccttcagtttcggtcataacatctgtcaaatcccagtaggcggcataagtttcaagttcagtgaactcgggattatgcttggtatcaatcccctcattccgaaaaactcggccaatttcataaacacgttccatgccgccaacaattagacgctttaagtgcagttcaagagcaatccgcagatataaatcaatatcaagtgcattgtgatgagtcacgaatggacgagcattcgccccgccagcctgattgtgtaagactggtgtctcgacttccaagaaaccattgttgtccaagtattcacggacagcactgacaatcttggttcgcttaacaaaacgatcaaagctgtcctcattagaaataagatcaaggtaacgcttccgatacttttgttcgacatcggtcagaccatgccacttatcaggtaatgggcggagtgccttagcaagatgggtcacatggttggctttaaccgtcagctcgccagaatcagttttcatgacttcaccgctgataccaagaatatcgccaagatcggcctttttgaagatcatgtagttgtcatcgccaacgacatctttacgtacatagatctgcatcttcccgctacgatcacgaatatccgcaaatccaaccttgcctttgccacgtttagacatcatccggccggcaattgtcacttctggtttttcatccaacagtgtctctttatcatcttcaccgaattcttcgcgtactttcgctgcggtatgggtccggtcaaatcggtgcccgaatggatcaatgcccgcttcacgcaaggcttccatcttttctcgccgcgcaatcatttggtcattcatttctggttgctgtccgttatccttagccaacacatgttcctccgtttcaatttttaccactctttgatgatgacaattttacatccaaaaagcaacctactctaacaaaaagacactcgtcactgaccaacaaaagtggacaggcgtgtgtcaatgaaacactgctaatttatgctttagcttgccgttcgcgagcgcgctcttcggtttgttcaacaaaatcatcaaagatgtgatcaacctctgcctgcgtatcaaccatattcaccgcgactttggttttagccgagcacggaattcccttcaagtagtaagctgcctgcatccgaaattcccgaacggcctgatgttcgccatgaaggtcaaccagccgttgtaattgcagctttgctgtcgcaattttctcgcgcggtgttggttccgggatcaattcgccgtcttccagataagccgacatctgtttcaatacccacggattacctaatgccgcacggccaaccataacagcatcagcaccaacctcgtctaacatccgcttagcatcttgcggggtacgaacgtcaccgttgcccatgaacggaatcgtgaggtgctgtttcacttctttcaaaatgttccagtccgcatgaccagcataaagctgtttacgggtacgaccatgcatggcaagcgccgcggcaccgccccgttctgcagctagggcgttctgaacagcatagacatggttctcgtcccagccagtccgcattttgactgtcactggtttagagacggcatctgtcacagctgcaaccatttcataaactttttcaggatccagcagccagtgcgccccggcatctgtcttcgtcactttagggaccgggcaccccatgttgatgtcaatgatgtcggctgccgtgttttggtccacaaacttagccgcattcactaaagtctctttggtaccgccaaaaatctgaatagaaatcggatgttcacgcggatctacaaataacatattcagggttttttcgtttttatacatgatcccacggtcgctgatcatttcacagaccactaacccggcaccgaattctttagccgttacccgaaaagccgcgttagtcacacccgccattggtgcgacaactaagcgattcggaatttcaacatcggcaatatgccacatacaggccacctctttcttgcttgcgccttgctaactttacttaaaataagtgtcaactgcaactattcgtgtcgggtcatcaaggcttccaagtccgccacactataatgatattgattgccacagaacttgcacgtggtttctgcaccaccgtcctgatcaatcatttcctgtaattgagcatgcggtaaagttgccataatatcgccaaaatgttcttttgaacaattgcaggcaaattttaacggctgcgcatcaagaaattggactggttcgtcaccggcaattcgctgaataatttgctttggtgtcaggccgctttttaataattcagaaaccaacggtaatgttttgacgttggcttcaagttcagagagctccgcatcgttggcaccaggcaaggcttgcaacatgaaaccgccggccacctgaatcgtgttgtcggcattgacgaagactgacaggccaactgcagccggaatttgctctgacttggctaaataataggtaaaatcttctgccaactcaccagaaaccaaaggaacttgcccagtgaaaggatcgccgacgccaatgtctttcgtcactgctagtaagccacgtttgccaacagcccgcgcaacgtcgattttaccaaccagattcagcggcaagttaacgtgcggttcttcaacatagccgcgtactgtgccaacattggtaccatccgtgacgagtgcgccaacgggaccatcgcctttaatgcgaaccgtcagcatatcgtctgcgtttttcagcccggaagccgctaacaatgctgtggcaactagcgtccgaccaagtgcagccgatgaagcgctccaagtatcatggcgccgctgcgcttcacgcactgtttgagtcgcatcagcagcgaaaattcgaaaatgttcatcacgcgacaatgcgctcgcgatatagtcactcatgtagggtcctcttttctgaaaggtaaacgtggctattttaccagagatgggtgttattgaaaagatgcggctatcgtagtcgcctgaacaagcgtggataaacaacttttatatttgtcgcaaagctctgtccatttctttccataaaaaataccccgcctttctatcagcgaggtattgattgttactaatcaaagctttggtcacgttcggcctatgtaccggccaagtgaaaagcttaagatgtcatttgaatttagttcaggcctgttgccaaagtccaagttaacgtggtttcgtacgtaccgttattaacgactggtgtcttaggcagaaccagtttgatattggtcttgtcccagccaaagacgttagcgccttcaccttcacctgtagccgcatgtgcaacctgatgattggtgtcagtgccactcaaggtcatcgttgttgttttgctgatgtcagtcaatggtaccaatgcaccaaccggcgtgaagccatcatcttgcgattcgttggttaaaccgtagacattaccggtctgaccataagccgtgttcagcatggtcaatgtcgcattgtcaatggtcttgccagtatcggcaccattatcgtccttcaatgaaagtgggccatctgccttgacgctcagtgtccaatccccggctttactgtcagtttggccagttttatcttcagcgttctcagcatcagtacgtgtcgtttgcttatcaacaaccgttgtccaagccttgcccttaacattagccaaagcggtgtcatcagtattaaggacagcggtcaagtttgtattaccactcttataacttggatagcgagtattgtcagcccgccctgcgttttgtccgtcagcagtgaaaaccgggtaatctgagaagaactgttcgtggttaccaaagtccaaaatcttaggaaccatttgcagtcgcagataaccggtgttaccggttggcggcagttgaccaaaggaaatccccgcggttgtcttggcgtcttgcggtagtgcctgaccaccgttaacgcctgcattaccttgaacagtagctgcttgcgttgccgctggggcagcgattgccaaaccggcaagtaaggttgcacccgcgaccaacgcacttgtcattttagtgaatttcattttgaaattcctcctcttaaaattttttacatcatggatttatccacggtataaaacagtttcaataagcgatcactcgacgatcagaaaagattgaccgtcttccaggtattaaaatcgttgtatgtcttgatcgtaaagacaagacacgtcacaaaggcgatgagcagcaggatggacagaccaatccaaaaccacttgacgcgtcggtaggaaaatttagcgatcagtgctttcaacagcatcacctcctttgctgcggcgaacgtgccgataaataaagaaactaatcagtagtaaaacaaccaacacaattacaagcttgacccaaagccattttcgttgggcaatttggtaagcagttgccgaacttgtaaccagttcccctgaaccagtgattttgacgtaccgtgtgtcttctcgtacctgtttgccttgtttcagccgactcgtcagtttatattcacctgccactgatttttgtccggttatcagtcgtgttacatcaaagactgtttgtggcgcgattcgtggcaactcccgggtgacagttaatgagaaaaagcgactcgttgcgcttgtcagattaatcttggctgaaacatcctttaaaaaaattcgcttaggattttgtacttgagatcgcaactgaaatcctgatcgtttttgtaccaaagatgtctgccccatccttaagttgctagcgctgccagcaacatgaccgttgtgcaagacgaggccaagcgtataagcaattcggttttggacacttgtatctgttgttgatggtgctaaggctgacaagcgaattgctgacaaataagttcctcgtggctgccctttccccggcttcaaaacaattggcagttgtcgcgtttctcccggcttgagctcaaattgacgatcaatcttcactaagtcactcccggcgatcggtagatatttacgattcgcctgagtggcttttacataactaacaacgccattagctcctgtttgcgcatcaagaatttcggcattcacttttaagatttgtgcgctagcgttgtatgcctgtactgtaatggttcgtcgctcacttttaggaagatcgagatcgaagtagccagcgcctttaccaacatgattgtcactaggtaaaactggcgcgaccatcagtgcttgctggctgttagagacggtagcgcttacaagatttgtaaaagtaaacatgttcatcaaagcaagaccaagaacaccgatgaggactaatcgcaaggcttgccagtcgttcttcatcgtggacgaagcttgaaagtccatagcagtccccccagactggctaatagcaagacgcctgtcccgatcgttgcataaagccagtgattgactggtttcttgatagcacgttcgttgatactcttagcctgaacgttactaaccttcatcgtcttcttaaacgtccagctcattggaaaacgattttgcgtgttcaagcctttgagtgtgaccttaatgtgataggtgccgggcttcattgattcataactccatgagaccggaaagaccattttcgagttaggggcaatcatgaaattatcagctttgtacgttttaacatcgccgctatccatccccactgcaacactgacatttgcttttgagattgccatcggttcaacattacgcaacgttacgccaagtgcgggatgtttttgaaataagattgggtttgtttcgtcatacttgacgttcggaaaaacttcataattctgcccacgtaaaaccaccccaactgagtaagcatagttcgagccaaccgcgttgccgccagattcgcctttatcgacatgttcgataaaatgccaatcaccataaatcatgccatcatatcgctgttttggcattttgatggttgcactgatgaccttcatctgtttcggtgctaattgaatcgtggcgccacctttgtctaaggttgcaacggttgtaaatggtgttttcagacttcggtcaagattcttcgtgctcggtgtaaagtcgataccgccgccatcttgggtataggcgtttcgtaagtcgctcttgactgtgatgttcttatcagaaatattttgaactcgcatctggatggtgtgcgttgtatcttttgaatacaccaacaggtgcttgataatccatcgtgtcttcctgcgcccaagttggatttgaagttgcatctgttcgtttcagtttaggattcatcagatgcagcgtcgcatcggtcaaagtttgagcaacctgtaagttgggatcttgactgtttggtttcggagtcgacttaaattgaccgtcctgttgcacactgagttgccaaccttttgtgccatagtaatcttcaactgtgacgccaaaaggcaacggttgcttagtcgtgctttggttttcaccaatgtaataggttcggtcaaccgacttattgtcaaactgaccaaaatcaagcgttggatcaacggtcagtttcaacatttgtttctcatagcgataagtcaccaccaaatcgtctttactgatcactggatcgaccacgctggcttgatcaaaagtcgcattcgtgaggtcactggaggttgcctgatcgaccactgtataaccatcaattgcttttggccgaatcggatctgcgttaatttccgatacatgtttgccgacatcaccactcactgtcacttcgggcgcgatctcggttggttttgccatgtcacttgcccgatcaacatagcggaaaatcactttgcctgtcgtcgccggtaaatgtatggtcgtctgattcgagaataaggtccccacactggctttgttgagaatcgtttctgcggtatcctttcgatcaattttggctttaaaacgaactctgaaaccttgaccattcgggatcgtataaggaaaggcaatggtgccattcgtcttgaaactcgtgtcgtcaattgtcacaaactcgttgttcgtgtcagcatctgcaatctgtaaagaaccatctgtataagtggtgttcgggtcaagctgatccttgatactgcccgtgcccatacctgtcaagttggtatattgcaattgatacgtgacaccatcgccattttgaccgttcgtctccgtcttaaactcagtctcgccggctgtgtcattgcgaaccgccttttgaagaacgaaatcttccggcggctgacgcaattgatactggtaggtcacggtgtaggacgttgtcgcagaaaattggcctgaatctttgccaccaggcgtatcagctgtgtacttgctagcgtattgataccaattattttgatattgaatccattctggtcgtctagacgatgcgtcccaactgttacccggatcaccggggatcgtgactggatcagcaatttgttggccagcagagtcggtaaacttaacagtgactggttttgcattcttaggtgtcttaatgagtgcaaccgcctgaaaagtaggattagcgccgctagcaccggtgtatccataagagactttgtctgatttaaagtagtctagaacatttttaatgtgaaaagtgcttccttgcgtcgggtcatcgtcaaggtaatattgcaagtcgccgcctaagatgcgtaccccattttgatacgtcacagacggtgtccacttaacaacaaagtgacgaaacttgccatccgaaagcggtttatttaactgaatatattgaagatgtccaacatcttctgattttttggtggttagcggtgtctcacccggacgaacaacgccaagatggccgaccccaaacgtatttggatagttcacatcaaatcgatcatctgcgacgccagatccgttccaccagttgtccattccaactgcaagtgcgttgcggatgtattgcttgatcatgttgtttttgccatcagtcgaccacggataggcgccaagtccgccacctggggagccataagcacctatcgtcaacggatcgttttgcagaacaaaggccatcccatcagcatctactccaggatgcgagccaaagtaatgataagtgtcatatgtaaatgcactattcaggtcaatctttgacttagaccacataccgccaatctgccaactcttcgtctcgcgactacctgtgacaataagtgcctgcggataagccttgctaaaagcggagacgttagggaagttttttgggtccgcttgactcttagtaaagtaatcactggcattcaacgttgaggccggtggtgctaccggaaacccatctgcggcaccatatgttttctgaatagggaaaaggcttagcgacaaaactgaaataataagtatcatcaacaactttgaaaagcttttcacctgagtacccctccctaattagtcctctaaattatttaatgtccgatttaataacgtcctttattttatgttaacaatagaggtctcaaaaaacaacaattatttttatatatataatatctaacgatacgaatatagcgctttagcacttcatagttaaggtgtcaagtctcaaaaatcaaatgattatttattaaaatatgataatctttctcttcaaaggctaacagttcgttatgtaatgcttttcataaaaggcattaaaacctcattactaacgaaaatagatcgatcggtcatttttttagcgcaatctgacacaacttttaactatacttaacgagattttgcctgctactatgccatatttgaatttggccatgacatgagaagacgaaaaaagtccttctcagcatctctgctaagaaggactttttcaaatcattcaaatctaagcttgcggaccctgctgatcatcgttgtttgaagatgaattgtcagtcgaagtatcgtctggcttttcaacctcatcagaatcagtatcgtcgtcactggcttgctgatcaccagattgtggtgaatcagttttaccactggcttcttcatctgcttgcttttctttatctttgtgttcaagggctgctttggattgctcgaaagtagcggccttttcacttggaaattcatcttggtcacgagcaggcattttgccatcgttgaacaagctgaggatttccttttcattcaaggtttcgtatttaagcagtgcttccgcaatcaacttatgctgttcacggtgggcctcaatgatttcgtgagcctgtttatgggcatcgtcgataatgcgacgaatttcatcatcaatggctgtagccgtcgtttcagaataaggaggtgtctgaccatattgtgcacccaggaacggttggccttcagtttcaagctgaaccgtgccgagacgatcggacatcccatactgcgtcaccatactgcgggcaatttgagttgcctgttcaaagtcattggatgccccagtagactcaacgccaaagataatttcctcagctgttcgtccacctaagagtccaacgatttgttctgtcaattccttcttggtaagtaggaattgatcatcctttggcagcatgatcgcataaccgcccgcgcgtccacgaggaatgatcgtgacttttcgaactgtccgcgaatcgctcaggaccaaaccaacaatggcatgtccggcttcgtggaacgccaccatattccgttctttcggattaatgacgcggtcgcgcttcgctgggccagcaatgacccgatcttcggcttcgtccacgtctgaggcatcaattgccttcttacttcgtcgggccgcgactaaggcagcttcattcagtaagttttccaaatcagccccgacaaaaccaggcgtctgacgagcgacttccttaagatcaacacttggtgcaagcggcttgttcttcgcatgcactttcaagatggcttcacgacccttaacatccgggcggccaaccagaatcttccggtcaaaacgacctggacgcagcaaagcaggatcaagcacatcagaacggttagtagcggcaatgacgataaccccttcgttaccggtaaacccgtccatttcaaccagtaactggttcaaagtctgctcacgttcatcgtggccgccgcccataccggcaccacgctggcggccgacagcatcaatttcatcaatgaagatgatggaaggagcagcctttttagcctgatcaaacagatcacgcacacgagaagccccgacaccaacgaacatttcaacgaaatctgaacctgaaattgagaagaacggcacaccagcttcaccagcaaccgccttggcaagcaaggttttaccagtaccaggagggccttccaaaagcaccccggctggaattcgagcacctaatgccgagaatttccgcggatccttcaggaattcgaccacttcaaccagttcctgtttctcttcttcagcaccagccacatcggagaagcgtactttgttggcatttttatccgcctgcttcgcccgtgatttgccaaagctcatcactcgaccggaaccaccgccttggccagcctgattcatcatcatgtagaagaagaccatcatgatcacaatcggcacaaccgtaatcagcaagctaaaccagacgccggattgtgattcttcctgcgtgtcggttttaacattgttagcgctggttgccttttggatctggctcaaagtcgcatcgttcgtcggaatatatgtcgagaacttcgtgactttggtgctctgactaccaaacagactcagcgagttatttgaactagaagacttctgtgccttcttgtattccccactgaccttatagactccgccagatggctggagtgaataactcttgacgttgtcttttttcaactccgacaagaacgtgctggtttcaatctcttgggacgatgttgtcccattatcgcgcatataatacgcaaaaccggtgaccaatagcacaaaaataatgatatacgttaatgtgctactgaacaggccgttttgttttttcttcatttagaacctccggcaacattcgattagtaccttatatactaccacaaacacaacattcagatcaggattttgctgcgtagatttccggttttaatacaccgatataaggcaggtttcgataacgttcagcataatctaagccataaccgaccacaaattcgttaggaacagttgtcccaacgtaatcggcgtgcacatcaacgacgcgaccttctggcttatccatcaacgcacaaatacgaaccgacttcgcatgacgcgttttgaaaatgtcggtcagatattttaaagtccggccagtatcaacaatatcttctacgattaagatgtcccgatccttcacgctggcgtcaaggtccttgataatcttgacttcaccgctagactcggtcgcatccccgtagctggaaacgtccataaagtcgagttccatgtaatcatcgatctcacgaacaagatctgtcataaacatgatggcaccttttaaaatgcacaccactaaggggtttttccctgcataatcgtgcttgagctcagcgccaagtcgtgccgtgatggcatggatgtcgtcttgagaatacaacaccttcaaaatatcggaactcatgatttatcctcacttttgtcaacatctggtgattgcaccagtacaacatggagtatatcagtttgatctatggccgacaatcgttctaaaggctgaccttcaacccaaaacacttgatgaccccgagctaaaaccaataattgatcgcgctgataggctggaatttttgtgttaatcaaaaaacgccgcagtttctgaatcacgccattgggtaattgcacaacatcgccagcttgccttgtgcgcaaagtaattggcagtttcactctgaccggcgtgcctttgtcagtagcaacgcttgtctgcaggctgaaaatgccacgagtggtacgatgttgctgatcaagcttagtgaatgtgaccggtttaactggcgcctgccgcgttaagcgaacaatttgttcactctggacagcaattgaaatcccgccgcccagatcaaaccgccgctcttttgtcccgcttagactcgctagaactggcgaaagtagctggcgatcaacgttgggttgccattgctgcagtattttttttaatagcagacgctgaacagcttccggctgcgatgatgcggcacgccaattaaccgttgcgtcatcaacctgcaggcgttgaagccactcagccagttgtgcttcagccaacgctaataggccagtctgctccatcgtgaatgtttgaatatgcgccagcaattgcgtgttttgttttttgaatgcaggaatgacctgatgacgcaactgatttcttgcgtaatgcggatcagcattgctggaatcttcgcaaaacctaacgttgtgctgatcagcataggagcgaatcatcgccttgctgtagggcaataatggccgcactaaccgacgtccatgccaagctcgatcagcgcgaataccgattaacgcggccggatcgccagagcgcgccagccgaaacaaaattgtttcaagttgatcatccgcatgatgagctgtcatgacaacctcagcatgctgctcagcggcagttgcggctaagaaggcatagcgtgcttgccgagcggccgcttcactggttggctgcccatcagatcgtcgccattgtccagtcaccactggcacctgcaattgttgggcagcggcgacaacaaaggcttgttcctgctgactctctggtcgcaggcgatgatcgaaggttgccaccaccacatctaagtcagctgctttgacagccaggttcaacaacaccatcgaatccacgccgccagaaaccgccacgagcacacgagtatgcggtgcaaagccaaatcgttgaaaaagtttcgggctcatgggcatcctccacgcaatcctgcagaaaccaagaaaatgggcctagaacaaaatgtgctttgttccagacccgatttttaactgcggcgaccaccacggccgccgcgtttaccctcggtattgcggcgaagaacgcttaatcgatcttcgctttccttcaaatatcctgacatcatcgcatcaaaatcatctttggatggttgtgctttgtgtccaaaatgattgccgccgccactacgcgcaccgccttgatagcgattgccgcttggccgagcagatggtgtatgatgactctcccgatgactattttcgtgttcactttgctgcggtttatcgaccgctttccggatagacaggccaatcttaccatcttggatcgaaagtactttcaccgtcaccggttcgccaacatgcagcacatcatgaatatctttgacataagcatcagagacctcgctgatatgtaccaatccggtcttgccatcgcctaattcgacaaaagcaccgaattttgtgatcccggtgaccttaccagtcactttcgtaccaacttcaactgccataaaaaaagaagtcctcctagttaaatgtacctattagtatagcacggcagaaaaccgacgcaagagcgcgagccagcccggttagaaaccggagtgtacgtggttttggccattgcaaccaaagtccttacacgcaggtttctgggtctgtgagcgcgttttagatgcaacagcgtccagagcctagcctttctatttagctgtccaaatcactgattcacattcaaatccggaaccttgttgaccttatcaggcaagttaaaaataatctctccttgcttcgaatagagatatttttcgcgaatcagcttagccgtgtagtcatcattgtgcagttggtcgacctgaaccttgagggctgacttgttggcttttaattttgtcagactgcccttcgctttttggacggcgtggtttgtctctcctaacgccatttgcgttcgaactaaactaagcccgccgaaccccaaaatggcgacaatcacgatcaacagattccgaatccgcttcatatgtacggcgtgcgcccgtggattgggcgtacgcttgtgcttttgttcgtgctcgcgcgtatacgcattattcaattgactgatattgttctttgccatttgaccgcaccttcgtttttcaccagccatttacttacatccgtaaatcaataaatcaagtataacaaatcccgagggctgcgagccaataaatacgtattaaaatgtttctttataatcctctttcaaaaccgtgtacatccccgctgcgtcatttttcttggtggtttcaaccaaatcatccgctcggacagtaagcgtcttgttgccaaagttaatcactaacgtatcccccacacgaacatcagagcttgacttagctggtttatcattgatcataattcgccctttatcggcaatttctttggcaactgtgcgccgcttaataattcgagagacttttaaaaacttatctaatcgcataacttaattacctcgctttatccgttgtaagaacttcatatatagtttaccgcctggcaaatcgagcatttctcgcagcgttagcattttaagccaagtccctgcggctaagaaaatgatgaccccaagtaataccccaacgactgtcacacccgctgccaccatccgggagcttaacggaatccaaccgacagcggcgtatactgccgcggccatgataccggtcacgatgattaacttagggacgaacagacggatggcactagcacctttgatcgtctcaggaactgcataataaatcaagcaaaggatcaagcccagtgagagaatcgttgcaccacttgccccggcagtaccgaacttcacgacaagcggctggttgatgacggctttaagcaatatgcctagcaacagcgcgacgctaatgccggcatactgatcaagactttgcaaaatagcattataggcattgatcatggcgacaacgacaatagcaaccgcatatagttgcagcgcaaatgtcccggctgtgtctccaaacagcagcaaatcaatagccggcatcaaaacaatcaagccagctgtcgccgccaatgcgaatgctaaattaaaatgcaccaattcggcaccgctgcgaataaactgacggcgctggcgggcttggcgcgcctgagtcagactcggtaaaagcgttgtcgacaaggatgccgctactacaaggcccaattgcactaaaggctgtgcccggtcataaacccctttaagacttttcgcagtcaccatggcgatacctgaagctgtgagcccttttgtaaccgtaaagctatcaatcagctgcaacaaaatcaacaaagctgcgtaaagtgtgatcgccccgccttcacggacaaaccggctaatgagacgtacataagcctgcatccccggaaaacgaaagtgctgctgaccaaacacttgccgatatggccgccataacgtcaatgcagccaccgcgccgccgaagaatgcaccggtcattgccacagcacccatctgataaacgctccaatgatattgcaaaaaccaccaagctgctagcagaatcacagcaacacgcacgacttgctcaacaacctgactagtggctgttttagccatatcaaaagtgccttgaaaataaccgcggcctgtggccagcaacggcatcgtcaagaacatgaaagccaccgtttgaatcaacggcagcaattccggatctgccatggattgcgcgatcacgccaccaaagatttgcaggcctaaaaacaatgcccacgagatccatgttaaaatcacgcggctttggtgcgcgactgttagcttggcctcatcgctatccgcttcagcaactagtttagaaatataaaccgggaacccggacaaagcgaatgtcatgcctaatccgtaaatcgggtaaatctgttgataggcatagaagccggtgtcacctaccatgttttggaacggtacccgataaacggcactgagtattttggcgattagtgagctcaggctcaaaatccacgcgccgcgcatcaagtgcttcatttcttggttgtgcatgggagccctcctatcactatatccactgacaccgaagtctgcttgagctgattgatcattggcatgtcatcacagccaagttgggtcaaaaacaatgaatgcccctacttttcacagcaactatgccgatttcttttccggttgcggattgacaacagtcagtaatccctgcaaaaagccggtcaattgatcaagccaagtcgcagtcttcatatcttttggcaatgctaacgtaactgtcagcttgccatccgtgatcgcgacctgcgctttcaatgttgtcgcacttaacgctttgaaaatcggctcgccttgtgctttagcagttgcttgcgatgacaacacaaccgtcaatttttgccccgccttcgttacgtgattgacccaagccaagtcagcaaaccgcttgagatgcgcaatcgccaataaattggtcaccggttgcggatagtcaccaaaacgatcaatcagatcttcgctgatctcagtttcggcttcatcgctatctgcttctcgaatgcgtttatacaactcgatcttctgacgggaatcggccacataatcagttggcaggtatgcttccagccccagatcaatttcagcatccgttttctcagccgatttaataccgcgccgtttattaacagcttcttgcagcatctgggtgtaaagatcatagcccactgaatcgatgaagccatgttgctgcttgccaagtaggttgccagctccgcgaatcgatagatcacgcatcgcaattttgaaaccactacccaattccgtgaaatctttaatcgcctgaagccgcttttcagcaacttcattgagcaccttcatcggctgatacataaagtacgcataagcgactcgacttgaccgcccaattcggccgcgcaattgataaagttgtgacagaccgtaatgatcggcattctcgatgattaaagtattggcattgggcatgtccacgccagtttcaataatggttgtggtcacgagcacatcgtaagcaccgtgcaaaaagtcataaatgacgttctccaactgcgtctcagtcatctgaccatgcgcatatccgacacttgcatctggcaccagttcctccagttgactcacggtacgttccatatcttccacccggttatgcaggtaaaagacttgaccgccgcgttccatttcccgttcaatggcttcgcgaatcacgcctggattttgctccatgacaaaggtttgaatcggatagcgattcgttggcggcgtttcaatgacactcaaatcacgcacacctagcatggacatgttcaacgttcttggaatcggagtcgccgtcagcgtgagcacatcgacattactcttgagttgtttgatccgttccttatgcttaacgccaaagcgctgttcctcatcaatgaccagcaatcccaaatcccgaaaagcgacatctttagacaacagccgatgggtgccaacgacaatatcaatggtgccgttcttaagccccttaatcgtttccttgttctgatgcgctgtctggaatcgtgacaacaacccgactttgattggaaagtccgcaaaccgttctttcatcgtgtcaaagtgttgctgggctaaaatcgttgtcggcaccaaaatggctgcctgtttgccataatcgattgccttgaaagcagcacgcaacgcaacttcggttttgccaaacccaacatcgccaaccaataagcgatccattggcttcggcttttccatatcatgcttaatttctttggctgaccgcaactggtccggtgtctcaggataaggaaactccgcttcgaacttgtgctgcaggtcatcatccggcccaaatgcaaaccctttttctgcttcacgcttggcatataaatcaattaattcgtcagcgatatcttcaattcgggcagctactttgcgtttggttttctgccactcagcaccaccaagtttattgacgcttggcgttttgccatctgcggaaacgtatttttggactagattcagttggtcaactggaatgaacagcttatcgttgttgcggtaaacaatcgtaatgtaatcacgatgcacaccgtcaacttctaatgtctccatcccggtgtattgaccgatcccgtgattaacatgcaccacgtagtcaccaggcttgagctcgttatagctgcgcaatcgctctgtattcgccagtgtttggtgccgtgcgtgacgacgttggcgagcattgaataactcgtgctcggtcacaacgactaatttcaagtcgggcagctcgaagccatttttcaggctgccttctgtcaattgcacctggcttggcaacagcttagtcggggctgtcatgacattgctaatctcaaaatctgacaacgtttcgctcagcttttccagccgatttttatctgtgatcaagaacaccacggtttgctgctgctttacccagcgatcggtttctgttttgagtaacggcatctgactgaaaaattgctgcacgttacggctgggaatattggtcaagctgtcaagtcgcaactgccccatgcctttttgaaaaaggctaaggtaaagccgcgggcgcttatcttgctgtgcaagttcctgaatcgtcaggttcggcgtgttaggtagcagccggccttcttcttgcaactgtgagtaccattctgccgtatcctgcaccaaggttgtatcgctatctagcaaacgactgtaatcatcgaatgctaccagtgcatctggttgcaaatagtcactgatgcgttgctgctctgggtatagctcggccgcatataaagctagattttcaggacgctcgtgtgccgatagctgctggccagtcgtcaataaaccatctgtaacggcctgcttagcggcggcatttttcacttttgccttgtaggcattagcttgcttggtaatgcgctcgccagcagcggccaaaacctgatcagtcgccaccatatcggttgccggcgcaatcgtgatctgctgaagtttttgcagactacgttgggtggcaatgtcaaagctgcgaatggaatcgatttcagtatcgaacaattcaattcgaatcggatcgtcttgattcaacggatagacatcaatgatgccgccgcgaatggcaaactgtcccggcgcgctgactaacgaatctcgtcgatagcccatggcgaccagctgtttggcaacggtttgcggatcaagctcggaagtcatatcaatggccaattcactagctgcccaatcggctggtgacggcaaaagccgcttataaccggccagactggtcacgatgatcccaggtttgccgctttgaataaacgtcaaagcattaatacgatcgttacgcgtctctggcgaactaaccgcgacttcagctgccaacacatcctcaactggaaaatcgtaaaccattgcatctccgagcaaactgcttaaatcagcagctaattcatcggcatgaaagcgattgttttcaacaattagaatctgctgcggtcgctgttgcaatagcgcgccaaaaaagaccgtcttggctgagcccgacagtcctgtcaccaaatggcgacccgttttcagcttcggccataatgccgacaatgctggatctgcctgcaccatgtcgatcaaattcatcgcgtcacctgcttctttcttctactaatgtacacatgtgcttcaccttttcgccatgaagtcacctatcttttaattaaacttattcatcagctgatcaaacggcatcccatttagccaatcttccaaggcatcatcagccttctcaatcgcatcatcgattaacggctggtcagttttggaaaacggcgttagtacccaatcaacgacccgttgccgcttcggatgctgaataccgatttttagtcggcaaaactcatcgctgccagtggcactgataatatccttgatgccgttatggccgcctgctgagccgcgcttacgtaagcgcaatttgcctaaggttaaatccatatcgtcttgcacgacaaaaatttcatctaattgtatctgataaaacatcatcagctcgcggacggcgcgacctgaagcattcataaatgtctgtggtttaacaaggaagatcttttcgccatttagacgggttgtcgcggtagctgcatcaaactccagcttgtcaatcgtcaggttcagtcgtttggccaagccatcaacgaccatgaaccccatattgtgtttggatcctgcatatttctggccgggatttcctaggccaacaatcattttcattggaacttttatcctccttggggaaaacgcgtttatagttgtaaggactttttttgtgagtgtttctatattctggccggacgagctaactcgcttatcttctggtagcggctggtcacgttttgctcggaaacgcgctcacaggaccagaagcatccacataagggccggatctgtgcgattgctttgagattcgataagcatcgtgcctttctagtagcggctagccacgcttcgctcggaaacgcgctcacagtcgcagaaacctccacataagggtcttcgacataaatggccaaagaccggccatttatgtcgaagaccgcttatgctccggtttctaagcgctcctgttcgcgctctaacgcgaatagacggattttgccttttccgtccagagcagtataccatactgacgtcttgcgtctgtgcgagttgaccgtgggaactgttgaatttcccacattcgtgaaaacagatgctggaaacgcttacgttattggaagcttgcttgaaacaggattcacaagtcttgctgtagtaaggctcgacgccattttttgacaatggcaaaatcatgaaaaagtctatcaaatttgtttcagggaattgataatgtgttatactcaacgtgaaatgcagtttgcatgcacataagaaaggatgatatcaccgtggcaagtattacggataaggatcaccaaaaagttattctcgttggtgacggcgccgttggttcaagttatgcctacgcaatggttttgcaaggtatcgctcaggaaatcggaatcgttgacattttcaaggacaagacaaagggtgacgcgattgacttgagcaacgcgctcccattcacaagtcctaagaagatttattcagctgaatacagcgatgctaaggatgctgatctggttgttatcacagctggcgctcctcagaagcctggcgaaactcgtttggacttggttaacaagaacttgaagatcttgaagtccattgttgacccaatcgttgattccggctttaacggtattttcttagttgctgccaacccagttgacattttgacctatgcaacttggaaactttctggcttcccgaagaaccgggttgttggttccggtacttcactggacaccgcccgcttccgtcagtccattgctgaaatggttaatgttgacgctcgttcggtccacgcttacatcatgggcgaacatggtgacactgaatttcctgtatggtcccacgctaacattggtggcgttaccatcgctgaatgggttaaggctcatccagaaatcaaggaagacaagcttgttaagatgtttgaagacgttcgtgacgccgcttatgaaatcatcaaactcaagggtgcgaccttctatggtatcgcaactgcccttgcccggatttcaaaggcaatccttaacgacgaaaatgcggttctgccactttccgtttacatggatggtcaatatggcttgaacgacatctacatcggtactccagctgtgatcaaccgtaatggtatccagaacatcctggaaatcccattgaccgatcacgaagaagaatccatgcagaaatctgcttctcaattgaagaaggttctgaccgatgctttcgctaagaatgacatcgaaactcgtcagtaatcatcacgatcactgataagtaagcaaccagcccagtcgctggttgcttttttttgtgagcgcgagcaggagcgtctagaaaccggagcataagcgaccatggccgtgatggtcggtttttgaccattgcagccatggtccttatgcggaggtttctgcgactgcgagcgcgttatggtgagcgcgagcaggagcgcctagcaaaccgcaaatatctaaatgttttttaataattctgtaacaccacggtaacacttgatattgtcactcatgccgcgtttgaaacaggtgatgttgcttttaattcgaccttcaataccttataatggcgaagtacaatgtcatcttatttgaggaagtgcttgccacgaaacaagaacaaacgaagaacaggaggcagcgatcagtgaagaaaaacaagcgatggctcctcgttgttggcgtcctcgtcgtactcatgggcggattttacatcattcaaagtatgcattatcgcgaccattttctgccaaacacagaaattctcggtgtcgatgtctccggccagaccgtcaacgcggctaacaagaaattgaccgaccaattcgatcaacgtcagtacacatttgttgaaaagaataaaaagattttgaaagttaaaggtgatgctttaggacttagccaagattttaaaaaaggcttaacacaaatccttaacaagcaaaatccttggcaatggacgacatcagtctttgctggtcaaaaaaccaatgctcaggaagaccctactattaacactgctgctctgaagcaattcgcaacttcgacggctgacaagttaaatcaaaatcgtcaggaaccggtcaatgcgaagcttgtgacaagcggtgatcagttcaagattcaaaaggaagttaatggtgatcaaattgatgccgacaagctggcgacaactgtcacaagcgcacttgataaccatcgtcaagtgattgaactaacagatgcttataaaaagccaacggttaaagcatctgatcgcgacttgcagacaactgaacgtgatatgaacaaacttgcaagcaccaaagtcagcttacagattcaaagcactaccgtcacggttccgcaagcaactgttttgagttgggtcactaatgataatggtaaggcaacggtttcttcccaagccattacaaattatgtcacggccttgtcgcaacaatacagcaccattcacaagactcgtcaatttaattcccaacaacaaggtaccgtttccgttcccgctggcacttatggttggagcatcaacattagcgccacctctgctatgattcttgctagcgtaaaagctggccaagacttgaataaagaagtcagccacagcggatctggttatacaaccactggcgacatcggcaatacctacgtggaagtctccaaagaaaaacaacacgaatggtatattaaggatggcaaggtcgtcatggactctgacatcgtgactggtaaaccaggccaagatacgccgtctggtgtgttctatgtttggtctaagcaacgtaacgctaccttacgcgggaagaacgacgatggcagttcttatgccagtccggtttcttactggatgccgattgattacaccggtgttggtcttcatgacagtccatggcaaccaaaatacggtggtgattggtacaaagaacatggctctcatgggtgcgtcaacaacccaccagacttcatggcgaagttatatgcagctgttgacgaaggcacacctgtgatcgtgtattaaaaatagattcgctcgacccataactattctttttagcgtcacaaaaaggtttgatcccggatatcaaaggatcaagtcttttttgtttattctaaattgtaaacattagctgatcagacgcgactttacgccacttggcgctaatgttcctttgagtcgtttatcttcattgcctccggaaacggaattcaaaagatctttatcaacaaaacgctggaacaattaggcattcgtaaggccaagtggtacaacttcggtaatatcagtcatgcaacaaaaaaacaacgaacccattatttaatgacatgtcaggaacggtcactgcacttttaaaaacaatcgtttccgaatagcattgtgcaacagatataacattacctctgaaagtgatcttcagcatgaacagtccagaaaaacgttacaccgccagtgatctatggtatcataaagcaagattagaatattttaataaagtgatacctgtttgatggaggaaaacgaatgttaattaagtcgttagtattaaaaaaggagttcctgaccactgtcaaggaaacggtcacccttgaagacgcgctgaagatccttgaagactccggctttcgttgtgtgccgattctggatgaaagcggcacgatcttccgtggcaacatctacaagatgcacatttatcggcacaagtctcaaggcggtgacatgagtttgccagtgacctatttgctgaagaatgccaccaagacgattccagtcaatgcgccattctttaaagtcttcttcaacattaaggatttaccgtatattgctgtccttgatgaaaatgccaacttttacggtatcttgactcacgctaaactgcttggcatgctgtcagaagcttggaacgttgatgttggttcctacgtgctgacagttatgtcgactggcgagcgtggcgatctggccaaaatgagcaagattttggccaagtatgtgtccatttctgggtgtatcaccttggatgccaaacgcgacgagttcgtacgccgcaccctctttacattgccggccggaactgatgaaaacacattgaacgaaatcgtttcccggcttgagaaaaaaagcttccgcgttgttgaaatcgatgacttgcaatcaggccaaccaatccgcatcgatgaagatctctaatctccatgtaacgctcacataaacaaaagaaggtcgatcgtttaataaacgaatcgggctttttttgtaagcacgtgcagaagcgcttgcaagcctgcaagtgccctatggtggtgcgtgtgttggtgcatgatcttgaacatgaagaacctgccttaagaaccttgcgctttgcgcgaaaggtctttgctgtccacctcatcaaaaatccactataatatgggataacgcattgcttgttgttatcgcgctgcatactaaacgggaggaataacgtgaaacgtatcactcgttttttcgatcagatcgcggccagcatccacttttttaagacacatcgtctcaagcgcaattattgacgagcacttttattcttcgcgatattgttgccagtttgtgttgtcgcaattatagcaggtcaacggttacatcagccgacaccgtcaagttcgaaagccgctatcgctctatcaaccacaaaaaagaaacaacaacgtcacaaggccaccagtaataaaaccaaggtacatacagccccgaagaacattgactggacagcaccttccgagaaacaggcttatcccgacctcacccagcatccgaacattactttagatgtcaatctaaaaaagcaacgggtttttatcaaggaaggcgacaaaacgctatacacgatgtatgcgtctactggtattgatgactcaaccccacgaggtgattttgcgattcaagacgaacggggttatgaatttttcaatccaaacgaacaaatgggcgcccattattatacaagcttttatctgcatggaacttatctttttcataccgtcccgacagatgtcggcggacaatacatcaaaaacgaggcggctaagcttggcaaagagcctggctctcatggctgcgttcggttgagtattgcggatgctaagtggatattcgagcatgtgccaacagggacgccagttaaagtgtattaaacaaataatgacgcaaaatgccgtccgacaacgcgatacattgttaaaaggcattttacgacatttaggcattctacatcaatttcattaaaagtctttcgctactattttcataaaggacaaacagtaatttgacacgtatcagattgtacaatgctgttatggttgttcacgccatctttaattttctatgacatgtttccaaatccacctatatcaaatctgcgagtctcacgattcatgtctgagaaacttaaccgagccaaccacaactatccgactgctcatgaaacaaaccgatttaattgtgactatataagttatatcgcgttgcaactcattgaaactggcatattggcttgctacaattaaatcgagcaggaggcatatgtcatgaagaaaaacttcataaatttcatcctaacgacgacgacaatcgctgtcgttgtgcttcttgttacgctaggcgacagaataaaatcaaaacaagccgaagtaattgtcttatgcgctatattattacttgtttcggttttatatcacgcctataaacaacattacagtgacaaaagagaatcattcttcgtccctaaaattaacggaattggcttcagcgttaatccgaatacatttgaaggaaaaataatttggtacgtggttttcttagtggtcatcatttttctccttgtcactatctttacgtaatctctacagtatgactcaaaatgtcggacccaatatataaggcgtcatgctagtgtgtcctattttgcctaacatgacgccttattttaattataaattttatacttcaatgttaataaataacagttttttccagtaagccatatattttacgacattacttatcaaaattctccgcaaaaatgccacaaagattacgaagttcaaatctttgtgacagtatattctgcctatactaggctctcacagcgtttcacttgccaatgttcggagcgatgcatcgacaccttccgcgcacatcctgccttcatgaatcccccagataactaaacttgggccgcgacggcaatcaccgaccacatagatttgcgtgtcattggtcgtgaagttatcatttttggcagtgatgccaaattgatcaaaaagccattgttcagcgccagtaaagcccattgccaaaaccacaagatcggccttaattttcttttcggtgcctgccactggtttaaagtgatcaacctgactaatttctgcttctttgacttggccatctttgccgaagaaagccgtcaccgtcgaggcataggcggtaatatcgccaaacaatgctttagcctctttttgcccgtagccggttttcaaaaccatcggcaactcaggccattgattttgcggtcttcgttctgctggcaacgctggggtgatttctaactgggtgatatcagcgcatccctgacgaatcgctgtgccaatacagtcattaccagtatcaccaccgccaagaaccagaacatgttttcccttcaactgatcatttgcggctggcccatcttttaaaactgtttgggtggctgctttgagaaaatctgtcgcttgcataatgcctgaaagttctctgcctggcaccttgagatctcgggcttcgcgcgcaccggtgcaaataacaacccggtcaaacgttttcttcagctcatcagccgtgatgtccttaccaacgtgtttgcaaccagttcaatccccactttagtcaacgtatcgatgcggcgctgaacgacatcttttggtaacttcatattaggaatgccatacatgagaaaaccgccaaagcgatcatcgcgctcaaataaagtgacggcatgcccgagctggttcaatcgccaagctgcagcaatacctgccggaccactgccgacgactgcaatttttttaccggtgcgatgcaggggcttaccagagtcaaccacccagccatgtttgaatgcttgctcgataataaatttttcgttgttacgaattgtaatgccagcgccgttgagtgcctgcacacaggaaacctcacaaggtgctgggcaaacgcgtccggtcatatccggcaacatatttgagcggctcaatcgttcaaacgcacgcttatcctgatcacgataaaccagatcgttccattcaggaatcagattatcgttggggcaaccactcacggctcgtccgccgccaaaaaagacgccatgatggcagaacggaataccacagttcatacagcgcgctgcttgcttacgacgttcagccatgtctaaatcaagttccatcacattaaaatctttgatacgctgcatgatcggccgcattggatcgtcttgtctaaggtattttaaaaacccttttggatctgccattctgttccctcctcgtaaacgcgttcaccagcccagaaacctgcgtataaggacctcaagcacactggccaaagcccggccaatgcacttgaggccgcttatactccggtttctgaccgggctggttcacgctctctatttcattgcttcatcaaaggctttttcaatcacttgttcttctgaaagtcccggtttggtgtaagcatcaatcaagtcgcgcattcggtgataatcgcgaggatagacttttacaaacgtacctttttccttttcccagtgatccagaatcatctgggccgtttccgagtgagtatactggacatgctttttaagtagttcaatcagaatactgtcgtctccagcttcatccaaatgataaagatcaactaggtcttgactacaatgcttcgcaaaatcgtgtgtccagtcatagacatatgcaatgccaccggtcatccctgctgcaaaattacggccggttcggccaaggatgacggcgacgcctccggtcatgtattcgcacccgttattaccaacaccttcaacaacaacattggcgccagaattgcggacacagaaccgttcgccagcacggccattgaaataagcttcgccaccagttgcgccaaaacacgcaacattgccgacaatcggtgaatgggtgtacagttctcgagcttgtggcggtgcagcaacgattaagcgaccgcctgacaggcccttgccaacatagtcattggcttcaccgaccaacttaatggatagtccttgggtaatgaacgctccaaaactttgacccgccgtaccgtgatagttgaaagccagttgtcccggttttaatccgtcattaccaaaatgcgccgcaatccagccgcctaaacgcgtgccaaccgcgcggtccacattattgattggtaggtcaatggttgtggtattttgatttttgagactagtttcagcaaatcggtctaaatccggccagtcatactttggcttgaaaggattggcctttttacgttcaattggaatcgttttgcccagcatccgatcatagttaagggttttggctttcccaaaaggtacataccgcggcttcagatgctcaccgtgacccaccatttgatcgactgtgcgataacctaatgccgccatctgttcacgcaaatcttcggccaaaaattgcatcatgtgaatgacattttcggggcgtcctgcatataacttgcgcagctctggattttgggtagcgataccgaccgggcatgtgttgaggttacatttgcgcatcatgacacacccaatagcaaccatggttaaggtaccaaaactgaattcctctgcgcctaacataatcgcaacagcaatgtcgcgccctgttaataacttgccgtcaacttccaatgtcgtgcgttggcgcaacttgttgagcgcaagcgtttgatgggcatctgctagccccatttcccatggcaacccacaatctcgggtggagtttcttggcgccgctccagtgccaccgtcatagccggagatcacgaccgtgttagcacccgctttcaccacacgggccgcaatcgtaccaaccccggttgaagaaactaatttcacattgattttggcatacggattgacctgttttaaatcataaatcaattgcgcgagatcctcgatggaataaatatcatgatgcggtggcggcgagattagctgcacaccggcaatcgagccgcgaatgctggccacccaagggtaagctttccctgctggcaactgcccaccttcacccggtttggctccttgtgccattttaatttggatttcttcagcactcatcagatactctgtgttcacgccaaagcgcgccgttgacacctgcttgattttgctgttgcggttcagaccatctgcaccgatatgaaatcgatttctgttttctccgccttccccggaattactacgtgcacccaacttgttcatggcaatggcaatggtttcatgcgcttcttcagagagtgccccaaaactcatcgcgccggatttgaaccgtttcacaatggaactcaccggctcaacttcgctcaacggcaccggtttacggccgttttgatcaatcgtccacatcgatcttaaggtcactggattttcctgttcttcggcatccagctctgccgtgtactgttgataggcctgatagtcgccgttcctgactgctttttggaattgataaatgctcttgggattgtacagatgctcttcaccatcggccttatattgaaaactcccgccagaaggcaaatcgtcaatcgcgtgattgctgaaggctcgctgatacttttggtaatactcgtcttcaagctggttaagattgatgccaccaatccgagttggcgttccggtgaagtattggtcaatcaaactatcagccaaaccaactgcttcaaacaattgcgccccttggtagccggcggttgtcgaaatccccatacggctcatgattttgatgatccctttggtcgccgcttggcagtaatctggcgattgcgcttcaaggccacgttcctttagcgtcaagaaagcgccatacggatgaatggcagcggcaccgtaaccgaccagacaggcaaaatgatgaatttcgcatgcctctgccgtgtcaacgacaatagacgcagcagtgcctttactttgccgtaccaaataattatgcaagcctgatacggccaacaaaaccggaatcgtcatctgattgtcagcaactggtcgatcactcaacactaaaatcgttgcaccgccatcaatcgcgttttccgcctgcgtgaaaagatccttgagcacatgcgccaaacgatcgggcgtatccgtcaaatcataagccaacgacaatttagcgacttgtaacatcggcaaatccaagttgagaattttagcatattcttgatcgcttaaaatcggactgtcaattttaagcttgtgacaattttcagcagtatcgcgcgtacaatcaccatcgcgacctaaaaagccaaaagtcccaatgactactttttcccgtaatggatcaattggcggattcgtcacttgggcaaacgactgcttaaaatacgtgaacaaagattgcgattttttactcaaaactgctaaaggcgaatcaaagcccatggcaatgaccggttcaccaccattttgcgccattggcaacaacgctgtttgaatgacttcgtgggtatagccgttgcgcagccaaagttttttcaaactgtcgatcggcatactttcatctgatttagcgtcaggtaattcccccaacgttaatcggttggcattgagccattgctgataaggatgcgcttcggcacaagcccgtttcaaatcacgagtcttcgaaatgcggccggtactggtgtcaactagtaacatctcagcaggtgccaagatccctttttcgacaatatcaccggggtcgacatctaccacccctgattctgaggcaacaaccaattgattatttttcattaatgtgtagcgtgatgggcgcaacccattacgatccaaaaaggcaccaacttgaatgccgtctgtaaagcacaaggcagctgggccatcccaaggggccatgaaagtagcattgtattcgtcaaacgcccgttgttcatcagacatttcggtaccttcgccccaagcttccggcaccatcatcatcaacgcttgcggaatggatcggccatgccgatagagatattccatacagttctctaacttggcggaatcagagtcagtttcatcataaatttcaataccatgactggtcatccaattttcggcgccctttaacgtgttgatttccccgttatgcgctaaaaaccggaacggttgagcacgatcccaactcggaaacgtattcgtggaaaaacgggagtgaatcaagcaaatggcacttttcatttgcgggttatgtaaatccgggtaaaaaagacttacttggtaagcatgaagcatgcctttataaacgatggtgcggcttgagaaagaacagatatacatggcttgccgatcaaaggttttctctaactgccgtcgcaatgcataaagatgatcctcaaagtcctgccctgcctgtgtgtctgtcggccgttggaccacaacctgaacaaagcccggcatagcttgttgagccgcgggaccacagttttcgtaaacaaacggaacattggcgtccaaagaaccggaaagccggcttcatcgatttgactcacgaccgcctttaacatggcggccttttcttctgcatcatgcggccaaaaaagctgagccactgcatagtcaccttgcgccggtaacgttaattcatagcggtgcatttcgtcacggaaaaaagcatccggcattgccattaagataccggcgccatcacctgtatcaggttcagcaccggtgccgccgcgatgattcatgcgttgtagcatggtcaacgctttttccacaatttcgtggctagcgtgaccatccacttgcgcaataaatcccataccacaggccgcatgctcaaattccggtaggtacattaattttttgtcatgtgctaagtgatccatgaaatccccaccttattagttaacatcaatgtcttgagcctaaagatattggtctcatagtattctaataatgacaagattacaatgcttttttctttgtctgccgtttcacatttggctccgaagtctatcaaagcttgcagaatccgccatctggtcacaatcaaaagcagtgcatcagactgatttaataggaaatcagactggtgcactgttagtcatggtcggttgcaagatctttttttattttttagttgtttaagataactgccatcattttctcacgatagtggcgtgaaagtggacgattttatcaagtccgtacatgatcggcgcagaaatcgtcatgataatgaactcggaaagcatcaacgaaacataggttggtaaaaacattgtggcgaaacttaaatgccccgtccacacaatctcaacggcaatcaaggccatcgtgatcgtcatgacagcgatatttaaggcaaaccgggcccagagctgacgcaatttcggcgccacccacccgaccaacagcaagccgagcaaactttgaccgccgccaaagaccacgtcaagccaaccaagcggtgagaagatagcattgaaaatcacgactcctgtcacaacacccacaatatatttacgatcaaacacgaccaattgattcaaactttcagacaagcggaattgaatcgcgccactggccaaattaaggctcgcgggaccaattgatagcacaatatagatagcagcgaccaaagcattaagtacccaaccgcgtgtttttagatttgtcatgaaagtcctccattaaaagtcacattatttcgtcatagcgcgtttgccggagcagaaacctgcgtaaaaggacagcgaatgcagtaacccaagccccgtcatcacgtttgaggccgcttgtccctggtttctaaccgctctggcgaacgttcaacaaaaaacgcgctgttaagcgcgttgctgttaattcttattatatgttttgggcttgggcaaactgaccagacccactgaaatcgccaacgcgcggtcgactgctgccattttggtgcttgacagagctgtcacgcgggcttgtagccgttgcttgtcaatcgtgcgaatttgctcaagtaaaatgactgagttgcgttcaacgccatcttgcttggcccgtaacccgacatgcgtcggcatcttgggtttttgaatcttggaggtaatggctgccacaatcactgtgggactgtaatggttgccaacgttgttttgaataataagtactggccggttgccgccttgttcggagccgacaaccggagacagatcggcgaaaaaaacatcgccgcgttttacggacacatccatgcttttgcccccttatcgctcatcgaatatgggcgtatgcctcgctctcgcaggcagagaaagcatgactgatctctgtattgatctggcccattgctacatagccagaaatcaattggttgatttcgggagcctgtgacttcaaaaatgtcgccactgcctccgtaatcacagcctgagcgtcaatgtcattcaattcacaataggcatccaaccgcgccttaatggcatcatcaaacgttaccgctactgacgtttgctttttcatgacaacttcctccaacttcccaagttcatgttgttactttagcacaaaatgggcatacgagccaccatcaatcgaccggattcacgctctgtcgcttcaggcgcggcgttaaattgcaggcaatttcgtaatgaattgtcttgctatatttagcaacgtccaacaacgtaatctcctgatcgccactttgcccaaccaaaactacctttgtgccagctggatatgctttgggcaaacgaatcataaactgatccatgcagatacggccaacaatttcacaatactgaccatcaacaaggacatgaaagccctgtaggcgccgcaaccagccgtctgcatagccaatcgggacagtcccgatgaattcatctcctttggcacgataggtcacaccgtacgaaataccgtcaccagcatgcacctgcttgcaataggtcaactcacttttcaatgacaacgctggttccagtggaaacggtgtggttggaatcgcgtccccagacggatttaagccgtaaatagccaccccataccgaatcatattgccattgcaagccgcatgccacaagctggtagccgaattagaaacatgcacataacgcggccgacttggtaaaagattgaccagatgattgaacttgtcaacttgctgtttgaaataagtatcatcaggagcatctgccgttgcaaagtgagtgaagaccccctcaatgacaaattgcttgggatgcgcttcaacaaacgcaactgccgtcttgagtgcttgatcttcggtaaacccgatacgacccatgccggtatctaaagccagatgaatacgcaacggcggcagctctggctgtgcttctaacactggcaaagcctgttcaagccattcggtgctgctgacaggcaatgatattgtttgggcagcagcaatggccgcatactgactcggtacgatgcctaacaccaatactggttcactataatcggccttgcgtaatcccaatgcttcatccaagatcgccacacaaaaaccggttgcaccagctgctttagcaacccgcgccacccgcaacataccgtgaccataagcatcagccttgaccacagcgaaaagctgcgtctgcttttttaatcgtgcgacctcatgctggatattatgcaaaatggctgtttcatctattaataccgttgctggtcgaaagttaccgatcgtcacgttcaggaccttctttttctaaaattacctcggtgaagaccaaggtttcactgtgcgaaatggagacaaaagcctgaccggaaaaaggatgcttcgtcagaataggtttgcccaactcattattgagaatttcgacatcctgtaaggcgacttttcctaacccagtaccaaatgcctttgagtacgattctttggcagagaaacggccggaaagatattcaacggcgcggcggccatcaagttgttgataatttgctaattcagtcggcgtcaaaattttaaccgcaaagccgctgtttttttcctgtgccgcctgaattcgcgccaaatctgtgacgtccaccccaataccgtaaatcatgggttgcctccttaaccgcgttgacatcgccggaactaaccactgttcctgctcacgctttgtcataaagttattctagcatgcttttacagaaaacgggtgtttggttgaagcaaaaaaagaactcaggacgtttaacctgaggccttttgaacgctttaattaaaaatcattcgccattacggattttgaaactacgcttaacattcttgcgtttatcgctgaagttgcgttttttgtcgtaactgcgcttattatcacggttgccttgatagccgccttcgcgacgcttacccttgtaaccgcctttataaccgccacgattattgccgtgaccgtgattgctgcgaccgcgatgtggcagcggacgttctggcgtgattttaaccggaacggcactggcatcatccgggctgactgccttaagataagcggaaaccaactgtaacggggtgtagttttccaacaaggattcagccatagcttcgtacttttcagtatcgttagcttcgacttgtgccttgatcgtttctaaaccgctggagatctggcccatcaatgcttcttctgctgttggtggtttcatcggcagcatccgcttcttggtcaagtcttcgatcgtgtgcaaatattcgatttcgtttggggtgacgaaggtgacggaaacacccttgtgacctgcacgaccggtccggccgatacgatgaacataggaatcaggatcttgcggaatgtcatagttgtaaacatgggtgacaccggaaatatccagaccacgagcggcgacatcagtagccactaggaagtccaattggccactcttgaactggcgcaaaacgctcatccgtttttgctgtgtcaagtcaccatgaatgccttctgcccgataaccacgcgcctttagaccacgggttagttcatcaacacgacgcttggtccgaccaaagatcaaagccaagtctgggtcttgaacatcgaacagacgagtcatgacatcgaacttttcgtagtcttttgcacggacataatactgttcaacggtatcagctgtgagttcctttgccttaatcttaacggtgaccggttcatgcatgaacttattggtcaaacgcatgatggaagcaggaatcgttgcagaaaacagcaaagtctgacgcgcggttggcatttgttcaacaatcttttcaatgtcatcgatgaagcccatgtcgagcatttcatctgcttcgtctaataccaagactttaagattttgcaacttcagggtgtgacggccaatatggtcaaggattcgacctggtgtccccaccacaatttgtgggtgttctgataattgacgaatttgccggcgaatgtcggcaccgccgtacactgcctggaccttgattttcttatcttggcctaaacgataaagttcttcttgggtctgaatcgccaattcccgagttggggaaatgaccaatgcttggatactccggtcagccttatcgatgttttgcaggatcggcaagccaaacgctgccgttttcccggtaccggtctgtgcttgaccgatcacatctttgcctgccagaaccagtgggatcgtctccgcttgaatcggcgtcgcttcctcaaaacctgactgggcgattgcctttaagagatcatgatccaaacctagttctttaaacttcaaatgagttcctccttgagaattcctgcacgcgtttacccaagcgtgttttcaaaggaatccgcgggcatcacgtgcattttcagtaaatgacaaaaaaacatatccgaacaatagtatcatgctcactataaaaaaacaagtgccgagattcggccaagtcttgcataatcaccaaaagcttcagtcaacacatacttatttaagcctaaactgacatttttaaaagaataaaaaccgtcaaaacatgctaaaagccgtttcattttcatggaacggcctttatgcttacaacgctactattaagcacgaccaccagcgaccaaagctgacaaaacggtttccagatgcaatccgtgactcgctttcaacaaaaccatatcgtcatggttaacatcgttttgtaagtcgcgcgtcatctgttccttgtcatcaagcggataatagtgcaactgatcggctggatattttactgccaatgtatcggcaagtgctttcatatcgctaccgtatagataaacaacctgcacttccttaggatcgagtgcctctgccagacctgcatgcaacgccggactttgttcaccaagctccagcatgtcccctagcactgcaatgtgacggccagttgccgtaaattcgctaaaatcatgaatgacggctttcatcgcggtcgggttggcgttataaacatcgcttagaatctgttcacctacatccccgatcaaccactgtgtccggttagccgtcacctgaaaatgagccaatgccttttgcatgatttcgggtttgacatggaatttgcggccaactaacagggctgctaacgcattgacaacattatattcacccataatcggaatcgagaacgtcagatcaggccaagcctcaactgtgaactcagtgtggttacgatgcccgctgattgaatgggcaaatatcgtattttcaggatgcaagccaaaagtttcgcgctcctgcgtgatcttcttcgcccgttcctgcaacaatggttcgtcaccattaaaaataaacgtaccatcatcctttaggccatcagtgatttccattttggcatcggcaattttatcccgggtcttgaaaaattcaatatgtgcttccccgatcatcgtaatcacggccacatccggttcagctaaggttgacagtgcatgtaattgccctggccgatccatccccatctcaagaaccaagacttcggtattgggttccatgctgagaatagtcattggcacgccgatttcattattatagttatcaggggttttaacgacgtgatattgtgtggccaagattgcagcggtcatgtccttcgttgtcgttttgccattgctgccggtgatcgccaccactttgggattcactttcatcaacagataatattgtgccaattgttgcatcgctttcaacggatccggcaccaccagcgtaatcagcttggtggtgacaggtaaatgatctgctgcaacaaatgttgccactgcgccagccgtagcagccgccggaataaattcgtgaccatcacgttcaccgcgtaacggcacaaacagcatacccggcttcaatttgcgtgaatcaaaagccagtccggtcaccacatgcgacccgtctgcttcagagagcggttgagctttcacaactcgcgcaatctctgccaatgtcatcttcataattaattcgactccaattcttcaacttcatcctgtttaagaacaggttaaaacagtccattattggcgatgatcggcagatgcagcatcatcaatcatcatccactgattcttttgccgcatcaaaacaagcattcccaatcgccggacatctgtatccgtcaagataccatcaggaacgaaccgagctttcggtgccaaaagtggcacactgattttttcacgagaaaaccggacattccggaaatcaaataccacgccatcttccaataatggtaaaaactgtgtatagacggcatgtgacacgcgagaaaagtgctgttgccgtaagcgtaaccagaatggttcctcattagcaattcgccgcatatacttgttaatggcgtttgctaagaaggtcgcaaataaagattcgttacgcagatacatattcaccataccgtttcgcaatggcaggtaaaccaactcgttttgcaatttgtagtaaaatggcgaacttaaatgcgttttggcatgtcctaagtatagcagttccgcaatctcgttaggcgtgagttcctgcaaaaatcgcgggcttgaataatctagccagcaacgcgtctgacccgctttactccgcaaaaagtcctgaacctgatccgcgccgtcgataatattgaaccaagtatgcggatctatctgttcctgctcatccacagggggcagcaataacagatgcttcggtacttttagatggtcgctcagcaaatcacttgctgaaatgccatatgtcaaaaacaaatgcgccaacggttcatggcgcacataaatcatcgcatttcgcacgtttaaaaccccttcaatactcccgacttaattatacgactttcacggcatcacatgcgttaagattaagagcgtaagtcaatccggtttctgcgctagctctcctcattctatctaagaaagagtaacctatgatgttacaaccatggcctaatcttatccctcgtcctgatttgccaacgattccaaaaacagcagccattccgcctgcttattttaagctcattcaaacaggtattttaccgatgaattggtggcttccgactaaggagccgacgagtgatgccattgacggcgtgggtatccacgcctttgcaactgttggcccagccatgacttcaagcgatttgccagcacattttttgccatttgccaaaaccgggcaccaatattttggcttcgatctccagcaggagccacgccagattcgctatattgataccgaagtcgaccagtggctgacagtggcgatggatttgccagctttcatgaagcaattgcagcctcatgaagcaaagttgccagaaatttcagtcgatccgcagatttttggacatatggccgtcatcgcgacagcggctgaatggccagcgctgtttgattacgcgcgcgaattcatggccggccaagcaattggcccatggctgcgatggctcgcccaatcaaaagaggaagctaagcggcaagtcgggatggaagaatttcattttctcacccgttaccagcccaacttcctcacacccaacgacacgctgacactgcagcatgtattcggctaatggttaaccgacttatggtcaggttggaatgcgaaggtgtccaaccaacgtagatcccgtttgattccaaaataaccaaacaaagcaagtcccaacgaaccaaagaagtccataaacaaatcacccatcgtgtccatcaatgccgcccggccacgcagtagctcgccgccagtcgccatgtaccgctgcatattcaatcctaataatccatcaaaggtgaactcataaaattcccagagcacgccgatggtggtgccaaaagctagtgcaaacaaggccatcaacaacgggcttgttgatgtcaaccgtttttgcggggtcaatgccgcaaaaatagcaaatcctaaaccggcgagcatcgcggcactgaataaatgttcaaacttatcccaataaggcacactgtagcatcgcaatcctgtccccagtaaaacgcttaaaagaataaagatctcgaataagtaaattaaaaccggtggaaatctaaaatgccaccaccgctccatcaatcgcggtaagctgacaatcaatatgccggacgcaacctgcgccaataacatcatctgaccatgaaataacgagtggccgctgatataaaggccaccaacaatcaataagtaaagcaggtcgccaccgacattcagccagtataaaaagttagatcgttttgtcattgtttttgccccttttctttaatgtaacatgacgcggcaagtcatttactacctctttgtaagcgcttggtgtagactcaaagataggaggtgttatctatgccgatcaaaacattacctgaagatcaactcgtcaccatgagtcaatttgtcgtgaaagatgtcgctaaagcttttgactttccctattatgtcaatgatctcacacatgacgcaaattttgacactgagcacacagcaaccaagttagaatttgagctcaccttgttgaatgatcctgatccagaacggaccatcagcttttacagtgatgccagcgctgacccgattatgggtggtgctgcatcagcacaggtcatcgttgagtcagggattaccttcgtttatttaaatgatggttacaaggattcctacctcattatcattcgtgatggtaaagtggtccaaaaccttaagcttgaacaacaaattctgtccggcccagaggtagaagatttgattgataatgtgatgccaaaagcgaaatgatttttgatgtcaaaaggcagccggattgcggctgcctttttggtcgcttgtgatgcgtcaaactgatgatcgtgcagataatgacaaagcgctgatagcctctgaaacgtgagaaaaggcacaacgcaactaaagatatcttttcttgctcaacaaaaaaaccaccacgagggtggaaaagtttgggggaacttttttgggagtgtaagttaatgtgtaagcttaaggctgaaatacatctgccttattgacctaagtatagcaattcactaactcttaggtggttccattttcaacaacaattctgttcattttataaatccacttatatattcataagttttaactacaaaaaaacagccctattggctgtttttggtttatttcttgtccaaaccatacttcttgttgaaacgatcaacccgaccatcggcctgagtgaatttctgcttaccggtgtagaagggatgggagtcggatgaaatttcaacccggactaatgggtattccttgccgtcttcccacttaacggtttcttttgaagttttggtggaacctgagataaatttgaaaccagttgctgaatccataaagacaactggatgataatctggatggatgccttgcttcataatgattactccttttgccctaaatcattgcctgatctagagatactcttacaacaactctaatagtctatcacggtcatggttcaaacgcaatctcaatcaatcaactcaacatctgcgccgaggccacgtaatttcatgacgacacgatcataaccacgcaagatattatcaactttggtaatcgttgtcgtgccttccgccattaaaccggcaatcattaagcaagcacctgcgcgaatttcttcagctgcaacttcagtgccttgcaaatgatcgcaatgatgcaaaataatgacgtcattttcaatagtaatatccgcgcccattcgcaacaactcaggaatatgccgaactcgtttaggataaatggtatcaatgatcaagccctcgccatgagccttcagcattagcggcgtgatgggttgctgcaaatcagttgcaaatcctggataaggcatggttttaatctgaaccattttcaaatcaccagacgggtaaacgaagatactgtcctcaccgacatccatgacgacacccatttcctctaatttagctaaaaaggcatctaaatgttcggaaataatatttttaactttcacaccttcgccgatcgcagctgccatcgccaaataagtccccgcttcaattcgatcagggatgatggtatgtgagttgtgtgcttcaagggttggcacgccgtcaatccgaatcacatcggtaccagcgccacgaaccttagcccccatattattcagatacgtggctaagtcgataatttctggttccttggcagcattttcgatcacagtccggcctcttgctgttaccgcagccaaaatgacattgatcgtagcaccgacggacaccatatccaaaaagatgcgtgcaccgtgcaagccttcagctggtgccttgatggccatcgcgccgtgttcattgctgacggaagcccccagtgcctcgaacccttttatgtgctgatcaatcggtcgtggtccaatatcatcaccgccgggcaagccgacaattgctttaccaaaccgccctaataacgctcccatgaagtaataggaagcgcgcaaactttttattttgccatttggcagggggacatcgttaatttcagttggatcaatcgttaggacgttctcagtaaaatccgatttgacattcatgtcatccagaatcgccatcaaattatagacatcctgaatatgtggaactgaatcaagtgtgaccggggtgcgtgacaaaatcgccgccggaatcaaggcaacggtactgttcttcgcgccgccgatcacaacttcaccggataatttcttcccgccgtggatcagcattttttccattgagttaaatcctcacttaaaggtcgttcatttcaaataggctgaagctggcctgcatctatgcttcaaaataaactgcgatttctggtaggcgaggcacaacaaactcatcatgcactcaacatacaagtttaatgaattctatgggaaaaaacaaggactaaaagaacagagcgcgaactggtgcgattagaaaccggaatgtaagtggccttggtcgtgatggtcgctctttgaccattgcggccatggtccttacatgcaggtttctgcgccagcgagcgcgtttaagaacctgagctgccccccaagtgcttcatctgccaaaaaagccgtctcaaagtaatgatacctcaggacggcctttataaatcaatgaaacctgctattaagctttaaaatcgcctgctgcctgaatgaaggctttgaataatccctccggcttgtttggccgcgattggaattctgggtgatattgtggggcaacgaagaacttgttcttcggatattcaataatttccatcaagcggttgtctgggctgacaccggaaaataccaatccgtggtcttccattgcctgacgatacttggtgttgaattcgtaacgatgacgatgacgcttttgaatttcatgggcattgtcataagccttcgctgcaacggaacctggcttcagaacacatggataaaggccaagtcgcaaggtaccgccaagatttttgacacccacttgatcacgcatcaggtcaatgatcgggtccttgatatcaggttgcgtctcagttgtaccagcatctttcaggcccagcacatcacgcgcaaattcgactgaggccatctgcatacctaagcaaatgccaaggaatggaatatcgttttcccgagcatagcgaatcgcggcaattttgccttccaaaccacggtcaccgaatccgcccggaacaagaatcccatcaaagccttgcaacaagctttcaacgttatcgtcattgacatcttcagcttggaacatttgcagatcaatatcagagtcccaatagtagcccgcatgcttcaacgcctcggcaacagaaatataagcatctttcaaagcgacgtatttaccaaccaaggcaatcttagtggtatgggtcaaatgctgaactttatgctcaagctgcgtccaagcacgcatgtcggcatcaggcacatcaaagccgaaatgatcgaccacaatctgatccatgccttgcgcttgtaatgccagcggaattgaataaagcgtctttgcatcgcgtgattcgatgaccgcattttccggaacatcagtgaaaagcgcaattttcttcttcatatcttccgtgatcggtttttcagtccggacaacgagcatattcggctgaatcccaatactacgcaattccttaacactgtgctgagttggtttcgtcttcatttcatcggccgcgcgcaagtatggtacaaggctggcatgaatatagaaaacattttccgaaccaacatcacgcttcatttggcgaatggcttcaaggaatggcaatgattcgatatcgccaaccgtaccgccgatttccgtgataatcacatcggagtcgctatgctttgcggcccgcatgatcttctctttgatcatgttggtaatgtgggggatcacttgaacggtcgcaccgaggtattcaccgcggcgttcacgttgcagaacttcagaataaattttcccggttgtgacgttgctgtacttattcaggttgatgtcaataaaccgttcataatggccaaggtcgaggtcggtctccgcgccatcgtcggtaacgaacacttcaccatgttgataagggttcatcgtcccaggatcgacattgatataagggtcgaatttttgaatggtgatcttcaaaccgcgattctttaacaaacgacctaaggatgccgcaacaatccctttacccaatgacgatacgaccccaccggtaacaaaaatatacttggtcatagccagtctccttttttaataatcgggaaaaaacaaaaacaagctccctattcatacgaacagggagcttgaaccgtgttggctttacattttgtaaagcgcccaagctgtatattaactaattgtggcaaagacgtcaaggcctaaaacttaagtatgaaatgtcccaaataatcataaataacatcacgtctcaaagacagccttaaagtcagctttctgcttccgctataaatcctttaatcatggacttttctcggtcgtccctgacgatagggtgcaccattttgatgtgtgttttttgcctgctgaaaagccgcaaaccaatgtccgagtgttgttggattaatgttaagctctgcttcagctgctttcgcgaagttttcccatgctgttcgactaatttcagtattacctcgagcattgcgcgactcgcgaatgaactcgccaaccaaacggcggaacttcacttgctggtcatggctcatgcgcaaataatcttgttgcccagttgtttccatttgctggataccggttagttcacgagcatcattgtcgatcgtaaagaaggaacggatgggaatcgcaatgtacaaaatatacgctgccttgggcacaaaaatagctaaaatcataatcgcagcgatcatgataacattttctaagttgtgctccccataaatactggtataaattttccgcatttcgtctttatcattggcttgttgatgcacgattgtccttgatatgagtcgaaatacgacaattaccaaaaagtagatcgcaccatagataatcacagagatggattcaacatctcctgacatcagtcgcgtcaatgctggcaccagtgacagtaggaaaaccaagatgaattcccaaagcacgattcgtcgtggaatctgatcaacggtgctgaacaaagttgcttgctggtaccaaatattcgccacgaaacagaaactgacagcatacaccccaactgccaaaaagaaattggtaatgttggcatgatgttcccaactttgcgcaggcaactccaagaccataatggtaataataatcgcaagaatagcgtcaatgaacgtatctaaccgggttttaagttcttttgaaatcatcgtagatccccctcttgttagaaagtatcgtgctttgtcaaaaattgtcaacggtcttaaagcgtaaaagaacatttaggagcagtcaacttgtaacactcgcacttttaaggtttttaggataccacaaatagcggtaaaacacgatcatcttggtcagtatgccacttctaggatttgcctactagtggacctaaaatgagcttcataacaggctcgcagtcgcaaaaacctattcagccccaattcagaaagtggacccacagacgcagcaagctatatacgagcctccaaaactaaaacatcaaaaccaatccatgttgacctgtatcggctagtacttcgggtgctaattgcgcctgctcgcgcacacaaaaaaagccgtccccacaagacatgggcacggctcgccaaacattactttttggtgttgctatcgtcatcatcatctgaatcgctgtcgtcatcatcgtcatcagagaagtcagcggtgatgtcatcgttatcatcatcatcgtcgctgtcgtcatcgccgaattcggctagctgaccttcgataccatctggcaacccatcatctgggtcgtcatcactgtcatcgtctgtgtcagtcgtcttcccgaccttgtcgtggaagcctgagtcatcgtcatcgaaatcatcgtcgtcatcgctatctgcgtcgagatcctcatcttcaggatcatcatcgttatagtcgatcacgtcatcatcatcggcaacgtctgctaagaaggcattgaccttcttacgcttcttacgacgtggtgcctcttcttcatcttccggatggttaacttcttcatcaacggaatcgtatggataccaagcgcgcaggccccaaacgttatcgcctaaagaaatgaaactgccatccacgttcagatccgtgtagaattgcggtaaacgttcacgaatttcttcgtcacgcttaccaagataattctggatctcgttggccagatcaacgaacgccatggtatcccctttttctttgaggatctcatgggctacttcgatcattgataattctgatttatcggcattggcaaatgctttgagtttcaaccgatacacgccctttccacagtttatacagtctgtttttcatcatacacgctcaggcgttgaattgcaatctcaatcgataatcacccaagtgctggttattagcaaaaagttgatattcaatgtagacttcacctgccacaggttcagttgtcatgcgaacgtcaatccgtggcgtgaccgtttcaaccggaatgataccgtacggtgtgcgatagcgcgtcagcacgcgcttttcattggcaaaaaacagtttcagctgagtgtcgccgttgctgctgccacgcgacaactgaacatcgccatcttcacgcagcttcatcgtcaccggcatactggtcccagcatcttcgtcaacttcttggtaacgaatgtataaagcgtttcccatctgcaccaacgttccaggttcgtcaaaaacatgtgtctcattgtcctcaccctgcgtcacaaacgtctcaaggtgaatttgaatcggcactccttgtgaaagatccataatgtcaatcctttctaacagctattgtacgcccacgggtcaaactggtcgagtcgtaacaattatccatgtttcaaatcacttactgcaagatatgcaatgaaaatgcagttccaactgacgtggcttgttaccttagttataatataagtaatctatcatatagaaagaaggcgcgtgatggacttgacaacactggccggccagcaggcagcaatttttcagcaaaattttacaaaagacgaggcgccgctcagttttgcccatactaacgcgttattggcacatcctgaattgcacccacctttgatgctgcatttctggacggcagaccaaaccgtcattctaggcatgcaagatctaaaattgccgcaactcggtcacggattgcgagtattggcaagtgatggctatggtttcttcgttcgtaattctggcggtttagcggtcattgcagaccgtggggttttgaatgtatcgctatttttgccaaatgaagacgagctttcaattaacagcgcatacgagctgatgactcagcttttccgcaccgcgtttccgagtctgccaattgcgaccactgaaatcgtccactcttattgtcccggtaaatacgacttaagtgttcgcggacaaaagtttgcgggcatggcccaacgccgtaatcgcgccggcatcgttgtgatgctttattgcagtattttcggtaatcaagacgctcgttgtgccttgcttcggcgattctatcatgaaggcaaggctgctgccagctcacattttaccttccccgtgattcgatccgaaaccatgacgactcttagcgacttgctgggacgaccgttaacgcttgagcaagcaacggtcgccttgctaaatgccttggctgacactggcatcgccgctgatatgaattcaatgccaacccttttgcgcgatccagcttaccataaggcgctgacagaagcgactgccgatttgcacacgcgcaatcgcagcctaaaaaagatgggagaacatgatgctatttgaaaagttacctcgcgaaaaagtctttcgcgatccagttcataattatgtccatgtgcaacatcgcgtcattctggacctgattaataccccagaatttcagcgattacgccgcattaaacagctcggcgtttctgattatgtttttcaaggcgccgaacatactaggtttgcccattcacttggtgtttatgaaattgcccgtgagatgtgtgacaactttgtcaacaactatccgacacaaacacctggcgatggcctatgggatgacgccgaacggccagtcgtgttatgtgccgccttgctgcacgatatcggccatggtgcctattcgcatacatttgagcacattttcgacactgatcacgaggcgattacgcgagcaattctcacggattcgcatacgaacgtgaacaaaattctgcgtggtgtcggtccggaatttcctgagatggtcgcatcggttatcaaccacacctatccgaatccgcaagtcgtgcaaatgatctccagtcagattgatgctgatcggatggattatttgttgcacgatgcttattacaccggcacgaagtatggtctcttcgacctttcgcgaattctgcgagtcatgcgaccatactcggatggcatcgcttatgaagccaacggcatgcatgcggtcgaagattatgttgtcagtcggtttcagatgtaccagcaggtttatttccaccctgtgtctcgtggcatggaagtcattcttttccatctgctaaaacgtgccaaattcctgtatgagtccggtcagtttgaatctggcttttcgccgcggctactcgtgccattttttgaacaaacttttaacctcaccgactatttgaaactcgacgatggcgtgttaaacacttacttcacttactggctagattatccagacagtatcttaagcgattttgctgatcgcttcttgaaccgccgaccactgaagtctgtgacctttactgaccaaacagcctatctcttgccacgcttaagggatttggtagcatcagccggctttgacccgcactactacacagcggaaaatgatagttttgacttaccatatgaccaatacgacccagcttccgcaaatccaaaaacgcaaatcgagatcatgcaaaaagatgggacgcttgaggagctctccaccctatcaccgttagtcgcggcacttagcggtcgggcaaccggtgacaaacggttctactttccaaaagaaatgctagccacgcaagacagtaacctgttttcgccaatttatgaaaagttccagcattatctgctgaatggcggtctcattgatccacactttaacgattgatgactgccttatcgcttaggttgattggctagccatttggcaactgcccaacggtgggtcggtcgtttcagctcagcgatggctaggtcaatcggcattaacatcaaggtattaaaagtttccagcggatcttgtacaaacgccaattgatcacaagcaaaaaaagttgccggatgataataagctgtttgacggtgatgagagtaaaaatattcagatgacttgcccaacttttgggtgacatgaacggttgcgccaaattcttctaacagttcgcgtgccaacgtgacttctggcgtttcgccttcctcgacgccgccgcccggcaagaataaggcgtgattgggcgcctgcagaatcagcaaccgagcgccactatgatccggtatgacgccatatgcgccaatccgggtatgataatctaactttggatcttttcggccaaacacaggatcgatcatgttgattacctccgcttttaatcacattatgccctaatcattttttaacctctacacaaggagactttccaatgtcagctcaggaactttttattgtttttgcgatatcgatcgtattaggtgtcatcttcgcttttagtttcaccgtggagccgcgacggttgattaatggtgtcttgtttaatttttttgcggtcacgtttcttgtggcgttagcgattgccattttaaggtcaggcaatttgttgctaatatcggtcaccggcgtattgttcctgatcattattttgatcgttgctttgctctttgcgttgcatttattctggttgttgtggaatgccattctggtttggcggcgtgaaggtcattcattgagcaatatgctgactttatatattgcaattggtttgttgctgatcgaaattgctgcttcttttggtcgccggttcattcctgatccgttgtacttctctcttgcaatcttttttggtctcggcggcttttatgtgctcttaacgttgtataattttcttacagttttgattctgtataactttcgtccgcaaccgcacaatcgtacatttctcattgtgctgggcgccggtttgttacatggcgaccaagtttcaccgttgctagcgagccgaatcgatgctgcgatcaagttctatcgcaaacaaatcaaaaagggccgaccagcgccgcgaattattttttctggcggtaaggggagcgatgaggccatctcagaagcgatgaccatgcaacgatacgctttagggaaaggcatccctgaaggtgacacgcttcttgaggatcagtcaaccaccacattggaaaatatgcaattttccaaacgtctcattactcaagaaattggtgaatcaccttataaggctagctttttcacaaataattaccatttgtttcgtgcaggcatctttgcccgcatggctggcattgccgccaatggtgtcggcggcgcgacttcgttctacttcctacccaatgcggtgattcgcgaatacctcgccttagtggttctatataagcgacggcatgctgtcgcatttggcctcattgtcttgattgcgattgctgaattcttacgggtttggcatctgggataagccgcagagatgcagcataagtgttgatttcagtatactaattttgaagggagttactgtttatgttaaaagaatttcagaaatttatcatgcgaggtaacgtgctagacttagccgttggggtcatcatcggcagtgccttcactggtttagtcacctctttaactaaaaaccttatcaacccgattttatccatgtttgcgggcaaagctgacctcagcgggctttatttcacgatattgggcgccaagtttacatatgggaattttatcaatgacgtgctcaacttcttgattattgcttttgtagtctttctgctagtcaaaggtattaaccgcattttaccgtcaaaaccggccaaaccagctggtccgacacaagaagaattgctaacagaaattcgcgatctgttaaagcaagatcaacaggtctaataacctaaaataatcatcttgtacaacgctttatcccataaatataaaaagtggcctcgttgcagtatttacgcggggccactttttatatgaataattgaatattaacgcttgtttgacaacttggttctttaccaaaagcttagtagccgtatatcaatactgccgcttaccgccttgatagacttgtttatctttttgttgaaaagccttcacatcagccatcggatctttttccaaaaccaaaaagtcagcgaacttgccttgctcaagggtaccgtattgatctgcaattcccatcaacttggcgccattaacagaagtcgaaaaagcttcaaacggggtcataccttgttcaaccattaattcaagttcaacaggcgacatcgtaaaatcattgaaaggtgtgccagcatctgttcccagtgttaaaggaacaccacggcggaaagcattcatgatgttcttgtaaagatcatccaaagcgtcagcagcctttttgacttcccaatcaggaatctttcctttggcgaaagtaggaatcgcccagtcggccaccaacgtgggagttaaataagtcccttgtttcaacatgaggtcaatttcatcatctgtcacataaaaaccgtgttcgattgaatcaacccctgcttgaatcgcattcataatgccaggatttccttcagcatgtgccgcgacaatgtgtcccttatgatgagcttcctcaactgcgacatgcatttcagccacacttagctgtggatcatccatgaagtcatttggggtcatgaccccaccagtggcaattactttaattgcctttgcacctttcttcaaggctgtgcgaacggcctttcgcatctcatctggcgagtcaaccacatacgccgcatttggcatatcaccatgaccgccagtcatagaaaaaaatttgcccgatggcatcatttcaggcacctgggttaactgaccttgatctcgcatcgcttttagcgcgatatcgatatcccaactactgccacattcacgaatgtatgtaaccccagattttaataagtcatgcagatgttcgacggctcctacggtagaggcaacaacgcctctgctggtaccaccatccccagttgtggggtcaagcgtgatgtgcgtatggacattggttaatcccggtgtcacgtactggcccccaagatcgaccatttcagttgcagatggtgcttggccagtgcctgtttgtgcaaccttgccgtcgtcatcgacagcaaaccaagcgtcttgaacgactttttcagaagtaccggtaaataaggaacaatgagtaaaaacagttgacatgatactgcctccattcttttctgcctattggctaatgcactaactttgatattgggctttaatattgcttgcgtttcacctagttcacactcggtcttgcatatgcgtttagtaactgaattaaataatcgaccccttgctggtaatcatgcaatcgaatgttttcattaggcgcatgcggacctgagccagcatagttcaccccaatcaagataaccggtaagttcagggcatcaacaaaatgtttggccggtccgcctcctggcatcattggcacaaaacgtacttgtccagtcccgtaaacttcttcagccacacttttagctaacttcagatgagggtcattcaaatcagagtgaaaggcatcttcgccaagattgtaatgtaaatgaacgtcagaataaccattcttatctaattgtgcctgaattaggcttgcaattcggcgaggatcttgccccgggagcaaccggcagtcaagcttcgccaatgcctcttttggaataattgttttaagtccttcgccttcgtaaccagctgataagccattgatcgtcagtgtcggcgccgtcactacagccctctttagatcggcacttgtaaacggtcgcttgagtccatacgttttacgaatcgcatctgcatcaaagtccatttcatcgattgctgcctgtgatgccatatctaatggctcgatatcatcataaaaaccatcgataagaatatgattttgttcgtccgtcaaagaggataatgctcgaactaaacgccaagcggcattgtcgatgtaggctgctaacgatgagtgaatatcagcatcggcggtcttaacatgaagatcaaatgaaacgatcccctttagtccagcaattacttgaaaatgatctgcctcattcttgccacccgtttcccaaatacatgcatcggctgtcagttcatcacggtgggctttgacatactcccctacatgtggactgcccacttcctcaccaccttcgacaaagaatttcatgttgaccggaaaaccgccatgatccttcatccagcgaagcgcggttagtcgatacatcagctctcccttgtcatcagctactcctcgcgcaaacagcttgccattcacaatcgtcggttcaaacggttcggtccgccattccgctaagggttccggtggctggacgtcataatggttatagaacaatatcgtctgatcagaattttccttgaattctgcaaagacaattgggttgcctccttgatcatgccattcttcaacggtttcagcgtctaggtccgaaaacgcctttttaacccagtccacggtcttgcgaatgcctttattttgggcggaaatagtcggaattcgtaaatagtcttctagggatggtaaataatccaacgcaaattgctcaattgcctcgtgctcagtcatgactcaacccccttgtgtgattaaatgctaatatagtgctcatttgtaaaagcgtcaacattattttgccattttagtcacatgataaagaatgaccgaatccttagtttaaaaaggattgatagcaagctgtataggtttaatgagaattttgtacaattatttgttgacagtcaagcaaataaggttaaagtaatctccatattataatctttttttaatttatttttgaatggaggatacatatgaatttcttaattgcgtttgctgttgtcatgatctttatgacactcggcgaatgggttgctaccgccaccaaagcctttattccttccgtgttcattacggcagttctattcgtcattgggttctggacagtcttgccaaaaaacgttgttgagaatgcctcgtttggtccaggattcattaccatctgcatcgcgcttttgttagttcacctcggaacgctaatgaatctgcgcgaactacttgcacagtggaaagctgtttgtattgccctgctcggcgtttgtggcaccttgctgttgacattaacggttgggacactcatctttgattggaaaacagtggtcgctgccgtcccgccgctaacaggcggacttatttctgccctactcatgtctaacggcctcaaagcgcaaggcttagcatcactagtagccttacctgtcgcgatgtttgttatccattctgttgttggttatccgctaacctcagttttgttgaagcaagaaagccgccgcttgctgagtcatttccgtgcaaatggcagcaaattggatccgaacgttcccaagatgcgccgtggagctgaagaagtgaaagacaatcgccctaagctgctgaacttgcctgaaaagtatcaaacgagtgcttttatcatggcccgcgtcgcaattgtcggtttgcttgcaatggggtttgggacattgacaaacaatgtcatcaattctaacgtggtttgtttgatcttcggggttatcgcgcatcaaatcggttttcttgaggacaatgctttgaacaaggctggcgtctttaactggttgatgtacggcttgctcgcctatgtctttggtcaactgagtgccaccacgccagctgtgcttggtggtattgtcctccaaatcattgtcctaattgccttgggcgttctgggcatgttcttagcatcgaggctacttgctaaaccattcggtatgtcttggcaaatggcattttcttgctcactgacagctctttttggcttcccagcggactacatcctgacttcggaagtggcgcgagcgatggcaacaaccgaagatgaagaggaatacttaacccaacaaatgatgccgaagatgctggttggcggatttgccacagtttccgtcgcctcagtcatcatcgccaccatcttcttaaaattgctctgataaattggcacagtatttacaccggtagcttgaaaaaatgacagtcattggtgacttctaagaaagcattcaaaagtctggtttattgatcatcaacgcacatgaaaagcgacagtcatctaatctatttcagatgatgactgtcgcttttgtcgttgtcattaaaatgctggttgtaaatgaatggccaaaacaccaaagcttgcttcctgccatactgtgtatagctgatacgtatctgcaaccattttcgtttcggaatccgttggtgcactgcctacctgcggaccacgatatttgtgatacaactcagcaaaactggtgaatttttccagtgcacttactgtcctgcgctgtgtttgtgccgttgtggtgtcttcaaacacaatcgtatcgccaacttttaattgttgccgtttttcatcattgagtctgatctcaatcgttttgctgccttgtttgactaacaaaaactgatcgtgagctaatcccattcgcatctgccggttgtgcccccttttcagctaatctcagtggctgttaatctaatgacgctttgtttgatgcaagtagttggttactgtctcggcaaacaaaactaacggtggatccagcagtagaacggaatagaaaaaggtcaccaacatcaccaatcaagcatttacacgatagtcgctatgctacttttcacattatatgactttcttgcgactatatgtcgtttatttgcttcaacaccaatgatgcaggtaaataaaaaagccgtacctgaatataggtgcagcttttttagtactatttcgtaaaccgattttcaaacaacggtgtcacggaacgattttcctgaatccgcatgatggcgcgacccatcagcggaccaactgaaaccacatccagtttatccatatgcttgtcagctggaagattaatggagtcagtcacaacaaccttttcaatagctgagtgggtcaagcgttcaactgccggaccagagaagatggcatgggtcgcggccacgagcacttcggtcgcaccggcatccttcaatgcttgagcagcgagcgtaatggtgcccgcagtgtcgatcatgtcatcaatgatgatacattgtttgccagtaacattaccaacaatattcatcacttccgcaacattcggacgcggacggcgcttgtcaatgatcgcaatcggtgccttcaagaattctgctagttttcgggcacgggtaacaccgccatggtcaggtgacacgacaacggtgtcggcaccatcgtagtgattccgtaagaagtaatctgccaacaatggggcgccgacaagatggtcaaccggaatatcgaaaaatccttgaatctgcgcggcatgcaggtccagcgccaaaacacgtgtggcgccggcacgttctaacatgttggcaacaagcttggctgtgatcggttcccgtgaacgggctttccgatcttgacgggcataaccgtaataaggcataaccacgttgatcgtatgcgcagaagcgcggcgcaaagcatcgatcataatcaacagttccatcaagttgtcgttaaccgggctggaagtggattggatgagataaacatcatccccacgaatactttcttcgatgttgatttgaatttcaccatcgctgaaccgcttaaccgacgactttcctagtttcacaccgacctcggcagcgattttctctgccaacggcttgttcgaattcaaagcaaaaatctttaatctcgggtcaccgtattgctcagacatatgttcctccacgaattgttatgggctgcgaaaaattgttccacagaaatcttagcggactgacgaaaaaaagcaagcacatgaatagaattataacctaattccaatctggatcttttgccagcggcaggcgtttccaaaaatcatctttgttggtttgtcgtgcgcgggcgatggccatcgcgtgaaacgggacatcttttgtgatcgttgaaccagcagcaataaagctatggtcagcaacatccactggcgccacaatattggaatttgaaccgataaaggcatgatcgccaatcttgctttcccacttctgaacgccatcatagttgacgaaaacaacgccgcaaccaacattaatatccgttcccagggtcgcattgccaacatacgttaaatgaccaactttggtgcgggcaccgatcttggcttttttaatttcgacaaaattgcctagatggacgtattcgccgatgtcagcatcaggccgcagatgcgaatttggaccaatgtcactatgagcgtgcatcacggcatgctcgatggttgaactagttactgtgacatcattttccagtgtggcatcgactagttcagagtgggcaccaatatggcaatcttcgccaatgactgttttccccttcaagtaaacaccgggttcaatcacggtatcggcaccgattttgacctcggtatcgatataagtcgttgctgggtcaattaaggtcacaccattgcgcatatgctgttcattaatgcgctgctgcatcaggcgggttgcccgcgccaatgcgacccgatcattgacgcccaatgattcggtataatctggcatctgataggcagccactttttcgccagcgtcgcgcaaaatacctagtacatctggcaaataatactcgccttgggcattattattattcacttgatgcaacgccttgaacagagcctggttgtcaaagacatagacgccggtattgatttcagaaatcaatgcttcttccggcgttgcatctttttgttctacattcttcacgacattgccgtctgagtcgcgaataatgcggccgtaaccggttggatcaggagcactggcagtcaaaatagtcgcctttgcgcctttggcttcgtgataagcaaataaatcattcaacgttttggcggtaaacaatggcgtatcaccactgataatgagggttgcgccttctttttgaccaagtaacggttcagcttgtaaaacggcatgtccagttcccaactgttcagattgcaaaacaaacttcgtgcgcttgcctagcgtttcttcaactgcttctgcgccatggccaacaattgttacaatggcatcgggatggatggcttccacctgactcaccacatgctcgaccatacttttgccacagaccggctgtaaaaccttgtaatactttgatttcatccgcgtccctttaccggccgcaagaataatggtgaatttttttgacatgtttatgctccaatcctaatattctgtcttcatgatagcccagccacgggaagctgacaacaagttggtggcttgtgtctgtggctgtccacaacaacagacccatgttgccacgggtctgttgttgactatgattggcttatgacttttgtatgtcatcgtcattggctgaatcctgcctagcaacaggatcttttggttgtgactggaaggtactaatttgggtggtatcggtccatgcatcgtaaaagaaacggtgatgacgcgaaatgatttcccatgcaaaattgatgagaaagagtagcgacaagaggccaaagaatcccagcgccgctaaattgatttcggttcgatggaaggcgccgaaatactcgccaaaaaagtaattcaatcccataaagctcggcaaagccagcccgtaaagcagactctcacgtaaaaagagacgccagaacccaatcggctggccatttgtccgaactattttgattcgtacaagactttttcccagtgtctgcccttgattaaatgctggccaaagaacaaagacaaagaatagcggcaggacataattgccgagaaaacctggtagctgatccagtcccagcaaatgcagcaggatttgaattaacacgccaataatcccactgaagagaaagaaatcaatgataaacgcagcaaatcggcgagccaaagtcacccgagcaccgcgcgcctgacttttcgcatcaatgatgtcccgtgacgtcaacgcgcgcatcagaattggtgcaaacacaccgcccaaaaagccgcctgtcgtattcaaaatcaggtcatcaacgtcaaagagtcgatacggacgcggataataaccgtagagtcctgacaattgcgtcagttcgaagaataaacttaagacaaaactcatcaaaataatctgcggcacgctgcgtttgaagtaatagcgcaagtaaaagccaaacggaatcgtcaaaacgacgttaaagaacggctgaatgaaagcggattgctttaacgctgccaaccaagtatgcggattggttggcacgaacacggttgtatgcacgaaataacgcaacgccatgaacggttccagattatatttaggcccggtgaactgcgcaactgctgctcgcgaaggcaacggcaaaataatcaaaaagtaggctgatagcagataaaagacgaacgagtagatcacgactgcacgccaccagctaaaggcaccgtaccgtcgataaacgacgaccagaaatggtaatgccaacaccagcgctaaaaacggaaacgtgatgatcgcagttctgaccggtccgagataagcactcattgaccagccacctcgagtagttgacgattctgatctagaaaattgccagctgtggcatgaagcgtattggctttagtgtccaccttgtcaacccgaatcaatgatgtatattcactgaccatccgatcaccgtcgaacttaccttcagcgaaaaccgtgataccgaccattttggcattgaattcatcaatcagggccttcatgccattgacggtgccgccgcctttcatgaagtcgtccacaatcagaactcttgagttagctggcaagctgcgtttactcagttccatcttttcaattcgcgcagatgaaccggacacatagttcacggacactgtggaaccttccgtaatcttggagtcacggcgcacaatcacaaacggcacattcagatactgactaacactttgcgcaattggaatacctttggttgcaaccgtcatgacagcatcgacatgggcctcgcgatattgggtggcaattaatcgcccaatttgccgtagcacactaggtgttcctaacagatcggaaagataaacgtagccgcctggcaataagcgatctgtctcggataaacgtttggacatagcggcaataaagttttccgcctcatcttctcccatgatcggaatatagcgcacaccgccagctgcgcctggcaccgtttcaagaatgcccgtctgtcgctgggcaaatgttcgccggacaatagccagatcttcactgatagaagacttcgcactctcataccgttttgagaaaaaagtcagtggaatcaaggtatgcggtcgttctaataaataccgggtcatatcaattaaccggtcacttcgtcttactttcatcatttcgctcctaacaccgaatatttagcactacactaacattgcgtgataatctcaacaagtataaacgctttaaccgaaaatttcgacccttttgcgttgttttttcaacgaacgttcgcatttgctcatcttgtgtttctttttaacggaaaaattgctacgtctgattggcttcttacgccattctatattagaatgattataaagaggaaaaatgaggagggcaaaccatgaattgttttgaactgagtcatgtgacgtttgcgccggaaaaaaatgcgatcctgcatgacatcaatctgacgattccgtggggtgcagatcttaccattgccggtcattcgggttcaggaaaaagcaccttgcttcgtctgctggcgacgctgctaacaccaacgagcggaaccattcgctataatggcaaaccgcaggacgattatgatccgatcagttatcgccgcgaagtttcttattgtgcgcagcagcccgcgttgtttcatggcaccgttgctgatgatctgcagtttccattcaccattcgtcatcaaaaaatgccccgtgaagaagccgagcgtgctttagaaagcgttgatttagccaaaaccatgctcgacgatccggtcaaaaacctttccggcggcgaacgtcagcgagtggcgttgttgcggcatcttttctttccgccaaaagtgctgttacttgacgaagtgactgctgggttagatcctgacaccaaaacggtcattcatgccttattacaaaaacaaaatgaccaaggcatcaccttgatccgcgtcactcatgatgaaggcgagattcaggccgcgaaacaattgctgcggctagttgccggacaattcgaggaggccgctcatgagtaatcagctcattgtgtcacccatcaccttattgctagcacttatcttggtcttgattgcactagcgatcaacctaaaagaagatctcggcatgaccaaagatttgattatcggcgttgtgcgggctgtcatccagttgactgttgttggtttcgtcctgacctacatcatcaaagccgatactgtctggctgacgttggccatgattgcggtcatcatttttaacgccgcttggaacgctaaaaaacgcgccgggacaattccaaatgcgctcgtgacgagtttgttggcgatcacaaccgcgactgggttaaccctggtgatgctggtcgcggtcaaagccatccgttttgtcccatcacaaatcgtcccaatttgcggcatgatcgccagcaacgttatggtggcaattggcttggcttatcgcagtttgaatacagaattcaatgatttacggcaacaggtccttgaacgtttggcactcggcgctgatctcaagcaagccagtcaatcgctcattgtcaatgcaattaaaactgggatggcgccgacgattgattcagcaaaaacggtagggttggtcagcttgccggggatgatgtcggggttgattttcgcgggtattgatcccaccaaagccatcatgtatcagatcatggtcacctttatgttactgggcgccaccagtatcggtagctttattgccgtttaccgcagctatccacgcttttacaatgcccgtaaacaactgcgctaaaaaaataatcgtagaatgaatcatttgacaaccacataaaaaacgttgtgctcgcattggccatgcggacacaacgttttttaaattgcttgattaataagggttctccatcttattttgcggctcgtatggaccatactcaacctgaatcgtcgtgtgcgcaatatcaaaactttcgcgcaaagataggctgagcgcatcaaggaagtcgtcattgccaactgtggtcgtgcgcacgacatggacggtcagcgccacatcggtcgtgctcaatgcccaaatatgcaagtcgtggcaagaagcaacggttgggtaagcattcacgagctttttaaccgccactgggtcaatatcttttggcactgctgccatggcaaggttgaccgcatcgcgcagcaaattccaggtgccaaccaaaacgacaatggcaactaagatcgacatcacgggatcaagccattcccagccagtcagcaaaatcagtccgccggcaagaacaacgccaagcgaaacgccagcatcggcggccatatgcatgaaagcgccgcgaatattcaagtcatgttgcgaaccgccatggaatagcaaggcggtggcgccgttgacaataatcccaacgcccgccaccagcatcatccagccgccttcaacaggtgcattttgtgagagtcgggtgaccgcctcaacaatgatggcacccatagccactaataagaacgcggcattagccaaagctgccaaaatcgaagaactcttataaccataagtccgttcgacagtgggatgccgtcctgacagccaatctgcgaaccacgctaatccgagtcccaacacatcgcctaagttgtgaaccgcatctgcgaccaaggccaccgatccaatgccgatgccaaaggctacttcagcaataatataaattgtattcagtaaaatgccccagaagaatgccttgtttggttgaacttgttccatgacaactgcccctccattttcctatccccatcatggtttagcgttacctaaaaatcaacccctaaaccgtggacccgtggcggataagcaaaatggccgtaataggtaaacttcgcggcaaaagcccttcatgctgttataaacccgcatggctctggagtgcttttggcacagaccaaaaacagttgggccgctgcctgacatttgcgcgaattcggcaccatacttttgtagccgctgcttgagggcggacatttccggataccgactagcagtgatggcttcaaggctattcgccatgccactcgtcatttgtgcaaagtcatgattttgaatgcctgccaccaccgtttgcgtatcaggatggcgcagaccggcgtcataatcaatggcattcaaaatggtcggcgtcgatactgaaacgcgaggctttgccaacacgacccaaaaattcggcaagctgccaagtggggtgaccacatcaccacgaccagttacgagcgccgtctctgaataaacacagtaagggacatcactatcaacacttaagccgatccgtgctaattgcgaccgactatagccgagttgccaaagcgaattcaaccctcgcaaaacggcagctgcatcacttgagccgccgccaagccccgcggcgaccggaatatgtttttcaatatgaatccgcgcaccttgacggatattggcgtgacgctgcagcgccaacgctgctttgtaggccagattgcgcggatcttcaggtaggaagccgctatctgtcgaaacctgaatgctgcgatgcgggctaatcatcacatagtcagctaaatcgaccgatgtcatgaccatctgccactcatgttcgccgtcgtcatggcgatacaaggcatccaagctgagattaatcttggccggtgctttttcgatcagttccatccaaccaccagtctctggcgacccatacgcttgccggtcaatcactatcaccgcaagccccgttgtatgcatcgaccgtatagttatttttagtatactgttttatgcgctgattttcaccgatacacggtaaaaatcgcgtaacgatgcgtgacttgctgtttccgtatccgaaatgaaaaacagcaaaagacctcgatgcaactcacatcgaggtcttcttataacagatttaattgttaaaacaattcaatgttatgaggctttttcttcgccttcgaaggtgatctgaattgacttagtcaagagatccgcgtaactgtaggagacgcgctcgaacgcattttcatcttggtcgagatcgaccacaaaaatagccggataggtttctttcaaagtcccccgtcgccgcgtcactttcttgcgtccagcttgtgcaacgaccgttaagttctcaccgatttttccatcgagcttccgtttgatgcttgctagtgtgattggcatgcacttcacctcttgcagtctatcatagcacgaaagcaagaaatttgcaattataccacgcgtttcttatttcggcaagcgatttatgctggtgtttttagtaaaaatttatcgtgcttaagcgtgagcctgactgattaaatccgccgctcgcaaagcacgatctaaccgagcaaaatcagcaattgaaagccgctctgcgcgggtaccagggtcgatggcggcggttgttaaagcagatcgaatggcagccttgttagttttgccaaataagaccacaagattattccagagtgtttttcgccgtgaagcaaaagcgccgcgaactagccgatcaaaactggctggatcggttaaagcagcaagcggttcggtgcgctgcgtcaaggtgacaatggctgaatcgacattgggtgccggtacgaaggcatggcggcttactgtgaaagcagttgccacgctcgcaacgagttgaactgcaatactcaggctaccatattcttttgaccccggcgttgcgcttaatcgttctgccacttctctttgcatcataaccgtcatgctatgaagtggtagctgtgcgcgtaaaagatggagcaaaatgggtgtggtgatgtaatacggcagattggcaacaacctttaaggtgtgcttgccatcaaaatgctcggcaaccaatgcgcctaggtcggtttttaaaacatcctcatttacgaccgtcgcattaggataatcggccaatgtttcatccagaatcggcagcaaccgatcatcaatttcaagtgccaccacctgatgcgcgctgtccgctaagaattgggtcagagcgccaatccctgggccgatttcgatcacatcatcctcaggggtcaaatcggcggctgtcacaattttttgcaaaatcttggagtcggtcaaaaaattctgacctaagcctttgcgcatatggaaaccatggcgctttaaaatagcgttggtgaccgctggctgcgcaactttttcaggttttgtcatgctgtcctccatctacttgggccacggcagccaaaaaagctgcgcggctaatttgaaactctgcgagtcgtcgaagcaactgtttgccgtttgtgtagccaatatgcaacaactcgcctaactgttcccgacgttggcgggcaccgacaccaccaactaaatcagcagcgagcaaatcttgctgactaatcacttgcggtgcatctggcatgtctgtaaaaagatgctgcaaagctgcgcgcaacgcggcaggcttggcatgttcgatgcccaacgagcctttatgatccggcacaccttcacgacgcggcaagaaagcatgcgtcacccctggaaccgcgcgggaaatagttctgcggattttctcacctgggaaatcagggtcggtcagcacaatcacaccgcgtgtagcctgtgcttgccgaatgcgttcgagcgttgcctcgtcaattgcactgccgcgggtttcaatggtgtcaatggcaccaaaagtttctttcaatcttttcgtatcatcgcggccttcaacgaccacgacttgtttgatagttgtcatgctttttcctttaatccaaagatgcgatgggcattgtcccatgtttgcttggcaatcacttccggcgttgtttcacgtaatttcgccaaggcctccaccacataccgcgtgtagcccggttgattctgccggccacgatagggtatcggcgtgagataaggcgcatccgtttccactaacagtcgatcattgggcacaattttggcactggcatgttcttccggtgcatttttaaagctgacaatgccagagtatgaaatgtataagcccagatccagaaaacgttggccccaagttgcatcgccggtgaagctatgcatgatcgcgccgaagtcttcaacatgagccttttttaagatgtcataggtatcgtcaaaggcatcgcgactgtgaattgacaccggtattttcaacgaacgtgcaatctcaagttgccgacgaaaaacccgtcgctgaatttcccgtggtgaggtatcccagtgataatctaagccgatttcgcctaaggctacaactttagaatccgccagttgcttgattaacaacgcctctttggccgcgtcataatccttgctagactcgggatgccaaccaacaatggcatataaattgtcatactggtgggccaacgccaatgcgccggcattcaaagctgtgtcagagccgacaatcgccatcttcttgacaccaagttgccgagcgttttcgatatactcggcttctttgccttgatagggcgtgtcattcaaatgggtgtgtgaatcaaaaatatccatgcgatctcaactttcttttatgcttctgtcataagcggtgtcagcaaccgtgcaacttgaacggcttttttggcagcaaatagtcgcttcagttgcgcagctggcgattgcgttaaagcgcgaatcaactgtgccatgcgttccggttgtttctgcggctcagcattcatgagcatgaacacccagttcactggtaaaatccgactagcatcggctaaatctttgaaggcgaccggaatagcaaaatgaacaaccaccaaccgcgtttgtttcactaattcgccttccaaatgcggaatggcaatattcggcaagccatctgccacttcatttagttgcatgccagaaggaaatgtctgctcacgtgtgatcaacgcttctttcccagccggcgccataatttgctggtcaacaagtgttgtgctaatcgttttaaaaaaagctgcttgcgtgggtgtattcagaaaatagaccagctctggcgtgatcaaatcagtcatgcatttcacctatctttacaaattctcaatatgtttagagtatagcacgcagtttgcctaggctcatcgtcgggtgatcatttcaagaaaccatttattatccgcgctttttctttgattttcatgaaaatgctccgcgaaaaatgtctattacttctattttgttctatactatggaggtactgaacatttaaggattacctaggaggtatttttacatgtctgttaaacttactgctggtcagttgaagcacttgaagcaattgtcaaacgatgacaatgtgatctcagctttggccattgaccaacgcggttccctgaagaagatgcttgcagctgcagctaacaagccggctgatgaaaccacgattgttgatttcaagaaggcagtctctgaagaattaaccaaatacgccagcgctattctgcttgacccagaatatggcttgccggctgctaaggttcgcgatcctaagtctggcctactcctttcatatgaaaagactggttacgatgctaccgaacctggccgtttcccagatctgatcgacaaccaaagtgctttgcgcattaagaacgaaggcggcgacgctgttaagttcttgctctacattgatccggatgaatcagacgctatcaatgatcgcaagtatgctttcgttgaacgtgttggtgctgaagcaaaggctaatgacctgccactgttccttgaattggtttcttacgatggtaagaccaacgaaactggtacagctgcatgggctaaagctaagcctgaaaaggtcatcaagatcaccaaggaattcagcaagccgcaatacaatgtttctgttttgaagcttgaagttccagttgatcaaaagtttgttgaaggctacaccgatgacggcgttacccctgtttacagcaaggaagaagccgctaagtattacaaggaacagtcagatgcaacggatctcccattcatcttcctgtccgctggtgtcaccaacgaattgttccttgaagaactcaagtttgctaagcaagcaggttcagcctttaatggtgttctctgtggccgtgcaacttggaagccgggtgttaagccatatgctgctgaaggcgaagctgctggtaagaagtggctgcagaccgaaggcaaggctaacatcgatcgtttgaacaaggtgcttgcagaaactgcaaccccttggactgacaaagttgaaggttaatctttaaccatagttgcaagaaaggaccgatcatgatgatcggttctttttttatgactgcggacatgtttttgtgaccactgcaaacatcaaaatgaagttcaaaaaacttgctaacaatcattgcaggtcagtgatccagtggtagactggtattgaatacgttttcgtctatttggaggtaattcaacttgatcacaattgaaaacagcaaatttaaagcaggcattgccgagcgcggtgctgaattgcagtcgctggtaaataaagccgacaactatgagtatgtctggacaggtgacaaaactttttggaatcggcatgcgcctattctgttcccatctatcgggaagtctaatcaggatcaatatcggttaggcgcaaaaacctatccaatgagtcagcatggatttgctcgtgactatgactttgatgtcagcgataagagcgactcagcggtcaccttcacgcaacatcaaaatgctgagacattgaagaagttcccgtttgagtataccttggctgtcacttacatgttgacggacggcggcctcagcgtacattacacggtcacaaatgacgattctaaatcaatgccatttgctttagggttccaccctgcctttaatgtcggcttgaaagctgatggcagtttcgacgattacgacctcactgttgaaccattaaacagcccactacaacgattcggcatcggccctgtgccattccgcaatggcgatgttgaggacatccccggcgcagaaggcaatcgtttgcccctgacacatgatcttcttgacggtggtctcgtgattctcgctaacagcgaaattgccaaggcaaccctcgcatcaccgcaccatgaccacagcatcaccctcgatatcagcgactttccatatctcaccatttggagcccagaacataaaaaggcacctttcatcgccgttgagccattcgatggtctgccagatcaagctggcgaaccaaccgactggtacaccaagctcggcaacaccacgctatctgctggtgccaacaagcaattggccttgaaggttgagcttcactaatcgaagtttaccacccaatcgtccgacacaattcgggcgatttttttgtgagcgcggggcagctcggtagcaaccgaagtgtcagcagtcaaaaaaagctgactcaccctgactagctttctggaaaagcgaccaaatgattggtacagttgcagtacaatgaactaaattcagaaaaggagacctctatccatgcacattgccatcattgacgatcaggcagccacgcgacaagcaacaactcaattgcttagccaactgaccacgcccacgcagcctttacaagtgacggcttatccaactgcagaggcctttctttttgctgatcagccggctgatctgttgttgcttgatatcaagttaggttcaggcatggatgggatgacgcttgcaaagcagattcgggagcacgatgcggcgacggcgattgcgtttgtcagtaactatgatgaattcgtttttgacggttatgatgtcaacgcgctcgattatgtcatcaaaccgattacaagtgacaagctgcagcatctcatcagcaaagtcgccgcgcaaacgcaaccaaagctgttggtcttcaccaccgccaacggcattcagcgtgtcgccatgtatgatatcagtgccatcgaagtaaccgatcatcgcttgcaggtgcacacccagaaaatgacgtacacggtcgctggtcaactaaaagagtttcttcctcaactcgacgaaaatttcattcaaatctatcgatcaattgtcatcaacctcaattttttgtcgcaacttgagaaaaacaccgtcgtcatggctgatggcaccagttacccggtttctcggcaacaagcaccgctcgtcaaacaagccttctttaaacattttcgggggttagctcatgacagtgaatgaatggtggtggctagccacattcggcctgttgacagttggctgttgcctgcttctatggtggaccttccgccgacaacaaaattggcctgtgcgcggtttgaatctggctgtcacattgctggccttgggcggttggtggctttggccgctgccaagtgtgcggtttgtgcttttctgcagcaccgttttgaccggcaccttggagtttgtcttaatgcgtcaattcctcaacgatcaggacgccgtattcgcccgcagcctcgataaaatgatggcccaatattcgcaagaagtacaggaactttatgccaatatgcgcggatggcgccatgattaccatgatcatttgcaggcgctcaaagcttacttagataatcaggatacgcaggcagcccgcgcctatctcgacgaactagaagacaagctggacgaagttgatccgctcgttcactctggcaatgccatgttggacgctatcgtcaatgctaagctgacattggccgaacggttgcacatccccgtcaatgaaaaagtgattgtcggcagcacaccgttaattaaagatgtcgatttggttgtcatcttgggaaacctgttagacaacgccattgaagcaatcagtgagcaaccggctagtgagccgcgccaactgcggctgtacatcggcatcgtcaagcaacagttttacatatccgttaccaacacccggcctgccgatcaagaaatcgattatcagtacgcctcaaccaaaagtgacaaacgcggcctcggtatccggcgcgtcaacaaactcgtggccaagtataatggcatgatcaatcgccaatatgaagcctccattttcgtcaccgaaattgccattcccattcacgccgttaaatcgaccactcacgcataatctgccgcgagtggccgattttttgctaaattaagatcaacgaggtgatcgacatgaaaaaatacgggttgttcaacaacttaaggtggtacttaacttacttgcgaaaagatgaaccgtcacttgcttggaccgcaaccggtctcgccattgataaagcggctgcagccttgctgggagttttcactccagcattgttggtcggtgccattgtgcagcatgcgacattgggggaatttgcttggttagctggtttaaccggcttgggattagccattaccagtgaagttgattatcttttaatgacccacgataacgttaaaagcaccaaattacgtaccgtcattgaaatggactttcatcagaaacaatgggatctggattatgaccaaatcagcagcggcaaagttcaagggttggcgcacaccgctttcagtaaagggttgagttggacatatgctggtgcagaggctatttatatttatggccgtggctccttaattgatatcgcgaccttgttagtattccttgcaactttgtcgaccgtcattccgtgggtgtttgcattggttcttctcagcgctgccatcagttatgccgggctgagctggtaccgcaagtggtatcaaacaaacaacgtcaattggaataagctcagccgccagcaagcttatatctcccgcaatgcctatgcgcttgaaaacggtaaggatattcggatgtttgggatggccggttggtatcacacccatcttgatcgactcctttcacttcaagatgcttggcaatgccgcaactcattgcggcatttcttagggacacaggttggcgaacttgccggattatgccgcgatgccttggtctacgggagtttggttattgctgtcacccaaggcagcctatccattgctcaatttactttgatgtttggcatgaccagtggcttcattaccttacttgaccaattactgaaagatttcagtggtctgcaaactgctagtatcgatctgcaagaacttcgcgaattcatgacgcttaagccgcgaacaccggctcgcccgctcaccacttccgaacaaacacaactagcgcagcgaccggtcaccattcattttgaccaagtaaccttccgctatcccgaagctaaaaccgcgagtctcaaggatgtcagctttacgttagaagccggccaaaagcttgccatcgtcggcgtcaatggcgcaggtaaatcaactctcgctcgtttgatgatgggcttgttacacccaacaagcggcaccattctgatcaacggcttaaacgccgatctattaccactagcaactcgtttttcattgttcgcccccgtctttcaggaaaccatcgttctagcattgagcctcgctgacaacgtggcattgacgaatccgccgcaacatcaacgagtcgagtccgcattaaaagacgcgggcttagccgattttgttgcgacgttgccacaaaaagctcacacacctatgacccggtacactcgcgatgatggcatcgaactttcaggcggtcagtcccagaaacttatgttagcgcgcgcactgtataaagatgctcctgtcttggtgttagacgaaccaacagcggctttagatgccatcgccgaaaacgaggtttaccaagagtatgctcaattagcctcggggaaaacttctctgttcatctcgcatcgactcgcctcaacccgtttctgtgacaccattctcttcatggatcacggtcaagtgcttgaatcagggacgcatgaccaattgatcgcaaacaatggtcgttatgcgcaaatgtatcatattcaaagtaaatactatcaacctgaagcaaaggaggttccagccaatgacaacctttaaagacgccgaaaaaaagaagccggcaagtaatacggtagtccgagctttacgtgtggttcgggtcatttatgaactcgactcagccgctctgccagttgaatttatgcgtgccctcacaaccgtgggaatcccttatctcaacattgcctttcttgggctcgtgttgaatcagctacagcaacgggcatcattacaacaagtcatgctattaatcggtatctttttggccgttcgttttttgctacaattgtgcggcggctggtttaacaagcgcgccgaggatcatgaaactgcagttaaacgacggctcgatcgcgctgtgaccgaaaagctattaactgttagctacagcacgctccaagatccagacatgcgcaaggcatatgctggagctcaggctgggcaatccttcagtggtggcttatcgacacttatgaaagaagggttgcaggacttcttttcgcttataatcgctgttggttttgggattgcgacacttgttagcctcatgaaaccaatggcagcctccagtgcgtggctcaatgatgatcgttatcccttgatgattttggctttgttgatcttaccaattgtcgttggcagttggagcattaaacacagtaatcgcattcaacaaggggttattcaaaaaatcattccaagtaatcgaaggttcacctattttttcaatttcactgaaaatatggacaatcatcaggttgtccgcctttaccgtgcaagtgacctcattatgcatcgagaaacaaacagcaccatggcatcacttcaacaaatttgggatggcgactggcaaatggccaaatacggtcactggccaaatctcgctatcgccgttgctgtcatcggtctctatatcttagtcggtgccaaagccctcctcggtagccttgcaatcggcagcgtcatgatcgcagttgggtattttcaacaacttatgaccgcggcctaccaatttcttcagcaagttggcatgtatgtgaatatggttgactacctccaattctatgtcgattttctggccctgcctgatcacgaaaagtccggctcgctgcctgtcgagaagcgcaacgacaacgaatttgccatccagtttcatgatgtgagctttaaatacccaggcagcgatgagtgggcgctgcggcacgtcaatctcacgctgaatattggcgaacgccttgccttggtcggccgaaacggcagtggtaaaacgaccctcatcaaactgcttgtgcgcctgttcaaaccaactgaaggcatgatcacccttaacgatatcgacattcaaaaatacgatgaagacgaatatcgcagcctactgggggttgtttttcaggattttcggcttttcgcttatagcatcgcggaaaatgttgcggcaacgacccagcctgatcgtgaccgcatttggcaagcactaactgttgcggatgtggccgatcgggttaagcgaatgcctgaaacaatcgataccccaattacgactgcgttaagtgacgatggtgtggatgtctctggcggcgaagcccaaaaaatcgccatcgcccgcgcgtggtacaaaaacgcgccgatcatgattctggatgaaccaaccgccgctcttgatcccatctccgagtatgaaatttatcaacggtttgacgagctcattgaagggaaaactgccatctatgtgtcacatcgcatgagctcaacccgtttttcccaacggattgtggtgcttgaccatgggcaactcgtccaagatggtacgcatgccagtctcatggctaaatccggcatttatcgcgatttattcaatgcgcaagcgcaatactatacagaggacagaataaaagctgcacgtaaaaaagtggccacatccgttgcacctgtggcgaattaacaaaaacgttttgggttgacttaccacgaataaactttaccaactgttgcgacattatctctgaccatcaaaaaacactcgaccacaactagtcgagtgtttttcattgcccttcaattaaccaaccaagctgccattctctaagttctcagagacttccagcaaagtgattttcttgccgtctaaactttcagccgacaacaacatgccttcagacatttcgccttttagcttgcgcggcttcaagttgaccacggccataacctttttgcctttcagcttctcatattctgggtaaaattcacgaataccggaaagaatttgccgtgtgccttcatcgcctgcatcgagcgtgaacttcaacaacttatcagcgcctttaaccggttcgacattcaaaatttctgcgacccgaatttcgctcttatcgaattgtttgaactcgatttctgacttccgagttttttcgtcgacggttgcttttgcggtgccgggggtcatcttgctcttgatatatgccacttcttcttccgtatcaagacgcgggaagattggcgtgccttgttcaactactttgacaccagctggcaaagcgccccattggacaagcttgtgatcgtcattttcatgatccaagccaagttggccgaagatttgcaatggtgcatgggtcatcactggttgaatcagtagagcaatcagacgcaggctttcggctaagtgagccatcacagcatcaagctgatcttttttggcaggatctttggccagattccacggttccgtttcgtcaatatacttgttcgcccgggaaacaattttccagacttgatccaaagcatcggagaaacgcaactcgtccatcaatttgtgatattgcgccaaagccgcctgcgccacatcgccaagatcttgatcaaacggcgttacatccggtttaaaggctggcaaaataccgtcttcatacttgttaatcatggcaatggtccgattcaacagattgccgaggtcattggccaagtcgtaattgattcggtcaataaagtcttctggtgtgaaaataccatcattaccaaacggaatggcgcgcatcaagtaataccgcaaggcatccaagccataccgttcaacaatcatgtccggataaatggcattgcctttcgacttactcattttgccatctttcatgactagccagccatgggcgtatattttctttggcaacggcaagccgagtgccattaaaataattggccaatagataatgtggaaacgaacaatctccttaccaatcaattggacgttggctggccagtatttgtcaaacaaagcgtgatcattactgccatagcctagggcggtaatatagttcagcaacgcatcaacccacacgtaaacaacgtgcttcggatcggatggaatctggacaccccaattgaagctcgtccggctcatcgccagatcttccagacccggtttgataaagttattgatcatttcagttttgcgtgaagccggttgaacaaaatccggatgctcgtcataatacttcaacaagcgatcggtgtacttgctcatcttgaagaagtagcttggttcgtgaaccagctgcacttcatgaccagacggcgctttcccgccggtcacgttgccgtcttgatcgcgataaacttccgacagttgagattccgtgaagtattcctcgtcttcaacggagtaccagccagtgtattcgcctaaatagacgtccccttgtttgatgagacgttccacaatcgtttgaacggcttcgacatgttccttgtcagtggtccggataaacttgtcattggtgatttcaagcattttccaaagttgcttgatttgggtcgccatgccatcaacataagcttgtggcgtcacccctaacttatcagccttttgctcgattttcaggccatgttcgtcggtcccagttaggaagaaaacgtcgtagcccatgagccgcttataccgtgcgagcacgtctgctgcaatggtggtgtaggcgttgccgatatgtagtttgccagatgggtaataaattggtgttgttacgtaaaaagttggtttgcttgccatgcaagggcctcccgtacattagttcagaatgagtctagtatagcataggaaacagcggggctgtatagttgcccacagctaatcatttgctgctaaccagtgatccaaaacactgataaattcatcatgttggtcaagcagcgccaaatgccgactgttggcgaagagatgccatttggcgttaggaatatgatcgacaactgttttcgcaataagcggcgtgcagaggtcatcagtcccattggtcaccaaaaccggaacgtgaatgtttttgagctgatcggttacatcgaagtcgctaatcgtcccattttcagtaaattcattggggccttcagcaattaaactggcgcgtttgccgttagttggccggcgtagcggttcaggtgagttttcgtctggatcatcccagcagtacttttccatgtagcgatcattggccgccagatatttcacattcgtaaagtcgccagttcgttctgcttctgcgatggcttcgcgatcttcataactcaggtatttgatcaggcgatgttgttcctgaatccacaacttaatagatgacggcgagccgtcaatcatcacactcttgataccttgaggatcgaagctggttaaataatacatttccagcataccgccccatgattgaccaagcatgtgaagctcatcgaggtgcaggtactttcgtaaggcgatcaactcttctgcccaagtttctttaacataaaccgccggatcttctggcagtgacgacttcccgcagccgacttggtcgtacataatcagttgccggccggtttcggcatagtcgtccatgagttcaaaataattatgcgacgaccccggtccgccgtgaatcagtaacaacggcgccttatcagcactaggttcgccaacgattcggtaataagttttatattcatgaaacggcatgtagccttcttggattttcatagatgcaccagtctccttcttaaaaatgatgatccttaccgcgattgtactacgcattgatcatggtgtcagaaagaatcgaagcgcgatcgccaacccggtttctggatcggtggtcgcgcttcgaagatgatatgtttgctctcaatgctaacttagcgctgtgctgttatccgagccggcctctttgatcccaacttaatcagcatcaaaacagatctaattgtcgtggggcaagacccggaaagtccagacccaacaaatcgatcaaactttgcgcattggctgcagcatcgtgaccaccattattgttgaagatgacagtaacatttttacttttcaaatgctgcgcgatcatgccaaactgctgcagttcttcttggctgtaacgataattggttctttcagtcgttttggcgccggttcgaccccatgccggatttcggccatgcaagcgcatcatggttaaatcggcattcgtggcaattggcacaagcggcactgagccgctggtcgtctgcgcttcatcaacgatcacgtgaatgtcgccggctgcttgcaacagcgccatcgtgttggcacgataagccggcaaataccagctaggatgacgaaattcaatggcaacaggtaaatccggcagtaaacgatttagttgctgcaagtagcgtacattttctgcggtcacgccaaaatatggcggaaattggcacagcaccgcctgcaactgatggcttgcaaccagcggtgccaccatatcattaaatttggaaaagtcagcgactgtgtctgcactttcttcgtgtttcgtcatggttcgcgtcgctttaattatgaactgaaacccagatggcacttgggcctgccagtggcgaacctgttccacagacttcaatccatagaacgtcgtgtccaactccagtacaggaaaatgctgagcgtaatccgaaaacgtactccgattgccgcgcgtcgctaattctggatgatcggctacactcgtcaaaccaacattaatcatcaatttcaccatccgcgatgcgaaaatcttctaaccgatcgccggtaaaataagatgcataatcatggcgttcgccattcagcgcgaagtgcaacagtggctgtaaatctggtaccaagccgggattatccgctaacaaccaatcttttgaaaaagtcgctaaaatgccctcccgggtggctcgcggcatcaccagctcgtcttccgtgtggccaaagaaggcaaaaagttcggcccgcaactcaccatcaacatgccagaacacacgcccgccattgatcagatcatgcgggggaataataatgtgactttcttcctgcaattcacgtgaggcgcaagtagctgggttttcattaggcaggaatttcccacccaatgcattccacatgccacgatatggtggattcgtccgattaattagcaaccagccgcttggggtttcgacagtgactaaggtatattttttgaccatgtttgctcctttgctttgggatcatcactagcaaaaaggcgccgaaatggcgtctcttttgaatctttgctgacaggccttttttgcggggatgcgtcaaaccgcccagattagctgaccgtgaaagagcgctcgtaaaaggacctacttcattttttcaaaggtatccttaatgataccggcagagtgaacatacttagcacgctcttcatctgtcaacttcaacgttggcgtcttgataacaccttgtttaccgatcatggctggatgaccgatagcaataccgaattctggatcgtaattagcgcatgggaagatgcgatgtgcatcgctgatgatcgcctgtgtcatttcagtcgcgatggtggcgataccgtagctcgtataatgcttagcctgataaatcttccaaccgcctgcccgcgcatcatcggcaagctggtcgtaatcaaccttcgcatattcagcaatcggttcattattgacccgtactgttgaccaagcggtaaattgcgattcgccatgttcgcccatattgtaaccacgcacgtcagcaacattcacatgcaaggtatcggcaaccgcccgtcgcatccgataagtatccagcgaagtcccagtcccaataatttgagacttcggtaaatctaggagatattgccagtaactcgtgacagcatcacatggattggtgatatctagcaaaacgccatggaagccagacgccttcagttttggagcgacgtcatctagtgctacttttgaagtcttggtttctccaattcgatcaccatttgaaatggcgccaatattgccgaccgcggaaataaccacatcagcatctttcaaagcatcataatcgttgacaacaatgtcagtataagtgggcaagccgccaagcgcatccttcaagtcaaagctttcgccttcagcaagttcagcctttttatcaatcaagactaacttgtcagcaacccctttgctgacaagattaaaagccgtggtcacacctacgtgtccaataccaataataccaattgttcttgccatataaaaaatctccttttcaaaatgcgttcattggcgtgatttcttttttgaatcagccatcaagtgacgttcaatgcgctgatccggaatcgcccatagcagcaacatcaataagtctagtatgatcgtcaacggcggccaaagcaaagccaataacatcgcaacaagtgcaatcgcgacggaggccgctgctttccagttgtgccgctgacgatataagtctgctaatgccgatgttggtccattgacgcgaatcagggtttgtactaatagcacatagctgatattggccatcaagatcacaaacccataggccaattcagggccaaatgtccctacgtgtccttcgcctacccagctagtggcgaatggaaacattgacacaaccagcatgaagaaagagttcgcccacatcacccgccaatcgattcgttcgaccagttgaaacaagtgatgatgattattccagtaaacaatgagtgtcaaaaacgacactagataaatggcaaaaacaccgcgtagttgccataacgaagccaatgatccgctgtgcggcggttgcaattctaacaccagaatcgtcaggataatggcgataaccgcatctgtaaacgcctcaagccgccctttattcatggcaatatcccctcacaaagttatttttggaagcttcgccttcacttacagaatttcccagatgatgagcaaaagctaagttgtgattgcttcagactaccagcttcgcaaatacgtccaccgcatccccctgcaccatatgcgcgccttccggcaatgcgatcttttcacggttcacagcgacaatggtcgcctctggttgcgcatagccaatcaaccccgcaaatggataaaccacgaagcttgttcccaccacgatcagcaaatctgcagttgaaatggcttcgatcgccgcactgacggtatcgggattgattggctcaccatacaacacaatatctggtcgcaaaataccaccgtcagctgcatgaatatcacttttcagataggtctcgtagtcaaaatgcttgtgacaagtttgacaataaatgcgataaaggttgccatgaaattcaacaacatgctctgcaccggccttacgaccgaggccgtcaacattctgcgtaacaatcgtacctttttgattggtgatggttgccattttctcgtgaataacgttcggtttagccgctggaaagtacatattattgacaacaaacttatgaaaatcttcatgatgtgcttgtaaattatcaatagacagtgcatattccggatcgacttgatcggcgtatagtccgcccttggaacgataatccggaattcctgatgctgttgagacccctgccccagtcatgaatgtcacatgcttcgcctgctgaattgcagtttgcagatcaaacatatatggtccctccttaaacgcgatcaccggctcagaaacctgcacataaagacctcaagcctaaaaggccgcttatgctccggtttctaaacgcgttcgttcacgcgctcatcttttagcagatatttttcaatgatgaaaatacgcaatcaaaccgtcaatccttagcatgacgcatctttaatatttcaagttgcgtttgaatggttcacatgcgctattaatttaaatcaaaaaaggtgtaacataacagtagaaatactttcagaaaggagtcttgatcatgaagtcatttcggtggtcacacgttattagttatctgatcatggtcatcgtccttgttttctttgccttcgtcctttatcaggtcatcatgctcggtgttcattccgtttccaatagtttcttcatcaactttggccggcattaacgaatcgtgtagtcgagccgatactgcgtcagaatgtcattcagcgattgttgatacaactgctgaaaggcttctggcgttgtttctttttgtggcaagggcagtacaaacgcattttgctcatcgctgcgtcccatggcaacatatgcgggttccttggtctcgcgatcacggtagccactgtgtttgatcatgaaaacctgatccaaggtaaggcgtaattgccgatgcgacagaacaggcgtcaacgttgcaaattcagcatcgttggtcggttgatagcctagccgttcaatcacggtatcaaatcgcgccagcaggtgaacaacggcgcgtcgtaatccaaatggggaatcaagcttctgcgcatccggcaagtcgtaaagttcgcgtgcaagcggcaaagcttgtggataggcatttgctaattctgccggcaactcaccatttaaaaaccccaacaaatcaagcaacgatagcactcgataaataaccaactggtcatcggcttctgctggcacattttgtttgaagccggcgagcacttgcgccaccgctgcgtctgtcaaaaggttgtgatcgcgttgccaggccaccacgagcatatgcaccgcagcattgtatagcgaggtgctcgtggcataaagttgatcgtctacctgcggatcaccgctcaataaatggaattgaagttgcggataacctttcatctggaacaacaggtgtagtaactcatgacttaaggtgtaatcgacattggtcgtgtccgtcactgctaccactagcgtaccatcttttttcaattgctgatggctttgatcgtgcgttaagacgccgctcgcctccccactaatgtcgacttctaggggatgatcatagtgttccttgacttcatttagtaatgtttcaacgtcttcctgcatcgtattgcactccttaaacgcgatcacaaccgcagaaacctgcacataaggacctcaggcgtaaatgacccaaacccagccgtttacgcctgaggccgcttatgctccgatttctaaccgcggccgctcacgctctgtgataaattggctttaattatttttatcctctatcattaaggtagcgataaaagggaggaaattcaaatgaaactatccgtaccacttatcaatggtcaacttgccgatcgctatggcaagcatgcaagcggcagtgacgttaaaaatggctaccccattacgagttttccttttacgattgaggatgcccctgccgaaactgtcagttttgcactttggttccttgactacgatgctgtaccggttgggggcctaccatggattcattggaatgcagccaatattcccgccgacagcacaacattcccagcaggcgccagtcataccaataaggtgccaatggtcgaaggcaagaacgccaccgctggccacctcgtcggcaacaccgacccgttcacacaggctggttatgtcggcccgcaaccaccagataaagatcacgattataccttaatcgtctttgcattggatacgaaattgccactgcaagctggcttttggctaaatgaagctcggcacgcgatgaagggccacatattagcacaagcagaaattgatctgccttcgcgcgtttaaccgataaaaatgaaaaaacccctgctgacgctggtcagcaggggttttttcattttgataccagcttcttaaactgtcagctaccatcgcctgtattcagccataaggcaccagcgccggctgcagctaaaacgccgacaccaataataccgactaacgcaaacttaaaaatggcaaagccgccaagtgcaaacagtatcagactgataaagggatgacggaggatcgcacccagtaacttaatcaccaaaaacaaaatgatgatcaccgccaccactgcaccaatcaaaattgcgccagttaaggtatgaccattgccactaccttctgtcgttgttaaaatcgccggaatcatcacaaactgtcaccccttgcttaaaccgctaaaaattatttgatcaggctctgaatccattgagcgataccattaaagaaactcacgatgccatcccagattttttgcaggaaattccgattttcttcagtgttcaggctcttattgagtttatcaaacaagcctttagcagaattctgaatggaatcggccagcttccctgcctgtgctttaaagtcattgttctttagtgagccggctttttgaacgttcactagtaagttgatgatcaattgccgctgattgttgttaataatcgttgttaaattattctgtttaagctgactgtctacgatgttaccgatctgattttgggacaaagtctgctgaccgttgttactttgactggccatttgctgtttcgcacccgccacggcattattgagctgcttgtcagaataaccttctttgtccttattcgcttgggtgatcgaactcaaggtgttgacttcctgctgagcagcattgatttgctggttattcaaattttcgccattttgagcaaaagccgcataaacccctgccaaggcacctgaaccatcaattctaaccgcgctggtaatgtagaggttggcattgctaaccccagcggttaatgccgcattacgatattgatcagcggtgatggtggtgatgttattggtgccattataagggacgattttgacattaatgcccccattatcagtcttttgaaccaacgcgctagaccagacgcctgagctttcagtaaaagtactacctgaaggattgaggtacttcaccagtgtggcaccattcacggtcagttgactggcattgttgaccccggcagcattttgtaaagtgctcaaggtgccgcttttttgatcagcagtcagtgaggaaccaattgttgccactggttgtgaccaagtatcggctcgcaccacatgcggtgctgcggtaagcaaggccaagcctgcaacggccaggcctagccatttcataaattttttcatgagtaaaatccatccttttaaatgcgttctccagcccagaaacctccgcatagggacttcaagcacaatgattatgacccagtcatcgcacttgagcgcacttatgctccggcttctaaccgggctggctcacgctctcctttagattggtaccttcattatcgctgcttcagtgcaccccgtcagcatgtttaccagacttttaagcaatgattaactaatgctcacgctgtgtcaccgcacgcgtgttcaaatgatcgtacagcgcgccttctcgcaagccaaactgtgagaaggtgagacgatccgagtctagataacgaatcatcgagataaccggcatcaaaccgcccacgataatatcagcgcgaaactttgacagccccggaattgactcccgcgtggccaaatctgcaccaagaatttccttaaaaatcgcattggcctgctttgtcggcatccgatagccgtgaatcgcctcaaaatcagccattttttcctttcgtcgttcgattttcgccaacgtccgattgcttccgccaagcgcgataatcggcaaattctgtgctcgccgcagccaccagatgctgttaaaagtctcatgaataaacgtacttaaggcaaaatactccggcgccgaaatcacatccggattcaaaaaccgttcggacaggttaaccgagccaaaaggaatcgataccagatgttgcaacttccgattttgaaccagaatcaactcggttgaggcaccgcctgtgtccataattaaggcgttttgaatcggcaaggtgttgatgacgcctaaaaagtcatactcggcttcacgcgttcccggaatcacattaatgatcaaccccgcctcgttcttcacccgtttgaggaattctttttgattcttggcttggcggacagcagctgttgcaaccgcctttaaatcaatatcagcatacttattcagctccgtcttaaacccctgcaaggctttcagggtgcgatccattgctgcgggctgcaaaacgcgatctggccccatatcctcagacaatcgcaccatttctttgagccgtttgatcggcttgacaacctcttgctcgatttcccagatcgtcatccgagctgagttactgccaagatcaattactgcaaaatgatgcgtcatgcgtcatcgtcctccttgggtgcggttatcggaataaaagtatgcgttgcatgcaagtcttcaggagcatcatcaacttcctcacgtcgcaatgcttcacccatggcttcagcatgttcaatgaagtatgcctgtgcattgagttttgtaaccccgcgtaattgagcacgaacccacgtactgtccggttgtaaaattcgcgttttaacgttatctgcccacatgatactgaaaattttgatgatgcgttcgcgaatatcgtcctgcaaaatcgggaacagcagctcaactcggcggctcagattgcggttcatcaagtcagcagatgaaaggtaaacattttcctgcccatccgcataaaagtagtaaattcggctgtgttccagcaactgtccgacaatcgaatgtactgtgatattgtctgaaactccgggaataccaaccttcaagttgcagatcccacgaataaggagatgtatctcgacaccggcattggaagcttcatagagcttctcgatcatggccgtatcagatagcgagttcatcttcatctggatcaaggccttgcgccccgccttagcagcagtaatttcttcatcaattcgatccattagatagtctctgatgcccagtggtgcaatgaccagcttgtgaaaatacggtggttccgaaaaaccggaaagcatgttgaaaatattagacgcatcttcgccaatttcgttgttgcaagtgaacaagcccatgtcggtataaagccgcgccgtcacatcgttgtaatttccggtcgccatgtgcatatagcgcttgatgccttcctcttcgcgacgaacaaccaacgccagcttacaatgtgtcttcaaaccgaccaaaccataaatcacgtggcaaccggcatgttccaattcttgcgcccaatgaacattattctcctcatcaaaccgcgccttcaactccaccaataccgtgacctgcttgccattttctgcagcttttttcagataacggatgatcggcgatttgcttgaaacccgatacagcgtcatttttactgcaagcacttgtggatctaatgctgcttcgcgaataaagtcaacaactggctgaaaactgtcataagggtgctgcatgaagacatcgcgatccttaatgacatcaaaaatcgactctttcttgaaatccggatccatgtacggtgtgaatggcttgaatagcaaatctttatgatcgtgcacttgtttgaccaatttgctgagaaaattgagatcaatcggaccatgaatttcataaacgtcttcatccttcacattcatagccttgatgagacgtttgcgcaaatgcttgctcataccagcttcaatctcaagccgcatcactttcccgcgttgacgctttttcaactgggattgaatctccttcatcaaatcagatgcatcctcttcggccacatccatgtccatgtcacgggtaacccgaaatgtagccgtttctttgatgtcagcaccaacaaacagctcactgacaaacatccgcacgacttcttcaagcaaaataaagacattgtcgccgcctggcagccgcaaaacccgcggaaaaacatcaggcacctgtaccatcgcaaacgaccgtgacttatcgcctttatcatcaggccgaaccagccgaatggccaaattcagactattattgccaagaaatgggaacggccgcgtcggatcaactcccatcggggttaaaacgggatacagttcataatggaaataatctgagacaaaatcgtgctgtttctccgtcaattctgatgcatgtagcagttgaatatcgacagcactcatttttggcaacagcgaacgaaccaatgttgtgtattgtttctccaccattgcgtgggcggtttcggaaattgcgtctaactgctcttgcggtttcaatcctgctgcatccggctgatcataattaactgtgaccatttttttcagcgacgcaacgcgaatattgaaaaactcatcaagattgctttgcgtaatacccaggaaacgtacccgttcaagcaacgggttattcttatcccgggcttcttccagtacccgatcgttgaatgccagccaactgagttcacggttattaaaataacgcggctttgaaaaatctagtttcttcataaaatgtttcttcctttcagctcaagccctagcccgaatacctcagagaaaaactttcctttgcgtgctaatgtccagcgttcaagttcaatatcatcatcggctctggctgttaacagcacttcatttggtttgacagaaacccgtaattgctgaatcttctgttggcgagatgcgtctagactatctgcaacgcgtagcaaggcggataacttagccacaactaagcgattttcggtcgacattgttggaaagttctttaagtccgattgcggtgtaatggagctgtgaaaccgtgtaatcgttgccaccatggttacttcaagatcattgagtcccataatttcagatgctttgatgatgtaattagaatgtgcgtaatgtttgtgtgtttcaatgtaactaccaatatcactaaccgttgcggcgacttcaagcaaaagacgctcgcgtttgcccatgccgtgcaactttttcaatcgatcaaacagctgtaaggcaaccgtccgtgtggcttgcatatgggcttcatcaacttggtagcgttctgccaaattattcgcactgatgacaatttcttcattcggatcaaagcccagctttttaaagccgccttcatgtgctgcattgacttcaataccatcaatggctttaagatctgagatccaaatagattgactgttgagcgtttcaaccaaccgatacaccagcaaaactgtcggcaaaaccagtgatgtttggtcagaagtcaaatcataggtatctgcaaggtactggtcagaagcctttgtcacttcatcgtataataaatcaaaccctggccgatcagtttctacctgatgcttgccttccggaatgatattttgaaaaatcgacagattactacccattaaaatcatattggtgtactcaacaccttgtggcaacagccgcataaagtcgagcaagcgactgtcgatatagtcgcgcatcacttcaacataatttgtcaccgagcgttgaacatcactcatgatttcatacactcgcaaagggccaagtgacagattacgcgagaagccaaacacgccattgctgaaagtagtcaactcaactgaccctgaactgatatcaatcagcaccgtgcctttttgcgtaatcgatttaaactgcggaaacttcaccatgatcgcttgggtacgaaaaaaggcttcttctgatagtgaggtagttttaatgagccagccagttcgcgtataaagctgatcacgcacaaactcggcattatcagcttcggcccaactggtacttgcaaatacattaacagtcggtacgccatagtctttaaaaatttgattgatggcatcaaacgcttgtacgatcgcatcaacagtatcgggcaaaatttcatgttctgcataaaaatcatccccaatggcaactggatatctaccgcgttcaattgttttcagcgtccgcagatttgtgatgctaaaaacgattgcttgtgcaccgatcatcacaaacccttgtatattatttgccattctcgttccacccatttcttttcgtttgctacctgactgtcatcatgctctaatgccatgatagcacggtaaacactgcctgcatggctttttagacaagccttattactgacaatcggtctatctacctttagtttaccaaaaatcggcatcaatctttactgaatgtgctataagtagcgctttcttcaacatttggtccgaccaatggcagactcgactgctggctagtcagtcattggccaataccacagacctaataaccatcacaaaagcatgcgatagcctcaaattagctcgtccttgagggtgctttctcacgcaatcatcactgcttttgtgataatcttaaagcatcatggaacaattctgaaaggatgctcattatgaaaatgattgatctaggccgttctggtctgcacgcttctgccattgcgttaggtgttatgcgtttgccgaatctcgatcggccgcgagcaaccgaactacttgatgctgcttatgacgtcggcattaacttttttgacaatgctgatgtttacagcaatggtaaagctgaacagctttttggcgatgcgttgaagaaggccagctttacacgtgatcaagtcctgattcagactaaggtcggtatcgtcaatgatcgaaaagcgacccatcgctatgatttctccaaagagcatatcgtggatgctgtcaatggcagtcttaaacgccttggtaccgatcatgttgacagcttgctattgcatcgacctgacccgctcatggaaccagaagatgttgctgaagcctttctgcaattgcaaaatgaaggtaaagttcggcagttcggggtttccaacttcaatcctgctcagattgaactgctccaacaggcggtgccgcaacgattgatcatcaatcaattgcagttttccctgatgcacacaggcatgattgatgccggcatgcatacaaacatggcagatgcccgttccattgatcatgatggcggtcttctcccatacagtcagcagcatcatatggcaattcaggcgtggagtcctttccaatatggcttctttgaaggtgtcttcatcgacaacgataaattccctgaattaaatgccttacttcaaaagctggccgatcaatataccaccaatcccaacgcaattgctgctgcctggctcttgcgtgtaccagctgatgtgcaagtcatcgccggaaccaccaaacccgctcgcattcgcgccatcgccgaagccggcgacattgctttgacccggcaagaatggtatgacctctacttcgccgccggaaacgacctgccataatcagacagagcgttcaatggcgcggttagaaaccgacgcataagcggcctcaagtgcattgaccgggctttggtcagtctgcttgaggtccttacacgcaggtttctgcgactgcaaacgcgtttagatagagcatgaaccaacacatttttaaaaggaaaatcctatggaaaaacgactcgactacattacagatctcatggcacttggtccaaccgccaatgcaaggaccattcagcgtcgccaaactgcccatcgactcgcaattgctgaggcatggcaggtaaaacccggcgaaaaaattttagaaatcggctgtgggcaaggcgacctgagcgccgttttggctgatcaagtcggctcatccgggcatgtgactggcattgacatcgcctcacctgactacggcgccccgctgacgcttggccaagcatggaaccacttgcttgcgggaccgcttggtgatcgcttaacggttcatttcaacactaatctttcggatgatcttgggcccatcgccgatcagcattttgaccgggttgtcctggcacatagtctttggtactttgcttccgccaacgccctcgccttattattcaaaaacatggcagctgtctgtgatcacgttgatgtcgccgagtggtcaatgcagccaactgcgctggatcaaattgggcatctgcaggcggctatgattcaaggcttgctgtatgccattgcgccaagtgatgtcgccaacattcgcacgttgatcacgccggacactttggcacaaatcgcacatgataacacatggacctacaccgctggcaccatcgtcgaagaccctactttagatgatgctcactgggagattgcaacaaccaatgcgcttttgaccgaactcaagctcagcaccgatttgcgtgatcgtgtgaaaccattgctcgaggctatgagccataacggtacggcaagtttagcaacctttacgggccgcatcacattttaaccaaaatggaggtcatcagacgttgattgaatttacccctgccacagccagtgatttaccaaaaattgtcgccatttacaatgaaactatcccgacccatcaagcaaccgctgacttgcagccgcaaacagtcgctgagaaacaagcttggtttgcggctcacaataaccattttcccgcttggatgattcaagttgaccacaaaatcgttggctggctgacactgtcggcttatagtgaccgctcagcttatgaccaaactgccgaaatcagtttataccttgatgtggccgcccgcggtcaccacgttggcagcgcggcattggcctttgttgaccgcgaagcacccaagcacgacttaaccactgttctcgcccgaatttttgggcataaccaagccagtcgcaacttgttcaccaaattcggttatgaccactggggccatttgccagccatcgctatcctgccagaaggagaagcggatttagaagtctatggcaaacactttaaaagcagagcgtgagctggcgcgcttagaaaccggagcataagtggccgcaagtgcattggccgggttttgccagtgtgcttgtggtccttatgtgcaggtttctgcgccagtgaacgcgtttaaaagagcgtgaaatggcgcgcttagaaaccggagcataagcgacctcaagtgcattggccgggttttggccagtgtacttgtggtccttatgtgcaagtttctgcgccagtgaacgcgtaaaaagcgtttgactgatgctaacgggctggcccgttggcgatcaatcaaacgcttttttaatcttggtgcccagccaattcatcttcctgctgtctaatgcgccgcatcgtccgaacatacgagctgactagtaccagcacactgccgaaccacgccagcgggttggccgccgatgcgccagcaaagccgaatggcacaacgaggaaaatcgccgcaaacgcccgcatccccaattcgaagaatcccgcaaccgttggcaccaacgtctggccaagaccttgcaacaaattacgaatcgtgaaaagaatcgccaacaaccagtacatgctggcattgaagtggaaataagtctgggctaaggccgtcacagctggttgattcggcccgagaaacaaattcactaatggtttgctgaaaagaataataaccacacccagcactgccgataagccgacgttcaccatcaaggtttgataaactccgcgacggattcgcccatattccttcgcacccagattctgcgcagcaaacgtcgccattgccaccccaaaagaggctgacggcaaggtcgctaactgatcaattcgtccagccgccgtatacgcagcaaccgcattggtgcctaatgtattcaacatcacctgcaaaatgacagcgccaattgcgataatcgacatctgaaaccccatcggaagcccaacttttaaatgctgaacaatatcgtgccaatcaaagcgcaaatcacgacgccgaatcattagaagcggtatccgcatgcgaatgtaaatccaacagagcaacgccgcgatcacttgcgcgctaaccgttgcatagccggcaccagccaccccggaatgaaacccgagaatgaaccaaaagtccagtacgatattaataatggtcgcaatgatcaagaagaacagcggtgttcttgaatcgcccagtgcgcgcagcatattgcttaacaagttaaaactcattgatgcaataatgccgaaatagataacccgcacaaaggcaatcgaaccatccatgatatccggtggtgtctgcatcacggtcaataatggtcgtgtcatcgtgacggctgctacggtgagaatcagtgaaatcccaaccgtgatccaaatgctcgtaccgaaactgcgtcgcacacggcgataatcatgagcaccataggcctgtgctgtcaaaatagaaagtccagccgtggtcccttgcgcaaatccaataatcaaaaaaacaatgctggatgttgccccaactgccgccaacgcatccttaccgatcgtccgcccaacaatcaacgcatccataaaactataaagctgttgaaaaagattgccaatcagtaatggaatcgtgaacagcacgattaatttcaatggcttaccgatggtcaaattccgcattaacaagtcctccaaaaatgatcgtgtgctcacccaatcaggatcgcacttttcaacaacgggattgcacacgtaaactacctgtccgtcatcggatatcactgataagcgatatgacatgcgctcgttcccgttcacaaaagactaattcaacaaccatagcacaaaaaaccaggcagcgactcgctgtctggtaattgaaatatatttgcaatcaaacatcggcaccaccgccgccggaactgccgccaccccagctggaaccgccaccggagccgcctccgaaaccaccgccgaagccgcctccgccgccacggcggccagaagatagcagcgcgtccagaataacccagagccaaaagctactgtcacctcgaccacggcgaccaccacgaccaccgccgccgcgactaccaaagatgatggccacaacgacgacagcgataaagatgaaaacaattttcgtcaaaaagttgccgccgctgtcttgacttgagttgcgatattgattcatcgtctcatcagaaaccgtgttttgatctttagggaacttgtatttcttatcgatgactgtcgcaaccgcattgaaaaccttgcgaatggcctgattcagttctttaggatcatgtgacttgatgtccttcagattgtcattcaagattcgcccagccagcgcatcaggcaaatcaccttccaaaccataaccaacttcaatgcgcatgttctgcttgccgccattattcgcataaagcaaaagcaccccgttatcggtacctttcttgccaattccccatttctggaaaagatccggtgcatagtctgacaaggggtcgccatgggtcgactttaaagctgctacggcaatttgcggctgttgtttagtgccttggtaatactgattcttactgtcgatcagttgcttggtactttcatcaagcacactgtcttgatctagatagtaatgctcggtgggctgtgccggcagatcttcggctgccgccactggctgcgcggcgccagtgaacaacaacaaacccgtcagcgcggcaacaaaccacgctaagtgcctgcgcatgatgccacctacttcccggaactagagctgttcgttgaaaaatcaacgcttggaaccgtttgggcagccggtgttgctttgaaggtgtccttcttccctaagcccatcatgctagcaaaaatattcttcgggaaggtcacaacactctggttataatcacgaacctgatcaatatatcgcttacgttcaaccgagattcgattttcactaccttcaagctgcgtcatcaaggtgttcacctgattgctgctttgcagtgtcgggtaattctcttttatcacgttgatcaaagtacccacactcttgttcaactgatcatcagccttagctttgtcagttgtcgaacttgcattagcatacgacttgcgggcttcagcaatgtcaccaaaaactttctgctcttggcccatgttgcccttaaccgcattaactaagttaggcaccaagtcagcccgtcgctgcatgacgttttcaacctggccccattgcgcttcaacggcctgattctgcttagctaacgagttgtaggtgccgattccgaagatcaggcagatagcaacaatcacaccaaggacaatacttgtgaccgcaactggacttaatcgtttcgttttcattgatatgaattcctctctaatgcgttcacaattgcctgccttttcacggaaaaagccgtcagaaaacaacggcatttccgtgaaaaggcaggctacaactgctcacgcttatcatcaatttcctgcttataccatcattctaccatgacgacggttttcgacatccggcttaagacggaacttgactatttaaagtagttgaatccgatcgcatcccgaacttcctgaagcgtttgattagccaccacattggctttagccgaaccttgcttgagcatatcagcaaccgcccccatatccttggcatagtgctcccgccgagtgcggataggttcaagcactgcctccatgacatcaatcaggtagcgcttgatcttcacgtcccctaagccgccatgttggtactgggctttcaactcagcaacttgctgcttatcaggatcgaaaatatcaagataggtaaagacaacattaccttccaccttaccggggtcttcaacgtgaatatggcccggatcggtatacattgacataatcttctgcttaacggtatcagcgtcgtccgccaaatagatcccgttatttaagctcttgctcattttggcattgccatcaatccctggcagccggccaagaccctttggtggaaaatagccttcgggttcaaccaacacatctttgtgataagtccgattgaacgtgcgcacaatctcacgagtctgctccagcattggctcctgatcgtcacccacgggcaccgttgtcgccttaaacgccgtaatgtcagccgcctgactaacgggataaatgaagaaacctgctggaacgctatcaccaaaggctttttgtttaatttcagctttcacggttggattacgttccagccggttcaccgtcaccagatccaagtagtaggccgttaattcaaacaaagccggaatctggctttgtaccagaatcgtcgtcttgtctgggtcaatcccaaccgccagataatccaaggccacttccagcaaagagtggcgaattttttctggatcgttggcgttgtctgtcaatgcctgcgtatcggcaatcataacaaacggttcgtattctccagagttctgcagttccacacgatttttcagtgaaccaatgtagtgaccaatatgtaaccgtcctgttggtcgatcacctgttaaaatgattttctttgccatacttgtttcctccttatattgtgagcgcgagccagcgtgggtgaaaccggagtgtaagcggccttgggcgtgatggtcgcacttggaccattgcgaccaaggtccttatgcgcaggtttctgcgactgtgagcgcgttatcgtaaaaaaagcgccctatgtcataacaacataggacgcaagcgcgcggtaccacctaacttgtccgccttgcggacctctcttggcttaaggcgcacccaccgaacataacgcaaacgacccaactttgcctaccatggtcatcgacgtcacagcattgccgactctctggagaccacttagataagctactcatcgtttgtgtgaatatgggtttaggttagctaaattcgctagtgatgtcaatgcaaggttacatctgtgacttatcaatttgctcagttttgttctaactaatgacatcaattattcgatgcggtatcaatgacaaatggcatggtaagtgctcctttaattcaatcaaatcagccacgtttctgcccatattaagcctttataatgtcaatcgggtccttacggctaatcagccgaatcggccataagctagcaaaaatggtcaccccgaaactcagagcaagattagtgataaaagctgccaaaatgatggctatgaagtgaactcccaaacgcagcgccattatcgttgccgcaaccacaattaaaagcgcagcaccaccaaaacaatagcatccgtatttcatggcattccagaaaagaatgcgccgaacatctttagttgtgaaaccaaccgcttttaaaatcccaacttcccgcaatcgctgtcgattgttcatactgaaaagtatggtcaacgcaatcatacttttgccatgatgaataaaagtgcaatctgccgcgtgccgttcttcgctttctgcacagtagcattcagtgacgccacattctgtgcaactgaggaaacactataaaaaccggaacttgatttgatagttttagtcattgaaaccatatcgttataacttttagcttcaaatctgagcgcgctatacccaaaaggctgttgcttgaagccttgaaaaatctgatctgacgttgtatttgctcgaatcgcgctgtgcagcaaagtcgtcatgctagcatcatccatgaaaaaagcgttaccttgctctgaccgatcataaggatagtttgaggcatagacgccagtgatggttgctgccaatggctgctgaacatatatattgccatctatcgcgaccttctttttattattggttggcagctcactttctgaaagatattgtgcatatggaatatagacttcaaatgctacttgtttacccatcgcagattttgtcgatatgtgatttttttcaagaaagtcttggctgactatgaagtttgttcccactttagctggatgtccatttgcatacaaatattttttggtcaaatcactcttataaattggctggattgaaaaggtttcatcgacatgataactttttccgcctaatgaaaaattggaccctttgggaaccggctgtctaacattttcttttgtcaggccatatgaaagaaaggtgtagtaaggctgtacagatgtaatccccggcattttcttgattttttggatctgtttaatcgtcaaatttcgaaatggatcgagatcctgatgactgcccgtaccaagggtgttattcgtgacaaaaagtgaattatccgttgcttgattgagttcacgttgttgctgacttgccaaaatttgtggcacatttaaaactatgctggcaacggctaacatgaccgtaacaatgacaaggaagccaataggcagtttttttgctgattgatagttgtcatagacgagcgcttgcttattggacaaatctgatcgatatgtaacagcagatgctgtcggttggcctgccatgctttctggaattgcacgattgaaaagtttagtacccgactgaggcactaattgcctgttattgatagtcaaaatttgatcagcatagtcttccggcagcgtttcatgtgacgcaacgatcacaatcgcctgttgttggtgagcaaagtccgctaattgttcataaaacatacgggcattttcactatctaaggaatttgttggttcatcagctagataatccgtgcaccggaaatcaaagctcgaccaatagcaccgcgctgatcttcgccaccggataaatcctcgggcaacatgtgacgttggtcttcaagccccagcttatccagaatggctgtcacgcgagctgctttctttgcttctggcaggttgctttttaaaagcggcactttgagattctcttcaagtgtcatcgtgtcgattaagttacctcaattttcaagtcaagtgcaacgatgataacgaattcttgatagtggtctaggctgttacgccatgcatcggtagtaatcgcatgggcgaagatagttcagaatacgtctgggacgatggttcagtgcggccgcactgaaccatcgtcccagacgtattctgaactatcttcgcccatgcgattactaccgatgcatggcgtaacagcctagaccactatcaagaattcgttatcatcgttgcacttgacttgaaaattgagggaattaaaaagcgtgaaatctgactggcagcaccaagtatgaggacgtttatcattcgccatacacttctttcgccagattaaacgcagaccacgcctttggccagccggcgtaaaaagcgagatgagtgatttcagcaacgacttcctctttcgtcaggccgtgttcttttcctaattgtaaatgggctttgagttgtggaaaatcgccactggtcataaggcaagcaatcgtgatcatgctgcgatcatgggcagacagttcattctcttttgcccaaacttccccaaacaaaacatcgtcattcaatgcagcaaactgtggggcaaattttcccaactgtttgcgtcctgctgtttgttttgccatcttattgtgcctccattagctgcgcataagcttgatccgatacaggtttcaaccattcactagtacctttggtgatcgccacatgactaaaccagctgtccttagttgcaccgtgccagtgcttcacaccttcatgaatcgtgaccacatcaccgggatgcagcaattgtgctggcttaccggcttcctggtaccagccctcaccgcttgtgaccagtaaaatctgaaacccattgtgatgaatatgccaattgttccggcaaccaggttcgaatgtcacgttggcaacagtcacatcgatctcgtctgccgcggcgaccaaaccattcagataactgttgcccgtaaaatactgttggtaagcggtattagcttcacctaagccgaaaagtccggcgttttgattcttgtcattcatgacgaatgccttctttcaatgtttaaggttattatcgatccgatgacttaaaatgtataatgcttatataacatatagtattatgatatttccttatgtatcggaggccttttcatggaattacgaacattgcgctatctcgtggcgattgccgacgctggcacgattacggcggctgccaatgccatccatatttcacaacctgctttgtcgcgacaaatgcaggaattagaaacagaactcggtacaaagctgtttaaccgaaaaagtcgggcgatcagtttaaccgctaatgggacgtatttggtgaatcgcgccagacaaattctcacgttgacagacgctacggttgcagacattgtcgatgaccatgccgtcagtggtacgctggcaattggtcttggcgagtcacggcttaatcagattgtgttaaaggcagcgcaacaattgatcgacgcttttcctgatgtgacactgcagctgtacagtggcaatgccgatgatattaaggagcggttagatcatggtttacttgattttggggtcgtgattgatccggctgacacttataaatatgcctatcgccggattccaggtgaaaatcgctggggactgctcatccccatttctgatccgctagcggcgcaaaccgctatttcaccagaaacgattcggggtcaggcgttgatcgtgtcggagcgcgaacctgttgtcaaaatgctcactgattgggccggccacgcttttaaccctaatcaagtcgtggctcgctacaacttgatttacaatgctggtctgcttgctcaactcggttccgggtatattgtcggtctcagccatttaatcggccatgatgaaatgcagctaaaattcattcccttttctacgacactaaccaccaagatggccttaatctggacgaaaaacgtcccaatgtctggcgctgctcagaaatttttggaaattttcaaccaattaatcgagactgtttagcaggcaactaaaaaaagatccgcacaaggccaactagccaaaatgcggatcatttttaaatcttaaaaagtcagttacagttccttgtttcgcaacattaatgctgacgagccaatcatcacaaccaatagcactaaactgacagcgatgtacggtggcaatgcactaaccttcatgccaccgacgccgatattttgggcgacgccgaagaagtcgatatatttaatccagtcccactcaccgagtacatggagcacactaacaatgagggggaagaccaccaccacaatcgccggtatcataatcgacccagttaataccagcaggaacacgccaatgctgaagatcacactcacaaagaaggtcgcagccacgaaactcagactaaaggttccaaacaatgttcccacgctcccgcctaatgggcgtccagcaacaagtccggccatcagtacggttaggaaattgacagcgaatagtagcagtaagtccagtaacatcaccaaatacttggctaggacaaacgctaaccgcgagatacccgagattaaggtgtttttgtaaaccttttgactgaactcatacccgaaaacaatgacaaaaacgccgataaaaacgtaaagtagcatcgtttcacccatattcgccactttaatgccagttaaaactgaccacgatttacccccaacttgggcaaattgaccactgtcgccacgcactgtcacgccgccaacactctgtcccaaggttgtcgtggccgcatagataatcgtcagcacaagcatgatgtacatgcccgttgtatggatttggcgatagaagtcggcccgaatttgattaatcatgcttgcccctcctgcttctctgtttgccccagtaactgcatgtaaaattgttccagtgatccagcttgatgactgatatcctgaacacccacgccactggtcacaagcaattggttcaccgccgctgcattaacttccggttgtctcaacaaaagatgatgatcgtcaatgatgtcaaaatcttgatacccatgttgatccaaaacctgtgctgccagtgccgtatcatcaacggtagccgctaagcctgattgattggctttatccagctcagccttggtcagttgtttgatcatccgtccatgatgaataatgccaaatcgggtggacacttgatacaactcacttaaaatatggctggagattagaatggttgtctgctgctcctcgttcaagcgtttcaataattggcgaaattccataatacccgaaggatcaaggccgttaatcggttcatcaagaatcagaaaatccggacgcggtaaaatcgctaacgccaaacctagtcgttgtttctgtcctaaagaaagatgtttgactttggtggtttgcttcgctttgagtcccacaaaatcaatggcttccgtgatggcctgtttatcttgaatgccatgttgaattgcgcacaaccgcaaattttggtaaacggtcaacttctcaaacgctgctgggctttcaatcacagctccaattcgactaagtgcatgttgatagtgaccagcttgctcacctagtaatgtgacggttccgtgctgcatcggtgacaagccggtaatcaaccgcattaaagtagtcttacccgccccgttttcgccaattaagccataaatatcccctttttcaactgtgaaactgacctgatctaatgcctgaaaacgtccaaactgtttgctaacatgttcaatcgttaacactgattgtgtcatagcaatctccctccaccattttgtcaccgctttttgcttacaaaatcagcttaactggcctttcttaactggctatataatgaatccttaattaaacctaaattgtgaaaaactgctcttatagcttacactattaggagagagcgtgagcagccgcggttagaaaccggagtgtaagtggccttggctgtgatggtcgggttttgaccattgcagccaaggtccttacacgcaggtttctaggctggtgaacgcgtttagtagagagcgtgagcagccgcggttagaaaccggagcataagcggcctcaagtgcgatggtcgcactttgaccattgtacttgaggtccttatgtgcaggtttctgcggctgcgaacgcgtttaggaggtgtgacagcatgggcaaaatcttaattgtcgaagatcatcaagatattcaagccttgttaagagatgtattatcaccctactacgctgtgatccaagcttatgacggtatcagtgccttagcacaatttcatcaggaagcacctgacttgattattcttgactcaatgctgccaaacgtcaccggtgaaagtgttttgacgaccattcgcaaaacgtctagcgtgccagttttggtccttaccgccattcaagacaagcaaaaaactgtcgcgcttctgcaacaaggcgccaatgattatttaaccaaaccatttgacattgacgagttattggctcgggttcaggtgcagttgcgtcaaacgttgcctgcaccatcggctaaagcacaagatcagttacaggttggtgaaatcacgctgaatctcaaacgtcatgcggttactgtcaacaatcgaccgctgaccctgccgaaaaaagagtatacgatgctggcgttgatgatgcgcgatccccatcaagttttcgacaaacaacaattatatgagcatgtgtggggcgagccgttcatgaacgcagataatacgctgaacgtgcacattagcaatttacgcaccaaaatcaatgatctggcaaaagatccgaagtatattgtatcaatctggggcatcggcgttcggttgatatagctagttagctacggatcatttttaaggataactgctagcaatcgaaaaatgtttttcaaaggagaaggctatgcttggtatcatcatcggactcagcgtcatttgtcttgtattggcgatcactcttttgttgatcatcatcgatatccgccgtatcaatcacgaactcacctatattaatcacatcgagactaacgctggggtgacaaccaataccaattttcctttggttcgtaaactcgcagctgggattaatgacaatctgaatgccacccgccagttgcggcttgagcaaattgcgcaagaaaaaaagattcatcagatgttgctgaatttgacgcatgatattaaaaccccgctgaccgtcgcaactggctacgttcaacttctaaatcgcgatccgcacgccgacgccaaacaatcgctggcccgcgtggcacacaatttgcgatctgttaattactacttacattacctgatggacttcaatctcattcaggaaaaatccacggcgttaaagctaaaacctatcaacttatcaaaattactcgaaactgaattatttgattattttgaccaattgacggccaatggtatgcaggtaaccccaaaaatcgcgcccaatcttgttttaacaaccgatgagacgatgatgcgccgagttttccaaaatcttattggtaactggctgaaatatgccaagaatcaggctagtgtcacgctcgttcgccaagatgagcagcacttgaccatcacactcaccaacaacaccgacaaaccgcttgcgaatgctgaccagctcgttgacaggttctacacaaccgattcggctcggacaacccaaagcgtcggcttgggtctgagcatcgtgcaatcactcaccaccacgcttggcgggaaaatgacgctgcaagcagacaggcaacaatttgctgtcacgctcacctttcgcgaccacaacgtctaagatcacgcctttgcctagtccattcgtgaactgggtttttaagctgtcattcaaaaagcatcagttcatacaaaacacttgctttttgtaaggagattgctattctagtaacagcttacaaattggaggggcatgatttgaaaacacaacaaaaatggcttgtggttgctgctgcagcactcacttttgtactgactgcatgcggtacccaatcgagcaaggacagttctagttccagcaagcaacaggtctggcaccgaatggaagccgatgtgttgcaaacgcttgatccaagtaaagcatctgaaggtgtctccggacaggctatcattgataccatgaacgggttatataaatactacggtcacgacctgcaaccagccatggcgaccaaaatcgtgaagccgacaaataatggcctcacctacacctttacgttacgcaatgccaagtggagtgacggcaccccggttacagcccaagatttcgtttttgcttggcagcgaaccgttgatccagctaccaagtccactcaggccaacatgtactctggcatcaagaatgcggacgacattcgtgcaggcaaaaagccggcaacagatctgggcatcaaggctattaatgataaaactatagaagtcacgcttgaacacccgattccttacttcaatagcttgttaaataacgttgcgtttttcccgcaacctgctaagaaggttaaggcatggggcgccaagtacggtaccaagtcgcaatatactttgtcgaacggcgcttttaaatccaaaggctggaccggcactggcgataaatggacagaagttaaaaataccatctattggaacaaaaagaatgttcatttgacgcaaattgacgttcaggtagttaaggataccaatacggcacttgacctatatcgcactggtaaacttgacgatgccaatttaaccggccagctcgctgcccaacaaaagggcaagactggttatgttgccactaaacgggcccggacttacttccttgaattaaatgaaaacaaggtcccggcattcaagaataccaagattcgccaggccatctccatggcgatcaatcgcgactcttttgttaaaaatgtgttagctgacgggtctattgtcgcccgtggcattaccccggctgatctcagtcagttgcccgacagcagcaccgattatgcgacagcggtcgccaagaacacgaaggccatcacaacctacaataagaagaaagctcaaacattgtgggcagaaggcctgaaagaagttggcaccaaaacagttgatgttgagctgctaggtgatgatgttgatgcaggcaaggcaactcaagaatatcttcaaggtgctttgcaagagaatttgccaggcctcaaaatcagtatcgccagtgtgccagctaagaaccgtcagcagcgcgctgccacccacgattttgacatggtcctcagtacttggggggcggattatccagatcccaacacctatctcgatttgttcacgagtaacagtgaatacaaccatggccagtggcaaaatgctgactatgataagctcatggctaagagtaacggtgcggatgctaacaacccgactgcccgcttcaaggacatgactgaagctgaacagttgctggtcaatcaagccggtgccatcccgctgtatcaactcgttgcagcacgcatggttaatccgaagatccatgatctgaagacgagcccgggcaacagtttcaactttgtttacgcctatctgaaataagcgcttcttggcgttacgtagcaaaacaggctttcctataatgcgcgactgacaaataaaagcgaacaaccttcccaaaatttttgggaaaattgttcgctttttatttcgtctaaacaaatcactgcgacttaaagacgtcagtgccaaggcggatcaatcataggtcagatggggctcggccgaattaataagcattatcagcatcaatcactggcggctcaatcggtaccattgtccgctgatgttgacgatacgtggcgatttcttttaccccgtgacgtttaagcatcgctagcgcatcagcaaagtttgcctcgtattgcggtccttcatgcgcatcactgccaatagtaaacaagtgaccacccgctgcttgataccaagcaatcgcctgatcatacagtggtgcattgccccagcgatacattgacttcgtattcaactccaacgccaagtcattttcgacggcaatggtaaaaatttgatccaacaacggcttgccccaagcttctagctggtccggtgtgatgtcaaatcggcgcaaggcatagtcaaagtgtgccaagacgtcggcatcatgaaatcgtttgaggccagcgagcatccgttcaaagtaatcttcaagctgctgtttagctggcatggtgatcaattgctcatccagataatcgtaatgaccatcatgatgaaaactcaaaagtgtcaaatcaaagtcatggttgtccaagtactgtcggaatcgagcatcggcaggagcaaaatagccagcttcgatcccaagcaagaattcgttcggaaatttttcggccagagccgcctgcgttgccttcatcctagcataatcaggcagattatcccggccgccatcatcaggattatcaaactctaaatgttctgttgtcacgacaggcgcctttgtctgcgttaagtaatcacggagttgggcttcggaatcaaatgaatacaaggtatgcatgtgctgatcataaattgtcacgaatgagttcctccttctagtggggtcagtgtcctttaccctactgacaaccaatgctagttagggtttcgaaccatgacttcttataccataagcatatcatagactgaacttgcaatcgaaaacagatggcatcgcgtgaatcgaccgagttgctgtgtttgtgaacatgttttatgaaacaaatcaaaaacgacctgtgttatcccctaaaaatgaggatgacacaggtcgttgtttctaacaatttaactggaaatcatgcaaacttagaaatcggcccatctgcatgttgcgcttgcaacgcatcaaatgcttgcggagataatttgccgagatcaacaagcttggtttcaatttgatccaacacactggcacggtcagctgctgagtgcataaagtcataacgatcacgatcaattgtaatcatagacgagcgcgtataaccctttgcccaatcacgataagctgtgttgacacgccgatagtaatcgaccaactccggcttttcgcgaatatcttccatatcgcgaccacgactttgaatttcgtcaatttcgtgatctggatcaattttcagataaactgctagatcaggaaaaccgttccaaggactgccattgacattactttgcatctcttgagacagtgtcacataaacgttgaaatcaacatcatcaatttcaccgtgtttatgcaactgcaaggccatcacgaagtctgattcaagcgaagaatccatgatcgcgttttcttgggtcacagccttcttcaattgctggtaacggaacgtgagaaatgcaatctgcaacatcgcgccggttcgcttacgactctcaacgcctgcaccataaaatttttgcaacatattggcgatcatgccattaccttcaacatcttcataatatgccggtgcctgcatatcttctgacaaaacttttgtcagcgacgtttttcctgcaccaatactgcctaaaatgtagatcacagatctcgctcctcaattatgtttattatgttgcgccaacaacaaacattaccacaaacactgctaaagcaccacttagatcgtttttagacccagctgcttgcggccccgattgaaccatggactaaccgtgaaggccaaaatatcattaatgacgtaaatgctggcattaatcgccatcgctaaactggcatccccttgcgcaaaagtaatggcccataaaacgagctgagccacgccactgaacaaccaccagaagtattgattgttgtatcgcaggaagcaaacaatcccaccagtcaatgaaatcgcaaaagccataccatcaaaaatcggccgcggatcattggtaaactggccgatcaaataggcgcttaccgcccacacaatcaacgtaaagccaattgacagcatccatttctgggcattgaatgtcttcaagttgttcttagtatcatcattccaagtccgaacgctaatcaaaactggcaaatcaagtgtcaccacataggctagctgttcaaacattgatagataattgcgggcgataaagccgacatagataaaacatgcggcactcaaaagacctaaccacccattgactgctttagtggcattaatggccaagacgcaaagcacacccaaagttgtcccaataaaagtaatgatagtcacgggggttatcttagcatctacaagggtcatcaactgacacccaaaagcaaaccagaacaaataatagttctgctgcggccaccccttcaactgatgcatcaaccaactaaaataattcccagatgtttgcacaaacaagactcccttaaactttcgttttcgttgcattgacaacgactatgctctattatgcaacaaatttttttaaatgtaagtcttgaatatacaatatattggtgttagcgagtgtgctcaccactatatgtgccattttaggtgaaccgcttacacaacgctaatcacagcaaaaatagcatgggatcagcagaaatgatgcttttggggcattagcaaagtcgcttcttagaaaatctaacgtacccaaaatggcaatcatacgccagttacattgcgtgaagcccgatataaacgatcaagcaacttctgatcgtgtaattcgggccgctgattccaagcccataatgccgggtaacctcgcaaaccacgccatgcatgtggtgcataaatcacgccgccttgcgcattgggatcagttgcggcgtacagtgctggcaatgccgcctgatctggcgactgccggagaaacggcagcaagcgaaaactcaacgcacccattcgcatcaaccacgcagttttccgtgagctgattgttttcaaactcgttgcggctaatcccggacttgagccagtcacggtcaccgactgtcctgcctctgtcaatagctgattgagcttaaccaccatcatcgcttgcgccagcttggtagtcgtataaatcgtccaagggcgatagtcatggccatcaaactgattaaaggtcaaatgtggtcgacccatggcgattgaggcaacgttaaccacacgggcatgatccgatcgcaatagtagcggcatcagttcgcttgttaagataaatccggcaaaataattcactgcccacatcagctcgaggccgtcacgggtcaaggtacgtttagcgggcatcatcacaccggcattattgattaaaatatccagcttaggaagcatcctcagcaggcggttggctaagtgtttagtggctgcttgatccgccagatcagcgcccataaacgtgacattttgttgaccggtttgcgcccttaacttggctgcagcagtgacgccttttgatgcctgtttgccaacgatgatcaccgtcgccccgtgccgcaacaaagcagcactcattgcaaacccaactccgctggtaccacctgttaccaccgcatagctgccgtgaagatcaggcatattcttttgcgtccaatgtcgtatcggttcccgcataggccactacctccgtttcaacaacaactgccatttgactgcaagaatttatgcctttttacgccgtttcaacatcacccgcaggttgccttgtgcacgctgaaattgaagaaactggcggcgcgtccgttcaaccatctggtagcgcttcggattctttttataaaagtcttgatgatagttctcggctggccaaaaagtcgcaacaggttcaattgcagtgatgattggccgcaaataacgcccagaagcagccaattcagccttagccgcttccgctatctggcgttgcgtatcgtctttgacaaaaatcacaggacgatattgactgccgcgatcttgaaattgccccagtgcatcagtcggatcagttaactgaaaataaagcgccactaatgctacgtagctcattttgcgggtatcaaaaataatttcaacggcttcaacatgcccggtatagccgccgatcacttgttcataagtgggatgtgcgctatgcccgccagtgtaccccgaagtgactgcggtgataccaggcaaatcgacgaatggttcaaccatacaccagaaacaaccgccagcaaaaatggcccgctcctgaaacggcacgtcgcgatcaaaatgggcactcaaatctgtctgcacagcccctgctggatcaccggtctctgctcgataaaagtcagccacatccggggtcaggttatcacgcatcgccaatggccgcaaagatgattcaagttgcgcccagccttccgccactggtcgcccggcctctaccaaatgtttggcctggcgcaattgttcgcgctcaaatgcacgcgttcccggtgcaagcatcaagttagtcaccttagctaaaaatacgtctcgctccatgtcaccagctccttttaaatgtgcttatcaagttaacgacgatgaataagcttgcctatttttactaagttatcacggtcacaaaaacgaggccagcccacatcttaaggcaagtatacgcgcgaacagcaaatttcgatagcgcacaacctttttgtcctgatgaacctaaccgagcctcctaacatatagacaactgcgcaactaaaaaagcatccatagtcgtcttgcctacagatgctttcccaatatttttaagataattcttcttttaatccctgatcacggaactcagtgttgtccatccagtcaaccttaaatcgcccgttgtcataggtaaccttgctaacactggcattcgtgagttcggtccgatttggcaaatcgccaccatgcgctcgtaaccacaggagactggccgtgccatggctgacgaccaacacattggtctcattcgcagcttctgcggctgtcacaattcggcgcatggcaaaatcataccgagaaaccacttgttgcgtattctcagcttgattagttgcatcagctgcgtgtatcccatcaggaatcgcttccagcggcattttaccgctgcgcacaagaatgtgataatccggaacaccaaaaacctcctgtgaaacatcttttaacgatcgtccttcaaaaacgccatcattttcttcacgcagtcctttgtcggtttcaattgccagctttacctgcatgcccagtaaaatttgttgcgcagtttcctgtgctcgaagcagatcactggcaacgactcggtcgatcatcaaaccgcttgcccgcaacccgcggcccaaagccaatgcctgtttacggccacgcgcattgagttgcgaattggtgataccttgaattaactggctgacattaccggctgtttccccatgacgaacaatatagaaatgaatcacgagctcctcctgtgtttccgtttaaactgcaactgacgctaacacccagcttggggcatctccacaaatatcacgtcctgaaatagccaagactgacaatgattatttaccgaaaatttcctctttcaaacgcaatccggttggtgtcgttgctaagccgccttcgcctgtttcccgtaaggtcgctggtaattgcatcccgacacgattcacagcctcaatcacttcatcagccggaataacactgatgcaaccagccaacgccatgtcagcagaaatcatcgcctgactggcgcccagcgcgttgcgttttacacacggcacctcaactaacccagcgactggatcacagactaacccgagcatgttctgtaaggtaatggcaactgcagtcgctgcttgctccaccgtaccgccattagccgttaccaacgcagctgccgccattgcactcgcagaaccgacttcctcttggcagccgccttctgcacctgcaattcccgcattattggcaatcactaggccaaacgcaccagcggtaaaaagaaaatccaactgttgatcatgacttagatgcaaccgatcacgcatagcaagcagaacaccagctaaaacgccagctgatcctgcagtgggtgtggcacaaatcaagcccattttggcattaacctcgttaacagcaaccgcattgcgaacagcctccatgatcggcttgccgctcatgaactgaccactggtgacataagcgtctaatttcttcgcctcgccgccagtcaaaccggtaacacttttgacgccagcgatgccttctttgacggatcgttccatcacttccagattgcggctcataagatggcgaacttgtgcctccgtccgtgtcgagttttcaacctcggtatgcaccattaacgcagcaacagatggaaacgcgtgactttgctcaatcaattctttgacggtataaaacataggcgactcctttatcaaaacatcagggacaacaattaaaaacgactgtcattcgaagtaagtgacattcaccatatgcggcaattgtttcaacttagccaaaatatcatcttgatagtcgtctgtttcaataatcatgatcgcctgctcgccttttgattcgcgagtcacagtcatggtaccgatgttaataccagcatcggaaaagattttcgtcacctgcgcgatcatcccgggaacgtcttcatgaattgtaatataagttggctgccccatactcagagaaattttaaagccattgatttcagtaatctgaatattaccgccgccaatcgataccccagtcacggctagccggtggtcgcctttttgcagcacgatatgcgctgtgtttggatgatcaactttgtcgcttttcggtacaaagctaaccttaatgccttgatcataggcaagcttcattgattcaggtagatgcggatcatccggcgccatgcctaataatcctgcgaccaaagccacatctgtcccgtggccgcggtaagtcttggcaaacgattcatacaagtaaatcgtgatcgtttctggtgcttcaccaaaaatatcgcgaaccacttttccaattcgggcggcacctgctgtatgggaactacttgggccgaccatcactggaccgataatatcaaacacactatgaaatcgtacatctggcatggcttttctcctttaacatgatgcagtttgctagctaatccaagtggtgaactaggcaaaataggcgttcgccaaaactttaccaacacgcgcaggcgagcaacaccacagtgtgattctaccaccctaaacatggcggcggacaggtttcgctgaattctcgcggcattctcatacaaagcattcaaaatgatccatttgcaggcgatcaccccgacattagacgttttgaaccaactgatcaaacattggtttaagggcgacaacccgctgttgtatgtcctgccaaagccgcacgggatctgcccaaatcggatcatctgccaaataaacttttcctagaaggaactccgcctttttaatcgtctgaaatcgagccccaactgtcgctaaattggctgaagtcagtggtaacatcgccttatctgtatgctcccctgccacttgccattttcccggtaaggttgttgccatcgcggtgatccccgtcaatacccgcgacgccggcttactttcacgtaaaactgacagccacaagaagagccgatcatcccaaaagcccagcgccagatgcggcaccattttgtaaccgcgtgaactggttgaaaacgcgacccaggtattcggcggcggattgcgatagcgacgttgatgcttcgcaatgtgcgaatagatcgcctgctgctgatctgtttgcagcagcggcacaatcaccgtggcggcctcagcaaacttgggatccaattgttcgcgaatcaaatgcattcgtgtcgccagcgttgtcgccttaaaaacggcgaaatcttcaagtgtaaacagaaccacaacctcttttccaagacaagaacatgttacaatgagggcatatgaatgcgtttaaaaggaggcaccattaatgtcagacgataatatgcaggaacatctgaacagcgcgatttacggtcccccgcagaccaaacccgatgaacgtcgagcctatatgggctctttgcgagaacgtgttgctctacaggtcaccaatcaagcattggccgaccccaaacgacaagcgcaagtgcagcctttactcaaagactttcacgctcatggttataaagcgttgctaaacgggaaactcgataatgccatcacaggcccctatatgaaaatgctcacggatgcgaatgtgccattcacgctggtggctaatgaaaccgcgcaaacagccgacaaggccgctggattgctgattgttgccgacacggcgattaatcaatcgaatgttgatctgccaccacttgagcaagattctgaaaagccgaaaaaacgtggctttgatttttttaaaaagttataaccaacatctgccgaacatgacggcagatgttttatttttcgctaaacagatacgtgagtaaagcaggtgcaattgaatgcgccgcgcccatatctggttgttgtggcaacattaagtcgggaatcggatcgacactgatgatgatagcttggccttcatgctcagcagcataggcgtcataaagattatcaatcacgaaatcaacggcggcaatcggcaattcaagcgcatcagcagcggcaaccgcaagttggttgtagcttggatcgatttcggttgtaacatcataaatatcgccacctgtttgcggatgcgccgcagaagcaaggaaaatctgctgaccgcgccgcaagacagtattcatcgtaaccgattgtaacttcaactgccgatttgctgtttcgtcaagtttgagctgtcgtgcattcggtcgcttaccatttttcaacgcaatcaattctttgattgatttacgaccatcgccaaccacattggcagcggcattttccaacacacttaccacacggcgacctataacagtaaaatgatacgttgttccccgccccatcatctcgaccaatacgccgtgatcttggttagcagcgtgaaaggcttgggcgaattgtttggcagttggcggcaccgcaaattgctcaacagcaagcccatgactacgctgttcaggtttcacgacgatacttttacgggcaaagctttgctcaaaagcagctttagcttcaggccaacgtgtgaacttggcgcctctggcaacaggtaacccagccgccgctaacacctttttggcggcatggcgatgttctgctaccaccatggcactagcaggtgtgcgactagtcaacgcaccgtcaatcaacacatggcgctgagtatcactggcaatctgcagaatgttctgtccccgatccagcaaggtccactgatacccgccatcaatcactgcctgaagcaaggcttgactgttgcctgacaagttactgaagcccggtaaatcttcttccattgacaaatctgcgtgggcttgcgttgctaacggtgtttgagctgctgaaatatcatgataagccgccgccacctgacccgcaatcgtcgtttctggcttcaggactcggctttgcatcaactcaaaagcttgttttcgttgcggtgtgaggccgacctgattcagccagaccgccatggcatcaatcggtgctgtcaaactcgcgaccggtgccgtgggatcgccagcagcaatcttctgtgcttctgccaaactatgcagacgcacctcagctgccgcgggcaatggaatcgctggttgactcaaagcaaaccagcaactgtcgattaaaaagttcaacatttgttccgtaacaccgctcgccgcataaggatcaagttccactgcaacatccaaagccaatgttcgcgctaagagatcagggtcactgaccttttgaaccagttgccgttcctgatccggcgcaggccaaaatgcccggccgtttttggccggtgaagcggcaaagagataagtcagtaacggcaattgtgtgatcaacccatcagtgaccaaatcataaatttgattccggtacgtcacataatcaggaccattcccttgaaaattttccgccgtataaagccgctcaaacaacacttccggcaaaacaatgcgaatgcgctgattattttccaatccggcggtgaaaaccggcagcttgccgttttctggcagcgctgcccagacgcggctgagtcccgcacgcaaatacgccacaacttcgctgggatcgtctaaaagcggtgtcgtcaactgtaacattgtagccgacacctgctgcaccaacgcatgccgactcgcattcgcccacactggcagctgctcgtcttccgccaacaccggcttcaccgtccgaatcaccccgattcgagtgtcgtcccgtaagccaaacaagttatttttctggatcagttgccaataatgattcaacatgtgtcattcctttatttgatgatctagaattagattaacacgcagacaacaagagcgcgagctggcgcgatcagaaaccggagcataagtggcatgaagcctaaatggttaggctttgaccatttaggcttcatgtccttatgtgtaggtttctgcgccagcgagcgcgtttaatcagagcgcgaatcagcccggtcagaaaccggagtgtaagcgggcctgagcgtgatgaccggactttggtcattgcgttcagggtccttacacgcaggtttctgggctaatgagcgcgtttaatcagagcgcgaatcagcccggtcagaaaccggagtgtaagcgggcctgagcgtgatgaccggactttggtcattgcgttcagggtccttacacgcaggtttctgggctaatgagcgcgtttaatctaagctgcgagctggcgcgatcagaaaccggagcataagcatccccgtgcaacaacaaccgcctattttaaagtcacacctctatgctaaactaagtcaatcatcttaaaagtacttcctatagttaatgtctattttaaaactgccacacacaaggagggttcgccttgcaacaaccgcttgcctaccgcatgcgtccacaaaatttagatgaagttgtcggtcaacaagaccttgttggcccagatcgcatcattcgtcgcatggtcagcgctcatcgattaagctcgatgatcctctatggcccgcccggtaccggtaaaaccagtattgccagtgccattgctggcagcaccaagtatgccttccgtattttaaatgccgctaccgacactaaaaaagatcttcaaatcgtggctgaagaggccaaaatgagcggaaccgttatcttgctgctagacgaaattcatcggctggataaaaccaagcaagactttttactgccattgctggaaagtggccgcatcgttttaattggggcaaccaccgaaaacccttatatgaacattcagccagccattcgcagccgaactcaaatctttcaggttaagccactgacgccagatgatattgcaagcgccatcaaccgggctttagctgatcacaaacgcggacttggtgactatcaggttgacttacagcctgacgcacttgattatctcacccatgcaaccaatggcgatttacgatcagcgttgaacgggcttgaattagcggtattatcaaccccagcaagcgatgacggcacgatcacaattgatctaactaccattcagcaaagtctgcaaaagcccgctttggctggcgatacaaacggcgacgcgcattacgacattatttcggcctttcaaaaatccattcgcggctccgatgctgatgcagctttacattacctcgctcggctaatcgccattggtgacctcaacagcatcacccgccgactgctggtcattgcctatgaagacattggccttgccaatccagccactgccagtcgcaccttgaccgccattcaaagtgctgaacgtctcggattgccggaaggtcgcattccactggctgatgctgtcattgatctttgcctcgcacctaaaagcaactccggtatcaaggctattgacgaagctctcgccgatgttgaaaacggcaatgccggccaaatcccagatgatttacgcgatgcccattatcgcggtgccaaacaactaggccatggtatcgactacaaactgccgcataactatcccaacggctgggttgcacagcaatatctgcctgacaaccttaaaaataaacactactatcagcctaaagccaccggcagatacgaagcggcactggctcagcgactacaacaacttaaaaactggcagcgtgatgcgcaaaagtctaagaaaaggtaacgtaagcgtttacgcttgcaactacttgccttcccgtgctactataactatgaaagttctaaggtgttcgcgcttccttaactatcagttgaccgaacagtatcgagaccttgggaccggaagagtcttggacggtgctgctatttcacttagcggctaatgtctctggcgtctgggcccacatagttagtagcgggtttcaacgatccgggaagaaaacggcaccaattagcctttcacaaaaaccaaacctgtttttggccggcccagtgccggctttttttgtggaagcgtgagctagcccggttagaaaccggagcataagtggcctcagccataaatggctgggttttgccatttatggctgaggtccttatgtgcaggtttctgggctggcgaacgcgttatagaaagctagcccagcgtcagttatagccttccgcaaaagcagcctcaagcgtgagccagagcgtttagaagttggcatataagtggccctaggcgtgatggttgcactttggccagcgcgtccaaggtccttacaggtagaccgaacccgttaatgtaaagtgggaacacgagcgtctaaaagtcactcaattttcagaaaaatccccccgccattccctgccagctatggcataataaagaaaacagataggaggactctcgtgactctcttgttaatgggcatttacgccgtagtaacgtttgccttagcagcctatacatggtcgcatcgtgaacaaaactttttgattattaagaaaccaacaccgggattaacccgttttcttaaactatttgcttgcctgtttgtccttgttggcattgctgctatcattggtggtcttttctttccgctctgggcaaatctcgtgattttggtcgttggtgccttcttagccatgattttcgtgctaattagtctgacccaaatgaagttgtgaaacgcttttcatttaattccatgattaaatcaagtacaatgaaggtagaggtgatgaggaatgttacaacaatatcaacatattttggttgcgatcgatggctcatacgaagctgagttggcattcaagaaagcggttgccgttgcaaaacggaatgacgcagaattgattctcattcatattgtcgacacccgcgcgttccagaacgtttccagttttgactcagcgatggttgaacaagtcacagaaaacgcgaagagtaccatggaaggctatgtggatcaagccaagaaggcaggattggacaaggtcagtttcagtattgagtatggcgctccgaagacgatcatcgcccgtgatatcccaaaggctaagaatatcgaccttattatgatcggcgccaccggtttgaacgctgttgaacgcttactgattgggtccgtcactgaatatgtgacacgaaacgcactttgcgatgtcttggttgtccggaccgatttggccaacaaaccggcactggcaagcactaaaaagccaactgacaacagtgataaataatcattataattttaatattcaagtaagataggtcattaaaacctgcttaaaaaataaaaaaatacctgagacatctggctcttaaatcagccgatgttttcaggtatttttttcgtcatagacggcagcatctatgaggatttttcaagctgtctcaatatttggtttttgcgagaccatttctgccactaagctcgtttccaaaggcgttgagcctgtcactcgggcaaatgcgatcgcaatttgataacttttagaggcatcggggtcacccaaaagcttgagcgcccttgcttgtaatgcaaacaattcatctagaaggaaaagtttatcgtgcttgactgcctctcgaacacccagatcagtgtatttgaggacggccttaaagtcactgagttcataataaattcgggcaatgtgccaataaattgtcaactcaacatccagatatttactgtcagacagtggcacgtgtttcaacatgcgtaacgcttgatcaatatagactcgagatcggtcaaacgtatgcttggcagcataggccaatcctaaccccagcgttgctagaataccaaaaaggtcacgttcggagttaactaacgggctcaggactcggccaaagaaataaatcgcctcatccggtgcattgtttttgaatagttcgataattccttgataatgatagtagcgcttttggtcatcatcattcttgatcttatccaaccgaatcttactcaaattctccgcagcaagtgcatattggtggtgctgaatctgaaaatcaataccggtcaacagttgctgaacacgatcatgatgctcgacaacaatgtcatccagctgaattcctaaacgaccaattaatcgcatcaaaatattcatgcttggcactttattacgcttctcaatcaagctaattgtagcttgcgtgcaaatatttgccgccagctcggcctgcgatagacccttcaacttgcgataataacggaccttatcccccaagatccgcagtgtttgctgctcctttcgcatacttatcactccccagtgtttcagttaagtgcatcaacatagaattttggcaaggcttaacccttaacctagagtcaattatacggataagtggttttaaaagctaataataacaactgatatttattcaatttttaaaaaatatctttttagattttgatcttttgtatctaaaagccacgagatataaattttataatataaatgcaaaataaaaatgcttattgattataagcatttttatcatcaactattcccataatatcggttagtttcttaatccgttgatctgctgcttgctgattttgagtgaaccggggatcacgtagcgggactgctaaggtatatagaccagcagcttttgcggcggcaataccaagcgttgaatcttccaccgcgatcgcttcctcagcagccacgtccagcacctgcagcgctgccaagtagacatcagttgccggtttagtgcgtgtgaagtcggcgccgctaagcaattgatcaaaatactgacgcaagcctgtctctgtacacatcttttcgataaaggtcagatctgaggctgatgcaatggcagttttgatatcatgctgcttcaaccattgtaaagttggccgtgcacccggcattacaatctttgcatacggaatcggatgggcctgtttgtaggccacataacctgcttgaagttgcagagcatctttcgaaggcgcaatgatgcgccaaacatcggccatattgcgccctaataacccagccaacttgcgatcatcggcttcaatccccacctgacgtaaataggccagtcgattttctaaggcacacggctctgagtcgacaatcacgccatccatatcaaaaataatagccttaatcaaagccgtgctcccttctattgaccatatggactaaaaaagatccacaatttgctgaatataatcggcaattggctgtggcaaatcagctcgcagggccaatgcttgcaacaatcgattgcggttgtaccaccgaacccaaaaactgtaggattcttgcggacgaacattcaccaaggcgtgctgccaattcttgagacacatcaataaagtttcactgtaaaacttattgacgttggtcaggctgctcagatacaaagccatgcgatgatcttccccaaaaacaagcggtgtttcaacgcgccgccaagcttccacaactgcggccatgagcaaaactttctcagctcgcggtaagaccccaacttgactcaattcttccagcatgttgccaatatgtgtataggcatgtgcccagcccttcttctcaacataaccacggccatctttttctaacagaatataaacggcgatattttgaacagtcgccaaataatcggctttagtcaacacgtggtaacgattctgatcagcatagatcatgccgcttagaatcatcagcgaaaaactgcgcaaaaagataccattgttttgcggttcaaaaatatgattgaacaaaatatccggtgcttgcagccgcttgaaaagcgttttaatttgctcattggtgaaggcctccgcatgaaacaaatcattgaacaggaagaaaacgcctttatcccgaactgcagggttggtacttgccaaatgtgctaccaaaaagtcaatctcatcatcagtcacgctgggatcacttgtttgcttgatccgcttctggatagctctgattttgacaatggccgtcttgtcgtctctaggtattttaatcggggtagcaggttcaactgccacgctctcaatcactttgcccaacatattcggtaatgctgtaaaaatttcgcctttattcagcaaatcgcgtagttgttgtaccgttcgctgaatcgtatcaagttgcgtcaaaatggacctcctgtaaatacgtgattgtcgtcagaaactaaccgcactttttgcaatgttcaactggcaaacggcttcacaaccggcgtgcgtcgccaacttataaaaggatgggtcgggctattttctgagtcgggtgcgccaatacccagccaaaatcggtttgcaaaacgcgcttagtcacgcgcatccccggttgattcataatggtgaaaggatagttgtgggctagggcctgcatcatgtattgattgaccagactttcgcccattcggccattaagaaaaattcgataaccaggataacgagtcaacaccgcatcaagcatggtggtgattcgtgcatcgcgtaactgcttaatcgtaatggccatcgcaactcgctcacgaaaattaccgagaaaagctcgcttttcgtctggtttaatcgttggaatccccagcgccattgtcttgataaaatgttcaagatcctcagccatggtacccctcctcgcgatcatggcacacgcaatagcatgcaaaaaattgagattcagtttgcaaatcagtaatttaattgtagcacccatgacgtgtgatcgctatcaggctcacgacttgttttgggggttcatagcttttatcctgacgcttcttgcaatttggccaaattaacaagccccttattctagcgatttcaataccgcttatttcgatacaaactggcaatcttctttacataggcctctggtgccttttcaatgccttcgtgacgatcacgataatgccaaatctgcccgatactgataccggtctgctgagctatttttgacaatgccgttgattgcaaaacctttcttgctttatcatagttatccatttgcggcctcctaaattagtgtggttttgttgccgcttctatcataaagcaaaaagttaggcttgcctaatatttttatgtcgaatgaaaaaagctggctaaacgtctatccgcaacctccagattgcagatgacaatttagccagcttttcttcaaaaatcgacattaaaataagaactcgatttcagcctacagacccatccatttccataccaatcagacgattcaattcaaccgcatattccatcggcagttctttagtaaatggctcaacaaagcccatgataatcatttcagtggccttggcttcagaaataccgcggctcatcaagtagtacaactgttcttcggaaacctttgataccttcgcttcatgttccattgacactgtggcattatggatttcattataaggaattgtatcacttgaacttttttcatccatcaagatcgtgtcacattctacgtggcaaaaggcattgtctgcctttttagtgaagcgaactgtgccgcgataatcaaccgcgccgccatctttggcaatcgacttggagacaatcgaactgctggtgtttggcgcattatgaatcattcgtgcgccattatcctgatcaacgccttcacctgcgaccgcgatacttaacatcgtaccgtgagcgcctttaccgtcaagatacacgctaggatacttcatcgtagttttgctgccaaggttgccgtcaacccactccatagtggcgttgtcgagtgcctgtgcgcgtttggtttcaagtgagaagacattcttgctccagttctgaatcgtcgtatagcggcagtaagcgtcatttttgacgaaaacttcaacaaccgccgcgtgcaaactgtcgctggaatagttgggagccgtacatccttccacgtagttaacatgcgcgccaggctcaacgatgatcagcgtccgctcgaattgaccggtgttctcggcattaattcggaagtaactttgaattggcacatctgtctgcacgcctttaggcacatagataaaactgccgccagaccacacagcaccattcaaagcagcaaatttattgtcgctaggtttaaccagcttgccaaaataatcatgcacgagctctggatactctttcaaagctgagtccatgtccataaaaataatgccgagtttttcgaattcatcccgcatgttatggtaaaccacttcagactcgtattgggcgctggcgccggccaaatatttacgttcagcctgcggaacgcctaaccgatcaaacgtatttttaatggcgtcaggcacgtcatcccagtcgcgataggttcgatccgtcgccttttgaaaataaagcatgttgtccaagtcaagatcggaaagatctggaccaaaattcggcattgccagccttttgtacgttgcataagcacgcagccgataatcgagcatccagtcaggctcatgcttctccgcagaaatagcgcgaaccgtttcctcggttaagccccgacctgtagaatacaccggcttgatatcatccttaaaatctgctggattgtcttctggcaaaaagtcgatatctgccgcgacagtttcattgtttttagtgttttttgtctcagtcatggtcttcacctttctgcgtcaagacttgcgccgctgctttccatgccaaagtggcacatttgatccgtgcaggaaattggtggacgccttttaaaaccgctgcatcgcctaaaatatcagcgtttggcacatccccgttaatgatcaaatcagaaaacgtttcgaccatttgttcaatgtctgctggcgttttgccaatgatctgttccgtcatcaggctagcactggcttgagaaatcgtacagccactgccagagaaggccacgtctgttacccggccggcatcctctttgatttgaagatgcaagacatcaccgcaacttggattgcgaaccgtaatttcatggtcaaaagctggcaaaaccccgtgatgtcgcgggtgttgtgcttcatccaaaatgaccgcccgatacatctggtccagcttagtcaatgccatggaaatacctccttgccgcctgaactgcctgaatcaatcgttcaacatcgtcagcattgttgtaaacgccgaaactagcacgaaccgtagctggcacccctagtcgcgccatcagcggttgtgcacaatgatgccccgcacgaaccgcaatttgctgctcatctaagaaagtcgcaagatcatgcgggtgaatcccagttaagttaaacgacacagtcgccaaacttgcttgattaccatacacggtcacatctggaatcgctgccaagccagcgcgtaactgatctgccaattgatgttcgttgtcaaatgctgctgcattcacagactgattaaaccacgttaaagcagcgcctaatccgatcacgccagcaatgtgcggcgtgccagcctcatacttaattgggccgtctgcccaagtactgacatcatcgcggacttctgaaatcatttcaccgccaaactgaatcggcggcatgtgctgcaataaatcagcgcggccatagagggcgccaatgccagttgggccataaattttatgcccagaaaatgcatagaaatccgcccccatagcttgaacatcaactgccagatgggctaccgcctgcgcgccatcaacaacgacaacagcaccaactgcatggactttggccgcaattttggcaatcggtaacgtatcacctgcaacattcgtcacttgcgccaccgcaaccaccttcgtctgaggcgtgatggccgctaataaggcagcaatatccaccgtgccatccggctttaccggcgtcactgtgaacgtagcctgctggcgcttggctaattgctgccaaggaatgaaattactgtgatgctctgcacccgtcacaacaatttgtgacccagccgcgacgacttgcggcccataagcactagcaaccaagttcaagctatcagtggtcccgcgagtaaaaataatctcgtcagcactcgccgcacctaaaaagccggccacttgttggcgtacgttttcataagcctcggtggtgtcataagccaatttatacaagccacgatgaacattggcattatcattgacatagtaattttgaatagcatctagtaaagcttgcggtttctgagaagtcgccgccgtatctagatagaccagctcgggatgagctttaaaaaatggaaattgttcacgcatcttcagccaccagcgttcgatcaatcgttgcgaagagttctttcttcagtcggacatcatcaatttcagccaagccgccttcaaggaaaccgcgaatgaccaaccgtttcgctaatgtcgcagataaaccacggctcatgagatagtatagctgatcagcattcacacgcgtcactgaagccgcatgtcctgcggtgacgtcattttcgtcaattaacagaatcggattggcatcaccttccgcatgtggcgacaacatcaagactcgattttcttgttgggcatcactgccacgtgcacctttgatgatgtgaccaatcccattgaataataaatgggcactgccagtaatgacgccacgttggttaatatgccctactgtgtgttgcgcttcattggttaccgaggtcgtgtaactgacatgttgacttcctgccgcaagcacacccacgttgacggttgcctcggcattttggcccaataagcggacatccacccggttgaggccggagtttcgcgaaaaccctgccaaggtccaattcaatttagcattggcaccaagcgtggcggtacggtttacaatcacggtctcagctgtaaaactgtcataactcagccagctgacttcggcatcggcatcaataaccaacacaagccaaacgcctaaaacattgccgccgctcgcccatttttcctgaatcgtgactttagcgcctttgccgacatgaacataaagcagtccacccgcttgcttaggaccagtcaagacaatcggctcatcaccgcttacaaaatgggccggaatatcaatcgtggtcgcgccttgggggtgtgcaagtaaccaagcatccaatgacgtgactggggtgaaccgttgaacctcactggagcctgctgcataggcaaccgattgcggtgcgtgtagaatcacacggtctaggacggcatcaggctgaagttttaaataccgagctaaaggaaacttgggcaagttaggtgccggtaaagtcactgcttcagccattttgatcacctactttaaggtgttcgtagccagtcttctccaattctttagcaagttctgggccgccactttcaataattcggccacctttcatcacatgcacaacatcgggaatgatgtaatccaatagccgttgataatgcgtaataatcatgctgccaaaatctggtccacgcaataagttgacgcctttggcaacaatccgcagtgcatcaatatccaagccggaatcaatttcatccaacaaaccaaagtgcgggtgaatcatcatcaactgtagaatttcattgcgtttcttttcaccaccggaaaagccttggttcaaatatcgatccgccatggattccggcatttcgagggtcgccattgtgtcgtccaattgctttaaaaagtcggtgatgcgaatctgatcatcttctggccggcgtgcattgatcgccgcccgaataaactcggcattggtaacaccagcaatttcttgcgggtactgcatccctagaaaaagcccggctcgcgcgcgttcatcaactgccatgtctaaaatagactgaccatcaattaagacatcgccttgagtcacttcataagcaggattgcccatgatcgtctcggctaatgttgattttcctgtcccgttcggacccataatggcatgaatctcaccagtcgctaactttaaattaacgccggtcaaaatctccggatgctcaggttctgctttaattttgacatgtaaatccttaatctcaagtgtgtgcacaatgatacccccgactggaatttgacttttagttatatcgccattctacgtcataaaaagaacagcggcaaacgcgttcaaaaaaaagcagaacgctatcacgagttctgcttacaaaacgagttttaaatttaatgatgggtttttcgtgcgaagaagtcaccgataaattgtaccaagaaaacgatcgccagaataaagattaaggaaacgatgatgacgtcgtattggtaacgttggtaaccgaccgcgatcgccagattcccaaggccgccgcccccaactgcacctgccatagcggttaagccgatgacagagatgatcgtcaggactgaaactcggatgagttctgacaaaccttcgcgcaggtaaacccgcaacacaatgccaagcggcgaaacacccattgcttcagctgcctcgatgacgccaggatcaactgtcaataaggcattttgaacctgccgtgcataaaacggtgtggtccctgcaattaaaggaaccaaggctgcagttggtccgatccccgtcccgacaatggctcgcgtcacaggggtcatgattgccagcaagatgatgaatggcaccgcccgaaaaatgttaaccagtttatcgaggataaaataaaacggttggttggctagtaaaccatcttcatcggttagaaccagcagaattccaataacaatcccgagaatgccggcaacaactgctgtcaacacagtcatatacaacgtttcgttgattgcctgagtcaccccgccgtcacccgaccagataggcaccacgttaggaaaatattttgtaaagaactgtcccatctgtctaggcctccttcttaagaatgtcttcaatcttgacatcctgctgtttcaaatacgcgattccggattcaacttcatcatggtcaccggaaagaaccacaattaagttgccaaacggcgtatcctgtaaaatctgaatgtcaccaaacagaatgttcgccgtgacatgatagctactaaatagcttagccaccagcggttgatcggctgaatcaccgacgtaggttaatcgtaaaagacgatcatccggccccagatttttcacggtcggctgctgcatgacagcatcaatcgcctgatccagttgcaaagtagtatcaatgaagtctttggttaactgttgctgaggattggaaaagacctgcaacaagtcaccgcgttcaatgattgccccatcatccatgaccgccacacgattacagatctgcttcacagcttccatctggtgggtaatcagtacaatggtcagtcccagtcgttgattcagcgactggagcaactccagaatagaactggtcgtctttggatcaagtgcactcgttgcttcatccgaaatgagaatttcaggatctgacgccagcgcgcgggcaatcccgacgcgttgcttttgtccacctgataattgagcaggataggaattagcacggtcagtgagtccaaccagatcgagcaactccgcaactttcttttggatcgcttgcttcgatttgagtccttttaatggaaaagcaacattgtcagcaatagttcgactgttcatcagattaaaatgctgaaaaatcatgccgatacgtttgcgttccttgcgcagctgcgccggcgacaaggccaacatatcctggcctaggacgttgacgctgccgccagttgggcgctgcagcaagttgatggtccgaacaagtgtggatttgccggcaccagagtatccgacaatgccgtaaatatcaccgcgattgaccgttaagtccacatgatcaacggcatgcaccgagcgagttttgccgtggaactcaacgtccacatcttttaaagtcacaactgcttgatctgacatgattgtccccgtttctaactaaaacttatagttccaagccggcaaggttgaacctttgtaaactttcttcaaaagatcagctgtccgctgtgtctgataggctttcacgatcttcttataggtcgcattgtccttgtccttggctgacttggcagcaatgaagttcacccaaggcttggacgccttagtaatcttttcaactgcgattgcgttagctggcttcagattagcggcagcagcaatatcattgttgacaacagcaactgcgacatcattcaaagaacgggctgtttgagcggcatccaattcagtaaacttcagattcagcttattttcagtgatatcgcgaatagtcggtgaagctacaccctttttcaacgtcagcaagccattttgtgccaacaactgtaaagcacggccttcattggaaggatcgtttggtaccgagatctgatcgccgttcttaacgtccttcaacgatttgatcttgttggagtaagcgcgcatcgggccgatgtaggttgcgccgatatcaacgatcttggtgttgtgtttcttgttccagttatccaagaaattgtgatgctggaaggcgttgagttgaatatcgccatcttccagtgcttggttaggctgattatagtcagtgaactgaacaagtttgattgtcacaccctgcttcttcaaacgtgattgaatatcagtccaaatttctttatccgtgctcatgatgccaactttaaccgtggtattcttcgttgaactagccgacttgccacaagctgctaaaacaaatactggtaaaatcagtgcaaacgtcaaaattgcctttttccaaaatttcatgaactttctcctcctcgttcaggtaaacaaatgatgtgtgcaagcgatgaaagcattcaaaaaggctcgcctctaaaaacaagttttagaagcgagcctagctcgcggtaccattctaattcgacgccatcgcgtcctcaataacaggcaatcacctgtgtgcggattaaaggccgccagccatcatcgcttaaccactgctcagcgatgccgatcaatgagccatcttcgatccaattaactaccctgctctcagctacccaggttttctgtacagtctgattagatctactcactcacgtcattcgtttcccgaaatgaattaaatcgattttagacgatgattaggtaaaatgtcaagataaagtactcagagcgtgaaccagcccggttagaaaccggagtataagtggccacaagtgtgatggccggggctttggccattgcacttgtggtccttatacgcaggtttctgggctggtgaacgcgtttaaatcagagcgtgagcagccgcgttcagaaaccggagcataagtggcctcaagcctaaatggctgggccttggccatttaggcttgaggtccttatgtgcaggtttctgcggctgcgaacgcgttttcgcaatgcgactgatactttttcttcagttttattccagtaaagcatctcccgtagtccgagctggctacgcggcgaggagggctggcgaccgcgaagctagagctgtgggcacagctttgaactcacgcaaagcccgcgcgatttcaaagtctggccttgttgtaagcggtaaaccgccaacaacaatttcacggctgagccccctctccgctccgccaactctctgctttctatcctagaattcaactcggattaccctcaacattgcttacttatataccaactttctcaactcaccattaaaatttctgcgtccaagctgggacttcactgccatgataaagtttctcaatcaagtcagcgatgtcttttgttcggtatgctttgacgatcttcttgtaagtagcattatttttatctttcttgtttgcgacgaaaacgttaatccatggttggctttgcttgtcgactttttcagtataaacagccttcttgggatccagtttggcatcgtgtgcaacgccagagttgacgacggaagcagccacgtcaggtaaggaacttgctgtctgggcagcatcaacggccttcaactgaagatccaatttgttttcggtcacgtctcgcgtggttggcaaggcaacctttttgttcagtttgattaaaccagcagtttcaagtaactgtaatgcgcggccttcgttagtcggatcgttaggaagtgcgatggtgtcacctttcttgatctggctaattttagtgatttttttggaatagatcgctagtggtgcaatgatggtctgcccgatgctgactagatcagccttgtgggttttgttccagttattcaggaaatactgatgctgaaacaggttcaaatcaatatcatgatcgcgcaaggcggtgttaggctgattgtaatccgagaactgtacgatcttgatcgtaatgccctcttttttaacctttttagcaactgcttgcaagacgcgattatccgcgccaacgaccccgatcttcaccgtcgtttgcttttgactactggacgaactgctgctacttttaccgcacccaaccaagactaatcctaaaacaaaaatggttgtcaaaattttccaaaaccgtttcatgtcttctcctcctaaatacgttcgccaacccatcaatctacgcataagtttcctagtggccaaaatacggctatcacgtccccgcctattgatgcttcggtttcttaccgagctgactcgcgctctctaaaatatgtgcgtcggcctgcagtccgaggcgcataaacttgccattgatacaaaaagaccgaaaaaaaactcacttctaacaaattatcaatctttgttagaagtgagctctggcccacggtaccattctaattgaccacacaaaacgtgatccactcagcggacgaattcatccgggtgcacgataatgggtgccaaccatcacagcctcgcaatttgctcggtgtgccgtgtgtgccaagccatcttcatttccgctagcgaccctgctctcagctcatcaggttttctgtactgcctcgcggtaactactcactcagtccgtttacaatcaatttcaagtttgtacaagtgagcttatcacaattttttaacttgtcaatcattgaattttaaatcaaaaagagtgtaagctgtgctcaacaaaactcgcgcacaaagtctgcaacagctgactgtcgcgacaaaggatggtgcaatcatgacagaaccaattgccctgctccaaaagctgattcaaatcaattctgtaaatggcaacgagctcgccgtcgccaaattgctgcaagccgaacttgaggctgccgatattcctaccaagctgatcccctacacagaagaccgcgtgaatttaattgccgaattaaaccatggtgatcgcgttctcggtttcactggccacgaagatgttgtgagtcctggagacgagtcagcctggacgtatccgcctttttccggcaaagtcgtcgacaatgtgatgtatggtcgtggcaccgatgatatgaaaagcggtttagccgccatggtgctggccctgatcgccctcaaacaatccgggttcactcatccgattcgcttgattgcaacggtaggcgaagaatacggtgcgatgggcgcacgtttgctgacagagcaaggctatgccgatgatctcgctggcttagttgttggtgaacccaccactaaaatcttaaaatacgcacatgctggcaccgtgaattacgagattgacagtgaaggcgtctctgtccatagttctaggcctgaaaaaggcgtcaatgccatcgatggtctaacaacttttgccgcactggaacaacacgcctttgacaaggcgcctgctgacccggatctcggcccatttcgacattcaatcacggtcatcaatggcggcgaccaagtcaacaccattccagcccacgctttccttcgtggcaatcttcgcccgaccccatcggccaatattgagctggttgtgaaaatgcttgaagacttagtggcacatgtcaacgccacgaccaatgcgaaactcacgttgaaagtattgcaccgttttctgccggttcactccgataaaacaggccacttggtaacttcggcaaatgctgccatcgcgtcggtaactggtaaaccagctgaattagccgttgcgtttggaggaaccgatgcttccgagttcatcaaatcaactaaccattttgatgtgattgtctatggccccggtgataaccacttcagtcatcaagtgaatgaacacatcgacctgaacagttacacaacggcgatcaaaatttatcaagaaattgccaagcgcttcttcgaataagccgcgctaaatcacaatgtgccatgcaaaaagccgaccgtcattttaaaaatgcgggtcggctttttgattagctatttggttgaaactgtcacaacccagttttggttatgatcggtttcgtctaacaaagctggtttatcactcaattcctgatgcacgtccacaattgttcctgctaacggtgcctcaagatctaaaacggctttttcggcttcaacacttaaaaaaggtttgccggtggtaaggctcgcgccaattgttggcaaatcaacatacttgattttgcctaacgtttcttgagcctcttgggtcaagccgagacgaatttgcccggcagccagttcatcttgccaaaaataagttgttgccattttgctctcccctattcaaaatcttctgtgtcgcgactaaacatgtagctcgtatgatggtagcgcatcgacaagaccatcccgactgataacatattagccaacaagaatgaaccaccttgtgaaataaatggtagcggaatccccgtcaatggtagtaacccgatgttcatgccgatgttttcaaatacatggaataggatcatcatgatgacaccagtcgagatgtaagcataaaactcattttttgtgtcaaacgtgaccctaatcatttggtagatcaacataaagtataacagaatcaaaaccgcagcacctacaaaaccgaaagcctcgccaatcacggaaaagatcatatccgattctcggactgggacaggcactgcaatgtgcatcggccctttcccagtcagttgaccagaaccgatagccttcatcgattgccacaactgataactgtcgccagttgtactaccagaagggtttaaccacgaatcaattcgggcaaattgatatgttttaaagccgatactaccaagaatagatcgaccccatgtctgcgtcactaacagaatgccaactgtcccgataatgccagccacaagtgcaatcggcacgagaatgcgccaattaatcccggcaaccaaggtgacaccagcgaaaatcgccagaaaaacaagtgtcgtcccaaagtcattttgaaatttcatgaggactgctatcggtaatgtccacaaaaccatccggccaattaactgccaatcgtgttgaatggtatgtgaaaaagcagcattgtgttgggtcacaacgcgactcaacatcaaaatataggcaggtttcatcacttctgacggctgaaaactgatcgggccaagggcaaaccagcttttcgcacctgtactggcttctgtgttgcggtcataaaaaatcaataccgcaatcatcagaaaaatgccaatcccgtataaataaggggcaatgcgccaaagctgctccgcatcaaatcggataacgaaaaaaatgccgataccgccaatcacataccacgccgcctgcataaccgtggcacgaacaggattctgtagcgtagaagtatcatgagcggtggccagatagatggacacaagcccgatcaaagccagtaacatgactgacaggatgatgccataatcaatccgatcaccctctgagtttgatttgatttcgtgtgactccacgggctgccctcctttaaacacgttcactgacgcagaaacgtgcacataacagccttgaaactaaagggtcaaaacccaacaggtcgtctcaaggtcgcctatgtcccggtttctgaacgtgccagttcacgctcttgcctaaacgcgttggttcacgtttcgttcttaaaatgccttcgattttcgcaaaagcatattctttactagctgaatgttgatgataaaaccgttcaaataccgatttacctctaaaatcacggtgcactggatgttgcgatgcgcgctgccagagttgtttcagccttgatgtaaatggtattcggcaatcaacgcattaactgcggcatccagtgttttgaaccggttaggcttagtcgagccggctacaaatgctgaaaaccgcgtgccgtccggttcaataaagccaatctcccggtcaccgatttttaaaaccgaaactgtatgaccatttcgagtttcatctgcctgtgtgaccttgatatttctttccttagccatgacggcctcctagcttatgattgagattttgaatgtcactaagatccaagtcattttcgggatgcggattacgccgcaaagtgaaaaaagctggcactggatcaagcccgcctttaacaaaggggttgcaccgtaaaatccgggcaatccccattaaggaacctttgatggcgccatgtttctgcaacgcctgaatcatgtaggttgaacatgtcggataatatcggcagctcggcggcagcaacggggaaatgaagcgctggtagccccgcactaaccatgtcagaacctgtttcatgaaacactcctaacgcagaaacttaaagaagtgcacccatgttgatggtaggaacaacttaagcggattaccttccccaagagcaaagccaatcaataagcccaatatcagtgcgattaaggctatcatcagccaaattttaatgatgtggaagatgcgtttaggatattgtgagtccatagctcgctcctagtactggcgatggtgttcaatattatcgagtaaaacaccggtcccaagtgcaactgcatctaaaggatcgtccgccaacaacactggcactttcaactctgcagcaaaaagttgtgaaatacctttaagcaaggcgccgccgcctgtcagcataatcccacgatcaatgatatccgcagacaattccggtggggtcttttcaagcacaccttttgcgccttcaatgatcgccatcatcgtctcatgtaaagcttcagcaacttcaacagatgtcaccgaaacttcgcgtggcaaaccagtcgcaatatcacggccacggacttcaatcgtttctatctcatcggcttcgtaaacggcaccaatcttgattttgatctgttccgcggtatgctcaccaataattaacttatgcttgttcttcacgtaggcagcaatggaggcatccattttgtcacctgccaagcgcagtgaacgactcgtgacgatttcgcctaaggataagacagcaatatcactcgtcccaccgccaatatcaataaccatattgccttgtggttggaaaatatccaatcccgctccaacagccgctacttttggctcgaactccaagtaaacatggcggccgccagacttttcagctgcctgaataatcgctttctgttcaatatccgtaatattggttggtgcacaaatcagaatattaggctttgaaaaaacaccttttacatttagtttattgataaaatattcaagcattgcttcggtaatgtcaaagtcagcgatgacgccatcctttaacggccggatcgaccgaatattacccggtgtccgtccaaccattttataggcttctgtccccaccgccagcactttgccggtatgggtatcaatggcgacaacggagggctcatttaagacgatgcctttgccttttacattgatcagcacattggccgtccctaagtcgatcccaatatcttttgccatgggtatatatctctcctcgtaaattgactaactatcgcattataccatagttaagacgaggtttttacaggaaaagtttaggtaagtttaaagctgcttgtaagagtgatagaaagaacgaactgactaagaatcctagcgcaaccgcaatgaagagtaacaagacctgtgcctcacgaacatggttggctttgatgaactgttcaaagcgcaaggcattgagtgcacggaacgcgagcatgatgaaaacaaaatgcgacacgattgtaatcgcgccgtttaaaccgattgtctgaaacatatgatcacctcatgaggtatcttcccgcagaacacgataagacgcaagcagagcgtgaacaggcgcggttagaaaccggagcataagtggccttgattgcaggttttgctaactttcatcaagcagcaagcaaaaagcagtcctctccaagttgggagagaactgcttttcatgtttaatgactggtcttgacgttaattcggttgatggcccgtcgcagtgcgacttgtgcccgccgaagatcgtcttgattatgatcattctttgcttgagcaatgcgcttttgagcacgatcgcgcgcagcttgcgcacgactgagatcaatatcacgctcacgctcggcagaatcggcgacgatggaagcaacattttctgatacttccataaaaccgccgttaaccgcaattgaatcgttgtgatcactggcgtcaacacgttgcacgtcaacctcaccgatctcaagtggtgtcacaattggttcgtgattagccataatacccaattcgcctgcgacagaatgaacaactagcatcctggcgtgatgatcgtatactaacccatcaggcgtcacgatgttgacccgaagaacgttgctcgtttcagccaaaacgcgtcgcctccttagttagctgcagcttgtgcagccggcttttcgtcagcatccgtattctgatcgtcaggagcaaagcccatcttcttagccttttcgacaacttcttcgatgcgaccgaccgaacggaaggcatcttcagggtaatcgtcgtatttgccatccaagatagctttaaagcctttaaccgtttcttcaaccggcacatatgaacctggctggccagtgaaccgttccgcaacgttaaagttttgtgacaagaagaactgaatccggcgagcacgggccacaacgaccttttcttcgtcagacaattcatccatccccaaaatagagatgatatcttgtaactcacgataccgctgcaaaacttgttgcacttcggtagcgactttataatgttcatcaccgacaatttccggcgtcaatgcactagaagatgattccagcggatcaacggcgggataaatcccttgctcagtcagacgccgttccaagttggtcgttgcatccaaatgcgcaaaagtcgttgccggcgcagggtcagtgtagtcatcagcaggcacataaattgcctgaatcgatgtaactgaaccttttttagtcgatgtaatccgttcctgcaactgacccatttctgttgccagcgttggctgataaccaacagctgatggaatccggccaagtaaagcagaaacttcggaaccggcctgagtgaaccggaaaatgttgtcgataaacagcaggacatcctgaccttcaacatcacggaagtattccgcgatcgtcaatccggtcaaggcaacccgcatccgggcaccaggcggctcgttcatctgaccaaagaccatggctgtattctccagaacgccactttccttcatttcgaagtaaaggtcgttcccttcacgggttcgttcgccgaccccagtgaaaacggagatgccgccgtgttcctcggcaatattatgaatcagttcctgaatcaaaacggttttgccgacaccagcaccgccgaagagtccgaccttcccaccacgcaggtaaggttcgagcaaatcgatgactttgatgccagtttccaagatttctgaactggtattcaaatcttcgaattttggcgcatcacgatggatgctgtcgcgccgatgatccggtccaaaggcttcaccgccatcgatggggtcgcccaacacattgaacacccgacccagtgtgtcttttccgacagggactgagatcggaccgccagtatcttgaaccgccatgttgcgttgcagaccatcggtggaatccatcgcaatagtccgcatcacgccatcaccaagttccaaggcaacttccagcacaagctgggagccatccttcttggcaacggtcaaggcgttattgatttctggcagatcgccattgattgggaaggctacgtcgacaacaggaccgatcacttgcgcgattttaccagttgaatttggcattttcgtcctcctgttgtaaattgagcgcgagctggtgcgtttagaaaccggagtgtaagtgggcctgaacgtgatgaccgcactttggtcattgcgttcagggtccttacacgcaggtttctgcaccagcgagcgcgttatgatgaagcgcgagctgacgcgtttaggaaccgaagtgtaagcggccttggctgggatgaccgcactttggtcattgcggccaaggtccttacacgcaggttcctgcgtcagcgagcgcgttatgatgagcaccgagctggtgtgtttaagaaccagcaccagctagcgcgtgattattctagtgctgccgcaccaccgacgatctcagtgatctcagtggtgatcgcagcttgtcgggcccggttatattgggtcgacagatgtgagatcaggtcattggcattatcagttgcgctacgcatagcagtggtcgaagcggcatgttcagccgttttggcatccataatcgcgccgaaaatcagactttccgcatattgcggcaaaactgattccaaaaccgagtcaagatctggttcaatcagatactcaacattggtatcggccacttcactgacatccaaatcactgatcggcaacattttctctgcacggaaagcagaggtcaaagtgttgacgtgatggttgtaacaaacgtaaagttcatcaaacacaccattgtcaaacatcgtcacagctgtttttacgatttcccgaacttcattaaaagtcggaatgtcagaaacaccgcgatattcataagccagattcaggccgcgtgctttgaagaaatcagcaccgacaccaccgatggccatcatgacgtaatcgtcaggactttcatggtcatctttgatcatctgcatcatggcttttaaaaccgtgctgttgtaactgccaaccagcccgcgatcacttgtgatcacgagatagccggttttcttcaccggccgcttctgaagcaggctagcaacggagatgacctgactcttgtcgcccgaatcggtatcactttctgcagcgttggctaactcaagaagctgcccagcagccaaatgggtcacaatctggcgaaccttatcagaataaatctgatacttttttgcccgcttttcgatctgacttaacttggccccagaaaccatctgcatggcttgcgtgatctgaccggttttcttggtcgatgcgatcttgcgcttaatgtccattaatgattcagccatgcggcacctccttagtctttcgctgcagcaagttgtttactcgtttggaatccgccggcaaaagccttgatttgtgcatcaagtttatcggtatccggtaaattaccggtgtcacgaatctgcttgagcaaatcagctgcattgctatcgaagaaatcaaacagttcatcttggaagcgagtaatgtcttcaatcggaattggatcaaggaagccatgggttaatgcgtaaagaatgataacctgcttttcaaccggtaacggtttgtgaacaggctgcttcagcacttcaaccgttcggcgaccacgattcaacttagcttgcgttgctgcatccaaatcagaaccaaattgcgtgaaggcttccagttcacggaaggatgccagatccaaccgcaatgtcccggcaactttcttcatcgccttgacctgcgcatcaccaccaacacgggaaacagaagcaccagcatcaatggctggacgtgtacccgcatagaacagatcgctttgtaagaagatctgaccatccgtgatagaaataacgttagtcgggatgtacgcggaaatatcgcctgcctgagtttcaataaccggcagcgccgtcatagaaccgccgccgagtttatcactcaatttagcagcacgttccaacaagcgactgtgggtatagaaaatatccccaggataggcttcacgaccaggcggacgacggagcagcaaggacagctcacgatatgaggttgcctgtttgctcaaatcatcatacacgatcaagacgtgcttgccgttatacatgaactcttcacccatcgctgcaccggcataaggcgcgatatacagcattggtgcaggttcagatgggccagcagtcagcacgatggtataatccatcgcaccatattttttcaacgtttcaacttgagctcgaaccgtactgtccttttgcccaatcgcaacgtacacacagatcatgttttgatctttttggttcaaaatggtatcaatcgcaattgatgttttcccggttttccggtcaccaatgatcaactcacgctgaccacggccaatcggtaccagcgcgtcaatcgctttcaaaccggtttgtaacggttctgatacggatttgcgttgcataacacctggcgccttaaactcgatcggacgggttttatccgtcttaatcgcgcctaaaccgtcgaccggctgacccaaagaattgacaactcgcccgatcatggcatccccgacaggaacttccatgattcggccagtgcgtttcacttggtcgccttcgcgaatctcatcgaagtcacctaagataatgatcccgacatcgttcgtttcaaggtttaacgccatcccgtatgagccgttgctaaattggagcaattcgttggccatggcattttccagcccagtcgcacgtgcgatcccatcaccgatgtaagtcacagtgccgacttcttcagccgccaaatcgtcctgatatccttcaagttgttttttgatcagagaactgatttcctcagtcttgatgctcatccggttcacctcttttacttactcattagtctgccagcagtgcagctttcatcttatcgaaacggtgcttgaccgtaccatcgataactgaaccgcgtgcttgaattcgcacaccgccgatgacacttggatcaacgacttgatccagttgggtcgatttcatgccaaaacgcgcagcaatggtactgcgcaaagcatcagcttgatctgctgacaaagcaactgcagtcgtcacagtcgccgcaataatcccggcttcctcatcgtacgcttggttaaacgcgctgatgatggctggtaatgctccgaatcgcccatattgctgggttaacttcaacaagttagcgaccagcgggctagcatccttggttaaggttgtcatcaaggcatctttatcagctgccgtgattcgagcgttatcaaaaatagtcaagatcgttgggttgtcgttaaagacagactgtagcgcttgtaactcttcatggaccgtctccacctgattttgatcttgtgccgcttccaataaagctttggcatagcggggtgcgaccatctgattagtgactgccatttgcatcacctaaccgtttaatatagtcatcgatcaaacctttttgatcgtctgcattgagttccttaccgatcagtttttgcgcgatggtcaaacttaggtctgccacatcatttttggcactggccaaggcatctttacgtgcttgatcaatgtcggtttgcgcattcttcttcatcgcggtgacttctgcgttggcagcgtcgaccaatgattgccgcagtttctcgccattttccttggcttgattcacgatcttaacggcatcggcttgggagtgttgcagttcttcttgacgtttagctactaaagcatctgcgtctttgcgtgacttttcagcataatccagatctccggaaattttctgctgacgatccgccatcatttttgaaactggcttccaggccactttcccgacggctagcatcagaaccagaaatgtgactagtgtgaagagtgtgtcacctaaagtcattttttgccactcccttctttattgatgaaccagattaacgactcatcaacatgaaggcaacaacgacagacaagatcggaacggcttcaatcaagccaacaccgatgaacatagtcccacgaagtgtcccagccatttccggctgacgagccataccttcgagggttttgctgataaccatcccgttaccgattgaagcaccgaaggcagcgatgccggcggcgattgatgcagcgatgaattgcataagaaatttcctcctaatttagttactcggacacaattttgtgtgatgtgtaaaccatcccaagcgtgacaaaaacgtacgcttgaatactaccaatgaagactgagaacccttgccacagaacctcaagcaagaatccggagacgaagctgacggccccgcctgagaaagcaaattgcctgatgagcaggactaagacttcgccggcgaaaatattcccatacagccgcatggagagtgtaatgaaatttgtaaactcttcaagcaggttgatcggaagcaggattgcgaccggtgacgcataccccttgagatatcctttgaaacccttgaagacaaccccgaagtaatgcgagaggaccagtaccatcatggccaacgtcatcgtgatgacaggcgacgcggtcgcagaacggaaccaagtatctttgccgatatcgacttcaaggaataacccaatttggttactaatgaaaataaataagaagagcgtaaacgcaaataaattaaaagtataacgctccgaaccaggcatggtacctttgacgataccgttcgtaaagtccatgatccattccagcacattctgcttgccgcctggcctcatcttaaggttgcgagacagccagaataccagtaagaataccagaactgccgaaaccaaaacgccgatgtcattcgtcaggttaaagcttaagccaaaaagcttgatcgagggatattgttcgttcacagaattcacctccttactgaagtgacgtcatatcatttgtatcatcaaaatgatgatgcacgattgcggagacttcgataatcgttgtttactagggcagacccctgaaacacaatcattactctaacaccatttcacctaaaagacaaagcactgaaagcagaaacttttgccgccatagcggctttttcatcagtgttttcatggctttgggcggcttttgaccatctatttttgcggctatgaaaattcttttgaagaaatatgaaaaaggcacgtgcttttacacatgccaaagaatgtcattttgtcccaaaaagtctgtcgcctgcatctccaagacccggcacaatatagccattttcgttcaaatgatcatctaacgctgccgcatagatatcgacatctggattggccgcctggacggctttaacaccctccggcgctgccaccaagacaactagccgcattgatgtggcaccgcgcttcttgagtgcctcaatggccatgttagctgatccgccagttgccagcattggatcgacaatgatcaaatcccgttgttcaatatccggcggcattttaacaaagtattcatgcggtttaagggtcttctcatcgcgatacatgccaatgtgaccgacttttgcggctggaatcagccgcaaaacaccatcaaccatccctaaacccgcgcgcaaaattgggacaaccgcaagcttcttgccagcaagctgtttttggatagttttacccatcggtgtctcaatttcgatactttcaagtggcagatcccgtgtgatttcatacaccattaattccgcgatttcattggcgatttcgcggaactccttggttccagcatgcttgtcccgaatcagggtcagcttatgctgaatcaacgggtgattcaaaactgtaaatttgcccatttggcgcctcctaaacgcattcttcatcctagaaaccgctatataaaggtcttagtcgccatgtgctacagtgagcatcacgtcctaagccctctgatagaccggtttcaaaagaagtcaatcacgttttctttgataatcatttgtttgcaaaccctaactatgataaaggatgacgggctgtcagtgcaagcacttcttgatgaatctggtccaaagctggctgatcatcacgctgggcaatcgaggcactgatcaattcgccaactcgtttgctctcatctgctgtaaagccgcgagtggtaatggcagccgtacctactcggataccgctggttttaaacgggccattctgctctcctggaatttgatttttgttagtcgtgataccaacttcatccagtaaatcttgaacttggcgaccatttacgccataacccgttacatcaatcaagaccatgtggttatcagaaccaccagaaatcaaccgcaaatgcggatcttcttcaaaaccactcaccatcgcctgcatgttatccagaatatgctgagcatatgttttaaaagatgtctgcaacgcttcgcctaatgcaactgcttttgctgcaaccacgtgatcaagcggcccgccttgaataccggggaaaagtgctgaattaatggccttgccgtattgcgccttagcaaggatcaagccgccacgggggccgcgcagcgttttatgcgtcgttgttgtgaccacatcagcgtaaggcaccggattcatatgcaaacctgcggcaaccaacccggcaatatgcgccatgtcgaccatcaaaaaggccccaacatgatcggcaatttcgcggaattttttgaaatcaatctcgcggctataagccgaagcccccgccacaatcattcgcggttgcacctgttcagcctgctcacgaatcttggcgtaatttagccgttctgtcttcggatccaaaccataatggtagaaatgatattcctgaccactaaaactaactgggctgccgtgagtcagatggccgccatcggttagatccattgccagcactttatcgccatcttctaaaaaggcgcgatacgtggccatatttgcctgtgaaccggaatgcggctgtacatttgcaaattcggccccaaacaattttttagcgcgatcaatggcgagattctcaaccacatcaatgtattgattaccaccataataacgatggccaggataaccttcagaatacttattcgtcagcactgacccttgtgccgcccgaaccgctggggaaacaatgttttctgaagcgataagttcaatattatgttcttgtcgttcctcttcgttatgaattgcaccgaaaacttctggatcttgtgccatgaaatccatgcaagttcctcctttaaaatgcgccatcaaaacacccgttgcatttgcttttattaaaaaaaccaactcacaaaggctctgtcagttggtctcattatagcaaatcatcttgggtctgctagaaaatctacttatttgtagctgaatgttggcgttctgtttcgtttaaacagctgccatcatccaagataacgattcagcacgacggctaaacttgagtcctcgatagtccagcactcataaacggttagcgctatgattcgccgcgactatccttgaaaatgcatatcgccagccgatttcaacagccgattcatgtaagcagcacttaattcagtttttgaaaaggcttgtgctaagaccagcgtgacatcgggatgtaaatcaaaccaccgtaacccggcaaataaagcgtgggcagcgctttgaacatccttcccaagtgaatagcttggtatcgtcggatactgagccaaaattgcatcagttgccaacaggccaaacacttgaccagtttgtttagcccaagcgaccgctgccgaaaattgggctggatcatcgacaacaactacttgcgcagctggtgcataatgcttgtatttcattcctggagccttaggtgcttcgttttggccaacatgatgtgctgccgtatcaacgtgtccgattaacggttcaagttcatcgggtccaatggctcccggccgcaaaatagctggtggcgtgaccgtgagatcaatgattgctgattcaacaccgacttgggttggcccatcatcgagtacaccggcaattttgccgtcaagatcatgcaacacatggtcagcagttgttggactcggcttgcccgaagtattggctgatggaccgacaatgggtacgccggctgtcgcaatcaatttgcgcgttaacgcgttatcgggatttcggaaggcagctgtctgcaagccaccagtcaccttcatggacagccgacctggcaaaatattcagaataattgtcagtggccccggccaaaaagcctccattagctttgctgcaagcgggataatcgcggcatattgtccgaccatatcggcgtcggcaaccgttacgattaagggattatcagacggtcgccctttagcagcataaacttttccaacggccgtcacattggtcgcatccgccccgagaccataaacagtctcggtgggaaaggccaccaactcaccacgcttcagcgcagccgcagcttccggaatatcagattcgtgataacgttttgacaagatgttgcctccaaatcatgttctttttaaaatagctcaaacttagtagaaaaattgtagcagatcggttcaagggtcacaccatgcgttttaaccttcagaattgcagcttggccatacgaggatgatctgccatatcgcgtcgaaaagtcacctgcgcctgtggcagttgcttagcaaaaagttcgcgcaatgccggctcttggcgataaccgaattctaagtatgccgccccgccagctgttaagtgctgaggcaacgctgcaacaaactgctcaaaaacggcgaggccatgatgccctgcaaataatgctaacttaggttcataacgcagcgtgctttgatccatcacaggcgtctcttctggggcgatataaggcaaatttgtcacaacaaagtcataccgtgctggtagagctgcaaacaagtcactcaccgtaaactgaactgccacctgctgttccttagcattttgcttagcgaccgcaagtgcttctggtgaaacatcgctcaaggtcatcgttgtttgcggcaacttgcgggctaaggttaagccaatcgccccgctgccagtaccaagatccaagccagtttgtgctgtccgttgctcttcagcggcccaagccacaagctcctcagtttcaaatcgcggaattaaaactgctggcgtgaccttaaacaactcaccaaaaaaaggggctaccccgacaatgtattgggccggctcaaactgacgcaagcgttcgacatcctgttgaaattgctgccaacgtgtttcaggcatcagatcttgacgatgcaaaatcaattgacttggggtgaagtccgcacgtgtcatcaagacataccgcgcaccgtcaggatcaatcccgtccttggtcaacaacaaagacgcccacttgagcgcctcggcatacgttttagacattgagcgattccatcttttgtgcctgatcgtgaacgatcaacgcatcgataatttcgtccagttcgccattcatgatacgatccaacttgttgagtgttaacccaattcgatgatcagtaacccggttttgcgggtagttgtaagttctgattcgttccgaccgatcaccagtcccaatcgcattcttccgattctgatcatatttttcctgattctgggtttcataataatcgtaaacacgcgaacgcagaatctgcattgcgcgggcccggttttcctgctgactacgttcatcttgcattgagaccacaatgccactcggaatatgggtcatccgcacggccgaactggttttgttgacgtgctgaccaccggcgcctgatgaccgataaacatctgtccgaatatcttttggatcaatttttagatcaacttcatcgtactctggcatcacgccaaccgttgcagtgctggtatgcacgcggccggcactttcagtcactggaacgcgctgcacacgatgcgccccattttcatacttaagcttggagtagacgttgtccccagtaatcatgaccacgacctctttgtacccgccgacttcagtaggagttgcgtcaatgatctcggtcttccagccttggcgctcagcgtaatgcatatacatattcaacaaatcgccagcaaaaagactggcttcgtcaccacctgctgcaccacgaatttccataatgatatttttatcgtcgttaggatccttgggcagcatcagtaccttgatttgatcttcaaggtcagccttttgcttctgcaagtcttcgaggtcttctttggccaaagcttccatgtcgtcgtctttgctttcccgcagaacttcttcactttctttaatatctgaaagcacttgcttgtatttcttgtaagcggcgacaacatcccgcatgccgccttcttctttggacaaggaaagataacgctttgtatcgctaatcacttcagggtctgacatcagctcttgaagttcttcataacggtccagcagaccatccaactgttcaaaaatcttatccatgtttcctcctaaaatgcatttaccggcgtcacaatcgacacgtctagtcactaaacgcgccaatgcgggcacttatcgtcaagcgccatttaaaatttaatcggcagggtcaatctgcttcaatggcggatgaaaataatgatgtcggcaaactggataatacgactcattcccaccaatcagtacttgtttgccttcgtagactggctggccatcatgaatccgtaaattcatgatcgcttttttggcacaaaaccagcagatcgttttcatttcttcaattttgtccgcatagagtaataaatattttgaaccttcaaacagctcattgcggaaatcatttttcaaaccgaacgccatgactggaatatgtaattcatcaaccacacgtgctgcttcaaaaatgtgatgtttctgcaggaactgcgcctcatcgatcaacacacaggcagccttagggtcagttgccttgatgatgtcgtaaaggttggtttcgtgtgtaatcggaattgccgtgcgttctaagccgattcgactggcaatcataccgacgccggcacgatcatccacggcacttgtcatcaaaatcacgcgtttattttgttcttcatagttatgcgcaaccttcaggatttcaatacttttcccggagttcatcgcaccgtaacgaaagaaaagctgggccatatgccgcctccatctcaaatatcacagctcacagtataacggattttttgtgcaaagaacaccacgcccgccggtttgcttgcaacttatgctaaaatagtcccattaagttgagaggaagaacgccgtggcattttctgcaaaagctagcctggcaactgccattggtcgcagcagttactggttcttacacacatttctaaaaggcgggtcgagcctaccaggccagatcgccaaccgaattgatccccaagtcttgcggacgctcggtcaaaactacgatgttattgtggtgactggaacaaatggcaagacgttgaccaccagcctgattgttaaggtgcttaaaaagaaatataaagaagtcttaacgaaccccactggctccaacatgttgcaaggtatcacaacggcttttttggcccagccgaagcgcggtcatggccgcggtatcgctgtgctcgaagtcgatgaggccaatgttgcaccagttgccgctcagttaaaacccaaggcctttgttctcaccaatattttccgcgaccagatggaccgttatggggaattttataccacctatcagaaaattttagacggtgtgacacgcgatcctgaagcgatggtcattgctaatggcgacgctccgattttcagctcccgaaagctgcctaatccagtcacctactatggctttgaactcacggcaaatggcgatcataaagccccgccgaatacggacggtgtcttgtgtccggtatgtcagcacattctgcactaccatgcacaaacttacgccaatttgggcaattatttttgtccgcattgcggcttcaaacgccccgctttaacccatcaaatcaccgaggtcacccaaatgaccccacaaagcagcgacttcatgattgatgatcaaccatgccacatcgacatcggtggcatgtataacatctacaacgcgctcgccgcctttgctgttggccgggcgttcggtgttaccccgactgaaatcagccaagcttttgcttatgacgagaaggtcttcggtcgtcaagaagtcattcaacttggcaagaaaaaattaaccttgattttggttaaaaacccagtcggcctcaaccaggtcctcagcatgatcgaaaccgccaagcagccgtttggttttgcaatgctgcttaatgccaattatgcagatggcattgatactagttggatttgggacggcaattttgaagaactcgttgccagtcaaaaggccgccagctatttggtcggcggcgaacgctacaaggacatcggtttacgccttacagtcgcaggtgtgcccgaaaaagcgcttgtcagcaagccatctcttgatgatgtcatcagcaccttaaaacgctccccgcaagatcaactttacgttctggccacctatacagcaatgttgcaactacgcaagaaattaagcgatggcgggtacatcaaagcaggcttttaggccgcgtatgctttctacgacagtgtgggaaggaatgctaggcaaagaatcctttgccgtgctaaacgccgcaatctccggccagatggggtggcgacgcgtagctagagcagtgatggcgcttcgagcccaaaaaccggtttcgaagtcgcctaactagatcagtcgctgtgttgtttgcacagctgggccccctctggcctacgattgctccgccttggcactgggatcttttaattcaacagcagattgtctataacaaaatgaaagacgaacggttttccgcactccaaatactacgaacaatcgctcgtcttttttgcaactataaatcatgtctcaaaactttatcagttatacagcaggcattgttttgaaatcacttaaaaatcgggctatcaaagcatcccgctttgccaaaaaagccggatttggttgggggtgaacccgattggtcaagataaccaatgccaattgatcatcaggttgaatcagccaaaaagtgcccgtatagccagtatgataaagccatagtcggccttgaccatcgcgccgcaagtcccatccgagacttcggcctaagtgatgctttgtccaatcctgtgtgagatcagccgcatgcgcgggccagcttgctgattggcggttgccaaaaaagtattcggtgaaagttactaggtcggccaacgaagcaaataagccagctgcaccgctatgcttaccaagaatggcgctcttgggatcatggacaacgccttgccgcaacccgactgccggactatacgttgttggaacgcattgttgtgaatcaggttgaaaagtagcttgcggtaaggctagtggctgtatcacttgccgcgtgatgagtgtttgaattggctgatgatatacctgttccaaagcccagccaaccagcaacaaattcacgtcgcgataaaccacttgacgatccacttcttcggtaacagtcagttgcgtcatcaacgcctgtttcagcgccggggctggcaaggcattacggtgcggaatatagccttccagtcctgaagtatgcgtgagtgcctgtcgaaaagtggttgtgtgtgggaaatctggcaagaatcggtgtagcggcatatccggcgaaaccaagccttggtcccatgcttgcaagaacaccgtggtagttcctatcaccttcgtcaaagatgccacgtcgtacagcatatgcggctgaaaaggcgcaggttgcgggaaccactgtgcctcgccactgaccgccgtctgcaccgttttacccgtcaataatgccacactaaaacccggcattacccgggcttttgtccatgtcttcatttcatccgtcactgcttgaaaatccatgctggccttctctctgatgtactgaccattatcacgaatcacgccacccgaaaccacagcgttaggcgattaggaccagcaatcatcaaaaattgattgtctttattataatcgtaatccgttaaacctgccgcatcaaggttcatcaaaatgttttccatagcgtgctgatctggcaagataaaactcacataatccaaaccatacatatccggcgtcggcaacgccaacttagcatccagtcttaagttaatgccaatgtggtgccgataatcccctgccgctaaaaaaacctcatttggatcatggctagtcttttcgcgaaaacccaatccctgttcaagataatgacttgtcgctggtaaatcggacacccgaaattggacataaccaatcgtcgtaccagatggcaatcgatcatattcccgagcggcatgttcgccaatggttgccgggtcaatcgactgaagcgtttcgtcttcccagttatattgccgttcttcttgatactgttcaatcgcgcgatcaatggtgaaagcgaccccgttgccttcaggatcatgggcaatgaagccttcccgataacctgtctgaaaggcggtcgttacagtttgattcttagccacaatgcgataagccgcacctaaggcacctggattcggtaacaaaatggcaaaatgatccaagccagtcaccggctgttgtgcctgcagccctgtaatttgatgcaacaccactaaaacctgttgattaagccgggtgcctaaataaatcgttgacccattttgccgtagcagatctaaccgcgcaacctgctgataccattgactcaccaacgtcaaattcgccactttaagcgcgacaaaatccactcgcgtctcttctggcaatatgattcctgtcattttaatctgctccttcttgaacacgcaaacagcgttaatctcccgctgtttacataactgagaacagcataatgattcggttcaatttttgccaacaaaacgcttgatttggtgattcaattcgcaaatcaactcaaaaagtgctggccatcgcgaaagtcggcttcttcaacaaaactaagttgcgaaattcacaaatgttttttagagttaagtgtgacgtcatgtaaaaacataacatagaaaggcgcaagtatttgatgaaaattttgggaatatacggtggtcaggatgctaatggcctcaccgccagcttagtcaaagaagtgctggccggcgttgcagcgccagccacaactgagtttgtcgatttgaatcaatatcaaattcatcctgacaaacctgagaccacaaatccaacgctggataaactcgaagccaaattaaaagctgctgatgtttgggtattaggtacaccaacctattttggcactgtcgctggtcaatttaagcaactgctggactgtatgcgccatcgcatgacgcgaatgactcataaaggtgacaccttgcctgggcaattcaaggacaagcattatgtcagtgtcaccagttgttttgccaccggcttggacaatacgttcacgcaccaaaccgatgcgaccttggttgcgattgataaagccatgacagcagcaggtgtccataaaataaccgaactggttttaccgcatacttgggggatgacctcactgccactggcaaaggtcaatcaagcccaccaactcggtgaaaaattaggtatatttaagaaaaaggatgatgaaaccgtgaaacgatacttcttattattcggcatgattgctatgatggcgctggcgacgatgggcattcagttacttttacctggcatcgccaccaacttctggtggcgctatgtcagcttcgtggtaatcttctttgttctgttagcctgcctactgcactacgccaccttcatgcgccacaagcggcgctgaaaagttaagatgtttcaacgttcaccattgccaaacaaaagacgactgattttcaattgcggaaaatcagtcgtctttgtttttcatagatagtcagggaaaatttaaaaatcctagcgccaaggcggagcaatcgtaggccagatggggctcagccgtggaaacaacacagcgacggtccttggagctgatgttgttaggcgactttgagatcgcgctttttgcgagctcaaagcgccgtcactgctctagctacgcgtcgccaccccatctggccggagattgcggcgtttggcacggcaaggaacttttagcctagcacccgcctacgattattcggaatttaacgaatcacaagtcctacaagggaattatggctcacgctcgtccctacaaatcagccctaaatagcaacattaccgctaaattgactgttatacagatcagcgtagaagccgtttttggccatgagttcatcatggttgccggtttcaacaatcgaaccatgatccatcacgatgatgttgtcagcgtcgcgaatcgtggaaagtcgatgtgcaacaacaaaactggtgcgattcgtcaacagtcggttcatggcatgctgaatatgaatttcagttcgggtatcaactgaactggttgcttcatcaagaatcagaatctcaggatcggcgacaaacgcacgcgcaatcgtcagcaattgccgttgcccttgagaaatatttgaagcctcttcattcagaatcgtgttatagccatctggcaactgtcggacaaagttatcaacgtgcgccgccttggcagccgcaagcacttcatcgtctgtcgcatcttctcgaccatacttcaaattatcccaaatggtaccggtaaacagccacgtatcctgaagcaccatagcaaaatgcgagcgaactgcctctcgcttcatatcacgcgtgtctgtcccgttcaagcgaatcgaaccgccactgatgtcgtagaaacgttccagcaagttgatgatcgtggttttgccggccccagttggtccaacaatggccaccatttgccctggtttcacttgcaaattgtaatccttcaacagcagcatatccggtgtatacccaaactgtacgtgatccatcactaatttgttcggatcatttgcgactgctggcacaccagacggctcgtcttgcatgtcctgttcgtccagaacagcaaagattcgttcggcactggcaatcgttgactgaatcgtgttagccaagttggccaattgtgaaatcggctgagagaactgttgcatgtattgcaggaaagcttgcacattccccagtgtaatcgcaccgttggcaacttcgataccgcccatgattgctacaaaaacataaccgatgttgttcaggaagatcatgagcggcatgatgatcccagaaacaaactgggccttccaagcagcattataaaaggcttggttctgaccttcaaaatcgcggacttcatcgtcttcacggttgaaactcttgatgatgacttggccgccataagtctcttcaacttggttattcagcaaccctaaggctttctgctgagcagcgaagaacctttgtgacttaggcgcaacgatcccgaccacaatcaggccaagcggaatcgtcaccaaagcaatcagcgtgagtttccaaaagatcgtcaacatcatccagatcgtcccgacaaacatcacagcacttgtcaccatttgtgtcagactttgctgcaaagttgaggcgatattgtccatatcattaatcgcccgcgacatgatatcaccgttgctgtgcgtgtcgtaatacttaatcggcacagttttcatcttgtacttcaaatcttttcgcagttgataaaccgtgttctgcgaaattcgggtcataatgaactgctgcaggaaactgaacagtgcactgcccaaatacaagactaggacgattaagataatctgtttgatcttgtcaaaatcaactggataagtgccaactgacatgccagctttttgttcagcttgccccttcatgacgcctttaaaaatttcagttgtggcttcccctaaaattttcggcgtgcgaatctgaaagacggttgaggcaatcgccaaaaccagtacggcaatgatcccaatcagccgattgcgcatgtaaccaaacaaacgcgccgtcgtgccccagaaattcttcggcttttcaacgagaccggcacggccgcctggacccatccgagggccggacggctgcttcgtggtttcagactttttttgatctgccattattgctcgtctccttcccgaatctgtgacttgataatctcctgataagtcgtgttggtggccttcaactcagcatgtgtccccttgccgaccatcttaccttcatccaacacgacaatcgtgtccgcatcagcgacggttgatactcgctgaccaacaatgacaacgacttttgtctggattttagcatcggcctttaaagcggcccgcaaattagcatcggttttaaagtctagcgcagagaatgaatcatcaaaaacataaacagatgcatccttgaccaaagcacgcgcaatggctaaccgttgacgttgcccgccagagaaattaccgccgccttgttcaacttgatagtccaggccttctggattggccgcgatgaaatctttagcttgggcaatttcaagggcatgccagatttgatcatcggttgcctcatcattcccatatttcatgttatcgcgcaccgttccggtgaaaagattggctttctgcggtacgaaagccacagcttcatgcagcttcttcaaatcaacggctttcacgtcctcgccgtcaactcgaacatgccctttttccgcatcgtagaaccgaggaattagattgaccatcgtcgttttcccactcccggttccgccaataatcgccagcgtctcaccaccagtgacctgcacatcaatatcactcaaggctggctcttccgcatggtgataacggaattggacgtgatcaaactgcagtgcaggatgggtagtgtctaacgactttggtgaggttggcgtcgtaatccgactatgttgatccaaaacttcattcaaacgaaccgcagaagcctgcgcccgcggaatgaacacaaagatcatagaaagcatcatgaaactcattaaaatctgcattgcatacgtcatgaacgcaatcagattcccagtttcaagtgcttgttgcgcgatcaaatggccgccccaccaagtaatgccaatgttggtgccactcataatcaacgtcatcactgggaaaaccgcagcgatgattgaaaagaccttcacggcattgtgcgtgtaatcttggttaaccgtttcaaaccgattttgttcaaaatcatcttgacggaaggcacgaatgacccgaacgccagtcaaaccttcccggaaaactaagttaatgttatcggtcttcttctgcatagccttaaacaacggcacagcaaaatacataataatcaataggaaaaaggctaataatggcagactaatcaagaaaaccatggtcagggtatgactcttttgataagccaaaaagcttgccccgatgagcatgattggtgccatgatcatcattcgcaagatcatcatccaaacgttttgaatttgggtgacgtcgttcgttgtccgggtgatcaaagagcttgtgccgaccttgtccatctcatcatgagaatagttaatgaccttgcgatagacgtcggaacgtaatttttgtcccagtttttgcgatgtctgcgacgcaagaaaaacatttcccacgctcgcaagaatactgagcaaggcaaacaggatcattttcatcccggttgcccaaatgtaatcaatatcgcctttggcaaccccattgttaacaatatcggctgtcaagtttggtaagtacaggttgctcatcacctgaacgatcatgaacaggacggcgccgatgacggcccagccagacatgcgtttttttgcaagcttaagcataatttcctcctaacacgtgcattagatcgcaattgcggtcgaccgtcttgcacaatttaatgacgttccccttcactggcaacgccgtactgcaaccagtccagaatttgattggtgcgttgcttcaactcagcaacggtcacctctttacctttagtctggcgtgaataaaaatagccgattgtctgcatgaacatcccgacaatctgacgaatgagcaaactgacatcatcgtcgcttttgattcgtaactgacgacgatcaatatttgccagcaaatactgatgtatctcatgatgcccacggggccgctcagctaaaggtgatccggccatttttgaggcactgtggaaatccatatgcaaaaagacattgcgataaagtgctgcatgcggaccttgaaccagcgcatcaatcgtcagcccgaaaaattctgacatagcggcaaaaagatccccgcgatgtttggccatcacctgttgcaaagcagcaactgcgcgatgccgcacttgttccaataaataaaaataaagatcggctttgtcatcaaaatattgataataactaccgcgcggaatccctgcatcctttataatatgactaatactagcatcattaaatggtgcgcgggcaaactctttattagcggcatccattagacgtttttgctttgcttccggtaaccgaaaaaacgttggtttcggcatgacggcctcctttcacggatatgacaatttgtcatgtgacaagctgtcattatagtcgcggttgttttaaaatgcaatcaaaaaacgacaaattcagtcgaaggtctgaggttgtcgttttaacaaaattcttattactgggacatgactggttgctgttaaataaccattcagcccaagaaatcactttggcgactgatccgaggcagcatcgggtgccgttgatgttgctgagccgcgaagtgccaaaatgtcgcgttcacgagttaaattaacgccgcgcacctgccactgcttctctgtgatgtcaacccgcgtcacactggtattcttcaacagcataaacggcaagtcctctggcgccagctgataaatcaacgcactcagtaacataccgtgcgaaacaactagaatgtcactgttatccgggctttgggcgatcacttgggtaaaagcctggtgggcacgagcaatcaaatctggtaagtcctctgcctgatgggtcggatctgcttctcgaattgaccgcacgagtccagcaaaacgctccgatccgcgccaagcccgaaaagcggcagccaccccaaattgacgaatcgtgcgggtgatgacggcgttaccagaatcaccttctaagccgccaaaataatattcacgtaaggcggacaattgaatcaatggcggttgcggccgatgaccagcaataatccgatgagcggtttcaattgtcctgccgcgatcactggtaaagacttttgcaaaaggcactggccgtagcaactcgcctaatcggtcggcagcggcgcgtcccttagccgtcaacgccgcatctgtgatgccttgcaattgtcgtgccgcattcataggcgtttcgccatgtctaaccaaatatagccttatcgtcatgtctatcactccttcagtccgtgcacctatgccatctcatcatcattgtcgcatcgtgactgtccactgcgcattctcgcttaacgcacacacttctcctttccatggtatcatgaaacccgtaagcatttctgaatggaggccttttttgtgatcaacgcagccatcatgatactggcatatgcccatgcccatccgcaaagttatcaggttcgcacggtaccttatcaaaatgtcaccagtattcttttagacgaccgtgtgttgtttcctgaacaatcactctttttcccaccaaatcggttacgggttatccgtttgccagaacattttgcattcaataatcctgagttaggtgcatggttattaagcctgctgcctgaattgagtgaagacgctgagcaggcttcaactaataatatgtggttaaccacgagccacctgaccaaagcacggcgcctgctaattgaggtgtcatttgaataatgctgtcaaagccgtcttcacccgtggcctgcgcgcggtgctgatggctttcttccttttcatcgcacgcgcttttttaacttggccatggctgttcttcatcatcggcgcttttctgctttatggttgtctttgttttggctacgctgcctttttagcttggacccagcgctcataaccgggattaaaatgatttagacgaaaaaaagatgctgtgaacaaacaagtatgtctgttcacagcatcttttaatatcgcgcttgggtagatagggatcgaacctatgattatggattcagagtccactgcgttaccacttcgctactacccaataacttaacaacgagtaatatcttaaaaaatttttgcgcacttgtcaacgtctttttttatgaaggtgcaaaatacctgattctggcgtaaactattaccaatacttaagaagtgaggcgcaagaatgaaaattgaatctgcatgcacctcgattctggtcggtaagaaggccagcatcgatggttcaacgatgatcgcacgtaacgacgacaccttcagtcccctaacaccacaacgtttctatatgcacgcgggctggaaaggcgagaaatcgctgcacgttaaatcacctttgaacggttttgaagcagacttgccggagaacggctatcgctataatgctgtcccaaatgttgagaacgataaactcggtgattacgaggaaagcgggatcaacgaacgcaatgtcgcgatgtcagccaccgaaagcacttacggcaatgaacgggcgttggggtttgatccgttggttaaagatgggcttgatgaagacttgatcgtcaacatggtgctgccattcatcgaatctgctcgtcatggggttgagtatctgggtcaactcatcaagcaatacggctctcctgctggcaactcggtgttgttttccgacaaagacaatgtctggtatatggaaatcgtgactggccatcattgggttgcacagcgcattcctgatgatgcctacgcgattgctgctaatcaggttgctatccagcaggttgactttgatgataccgacaattttgtctggagtgaaggtattcaagaattcgtcgatgcgcatcacctgaacaccgacaaagaaggttggaacttccgccacattttcggcacgatgaatgaaaaggatcgtcactacaacacgccgcgtgtgtggtatggtcacaaaattctgaatccagaaatcgaagctgatcccgaatcagccgaattgccattcatcatgcataccgatcacctgatcaaccgtgaagacattgcccaaatcctcggcagccattacaacgagacaccatttgatccttatggtcatggtagtgatgccgatcgtttccgttaccggccaatcggcttgaaccgtacgcaaaattcacacattttgcagctacgccgtgatgtcaatgaaggacttgctgccattatgtggctagcgattggcatgccgactttcagcccgtatgtaccgttttattgcaacgccaacgataccgatccaagctactctaaaacgccgaaaacattcgatatcgatgccgattcagcttactggctgcatcgcctcttggatgtgttagtcgaagcgcattacacccagtttattcaagcagatcgcgattatttaactgccctgaatcgcgactatcgtgaaatgatccaagccaccgacgacggtgccaaggatcttggggataaagagttgacgcagtatttaactgaagccaattacaagttagttgatcacaccaagcaagctactaaagctttgattaacaactatgtcatggaaagtttaaaactgtcgaagttaacgtttaatatggataaaaatctttaagttataagtgaatgacatcaagcggtccgaatcttgcggccgcttttttgctgacaacttcttacaaccgatccggcatacctcacccaaatggcaatcaaaaggaggcaatgatcgctatgtcaaaatctcgtatcgaagcgtttagcgatggcgtgtttgccattttaatcactattttggtgcttgaatttcatcccgttgctggccgaccagggacgctgttgcaccaagtaaccggacaaatgccattattaatcacttacctcacctcttatttttacgtcggtaccttgtggcttttccaccacgactactttactcatgttaagagaaccaccacggcgctgaatattttgaatctcatcctgttattcaccgcaacgttaatcaactacagcatgtcactggttgcaatggcgttacgaaccttgaatcatgctgacatgcaggtagcgtttattgtctacgacattgtcgctctcttaatttcgctttcttattggttgatttatcattatctaagcacccatccacaactcaccgatcatggcatcaccagtcctacacaacgtatcgatccgttaatcagtggcttaatttatggtagttccattttggtcagttggctgaacgtttggatcgctggcgtcttgctacttcttggtatcgtcttccatttcatcgcttatttacgcatgcgcctgcctgctatgcattaaggttttgggacatgttgccaagtccctattcttttccttttctgacccacaaaatgtgtctgcgtttattttcaatcatgaaagcatcccccaaaataggtttgaccgcccgatcacacttgacgtaacatggcattattgtcttaaacacaggcagcaagcggctccgtgcctttcaattattttaaaaagggggcgttacccttggtgcgcggaattcagttacgctggttactgacaggtgccttacttagtagcattggcatgagtttcatctggcctttaaccagcatttatttgcataatcgcctagacatttcgctaactgtcatcggtgtcgttttactgcttaattcgcttgggagcgtcgtcggcagtatcattggcggacgtctgtacgaccaaggcgacccctaccgccttgctttgtttggtgtcgggctcaccggcttggtcttgatcggtttgaccttgtggcacggctggccagcctacagcatttggctgaccttactgggcattggctcagggtggaacattacgatggtgaattcactcggcacaagcatccgatcaaaagacggccgctatgtcttcacgatgctctactttgcgcaaaatgtcggtgttgtggttggcactgcgttggttgggtttgtttatgatatcagtattaccctactttttttgattgccgttgtgttatatggctttttctttgggatcgtgctaatcaaattccgaccggcggcaaaaacagcgcaaccgacacgaaaagaaacgacgaccgaaacaccaaagccgagtttgcctagtgcaaacaagctgatgttgaccactttcttttttgccttgctcatcttttggctcatgtatcaacaatggtcatccaatttgtccgtctacatgactggactaggcattccgttacgcaattacagtttcctgtggaccttgaatgccgctttaatcgtcgtcattcaactctttttaaactggttcaacgaacacgtcaacggcattcagattatctatcaaattctttttggtctcgtgatggttgccatctcatttctcattctgatcaccgcgcacacatatgcgcttttcatgatcgcaatgattgctttgacaactggcgaagcgaccgcatcccctgctattcctgcactcgttaacgatctgactccgcgtgaaatcaaaggccgctaccaaggtttcgtcaattcttggggttccgttggtcgcgcactcgggccattattcggcggtctaatcatcgactggctcagctatcgcagtttgttcatcattgccgcagtcggtgtgtttgcgctagtcgctgtgcttatcgttgtttggatccgaactcggcggcgattggtgcgatatcagtaatccgaatcgaactacttggaaacgcagccttaaattcatttatcgaaaagctacggcgttgtctgacgaattgaattggcaatgcactaaaagatgccttaccacgaaccttttagggaaaataagcgccactaaacaatcaggtcgtgggctctcgcaattgcgaaagtccacgacctgattttatgcagccttgttgtctgttgaatccttcaagttcttaatggcctcttcaaccgtccgaccagttccaaaatggttctgatcatgtgcgtcaattgctacaaacaactggtttttagtgtctaattgtaatcgatattgcatcatgatgatcgcctcgcttaatcaaacttctggcctgccaaagccttcaaacaggctctacctttatcatagaacttatgtcaaggcagtttctggatcagtaacagcctttgacaatcaatgattgacgcaccttatcaaatgcgtgatattaacacaattaataatgagcatgctaaactcaaaaaaggaggtaattgcttatgcaaataaaaagaaatatcaactggtttcatctcattttgagcattgttgtcgttgagcttattgggtccctttccggtctactcgcaggtaatatcaagggcatctatacatccttaaagctgccgccactttcaccaccagccgctgtctttggaccagtatggatcatcctctacttattaattggcgttgctggttacttagtcatcaaagacacgacatcgcgtaccccaaaaaccatcaatctcagtctttttggcagtcaactgcttctaaacttcatttggagcatcgtgtttttcggcggcaatagctattggctcggactgatcatcattatagtgcttgatttggttgtccttgcctgcatacttgcctttcgcaatgtgaataaactggcagcctacctgtttgtgccatcctttgtttggattttattcgctacctatttgacgttaggagtggcgatgatgaattagtggcttgctgaccaatacattgtatacatgtattggtcaaattaattaaattcttttcgttatgattctctttttctttgagccgaaacaaaattcagatatacttcagtgacagtcaaataagggcatcatgaacccacgtttgacttggcggtttggttagacatcacccctcaactattttggatcgtggaggtgatggtccatgcctaattggaaagactggagggttgggcacgctagaaatagcgttagcaatcttggttattgccaaagcgtattttatatacgcccaagcaaccaagatactaaaagaagctagccacgagggttagcttctacaccagtcttccagaccgtgtcgaggtcatcggggtaccctcccgatggcctcttttcaatatttataatgtatcaacagtgactttttttgtcaactttaaggttaaatttgtgtgatctacgctggttactctgactggtatattgcgaagcgtcttggttacatcagtttaaaggaacttcaccgcatgtacggccatgtcttcacgcaaatgcaggccgaagctgacaccaagttgcgggtgtcaatcggtcaagagtatcttggaaaaaaagggacaaagtagtaaaaatgccttcaaaagactgaaaacatcatcggtcgccacattccgtgctggacgctggattcagcgatcattaggggacttctaaaaactcaatgcatttatcaccgcccaaaacccttgaggcacaatagtttccacgtttcaggggggatttgcctttttccacgaatacttgttcgtgaaagtccccgatcaatgccccctaagttatcctttttagtcttttctccccaaaacaaaaacccccgaaacaccattctaaaggcagctcgaggatttcatttgttcttatttgttctatttctcacccgtacgggattcgaacccgtgtttccgcgctgagaacgcggcgtcttaaccccttgaccaacgggcaatgagtggcgcttaatatcgtacctaaattattctacaggaaagtgcgaaaatgtcaaatacattttgacagcacttggtgacaactgatgcgggttttcgcttttccctgtcagtcattttggctaatgatagatgatgccactcgtgttgctaataaagtttcttttgagccgattgatagtctttgaatgccccgatcgtcaactcgcgatcatgttgggtcagagcaagcatgtcgcctttcaagccggcattgatgaaatcatagatagcggcatcgtctgctgtgttgccatagtatacctgcttaatgttggcccagataatggcgctgagacacatgggacatggcatggcagatgtgtagagttcacagccggttaagtcatgtgtgccaagtgcctggccagcttttcgaatcgccgtgatctcgccatgggcggttgggtcgtgatcgaccagcacttgattatgcgcgcggctgacaactttaccatctttgatgatcacacaaccaaacggaccgccatcgctaccattgacgtttgccttggcttcttcattggccattgccataaattcttttcgatacataagcgattccctccaaaaagacagtactcaccacgccaaaaattcactagcgagcattttcttgatggcatccgaatgattagatgccttatatcccaaaatccacgacaacttaagccttgatctgattaaccaaatccgcaacaactgcgtgcgtcaattgactagtagctggtgacaccgggttcttcccttctggatccgccacagcctgaacaaaggcctgaaccattggctgaaaaccgcgcgttgttaacatcggctgccaatcaggcgcaaatgtctgcgttgccccgccacgtccgtaaacgacgagttgatcaagattctgcacacgctgaacgccacttggagccgcaacctgagcttcttcaagattggtacctgcttgtaagtcaatcccagcttcaccgcggatgcccggtgcggtgaaaatcacactagcttgctgcagtttaccatcatcgccggtatgcaatgaatatcgggtatttggtttttctggatagcctgccaacattaaggccgtatctaccggatgaataaagagatcccacagtgcatgttctggatcgtcaggggcatcaatccgatttttgtcaacgcgaacgccggttttatcatcgacttcagccaagtcctgaatcataggcgcaaatcgtcgattgaatccaaccgttagcagcacgtgctgggtatcggctaaatcatataattcattgatttggcccatatctgtggcaagtggtttatcaacaaaaacgttgacgcctttttccagaaaatgtttcacatactgataatgggtttccgttggcgtgtggatcatgatggcatcgagcggttgcgcatccaaatcctctaaagtcgtgcccgcaatcgcgagtccgtcttgtgttgccaattgttgcaatttatcgtcgttgcgggtgctcagtacccagtgcacttgattctgcatttgtgtgtaaactggcagatatgctttctgcgcaatcgtaccaagtcccatgacaccaatcgttaacatcgtttcacctgttctttcatgacaaaataatttactttcacactagcacaggcccctgtcagggtaaagataagtattcgtaatgatccgcctgcctagtcaaatgccactattattaacacagtataccactggtcctgtccttctattttacgcctctccgttcttaacgaccattcagcgacaacttgaaaactttcaaaaagaagtttacggttattatgtaaactaaaataaagtagccgcttttgtacgctgcttgagcctaaacggatcgtcacatcaaacgcgagatgacaactagtccgctcttcttttttctactcaaatttaagcgacgcctaaagcgacacaaagtaccattaatcatacaaggaggactcgttgtgaaacctgcaaaaactaagtttagtgatgcccctgatggcagtattcatcaatatgatcagattttgaaatattttaacgatcaaccagccgatcaaacgaaaccgcgtggtaatcggatcacatttgtcacaaccggcattatcggttttgatggcggtcaaacaacgatgctgcatctaggtacgctgctggccaacgccggttacgacgtctactatttaagctatgtcccacaaagccaagacgaaatgattcagaatgctgaatttaattatcccggttacaaaggaacctgtctgccaatgggcgaacttgagtcccaccgttccgatatttgggtcgccacgttatgggaatccgtttatgtgatcaagaacaaaccggggtacaaaatgtattttgttcaagattacgaaccgtatttctatccatatggcgatcgctatcagatggcgcgacgaacttacagtctaggtctgcacatggtatcgcttggtccatggtgtgctcacatgatcaccatgcattgcaaggttcacagtcctattgatgtgattaactttcctgtcgatgtcgcacggtatccattcaaggaacgtgacatgggaccttatcaacaaaagaagcaaatcaagcttgctgtctataccaagtggagcagcccgcggcgcgcacccatcaacattcagattgtcctcgaaaattgccgccagttactgcgcgccaaaggaatcgatctcaaaattcaatacttcggtaccggccgcagcaaacgattcatcaatggtgaaaaccttggtaagctgactcccccggaattaaatcgactttaccaaagtgctgatttcgggatcgcgccatctatgaccaatttttcgcttatcccttatgaaatgatgagcactggcctgccactcattgattttaaggaaggcacaggaagctacttcttgaaagacgggacctattttgccagtcaccttgatgaacgagatctggccaaaacgcttgcaaatgcttgtgccaaccctgacacgatcagcaaccaagtccaaaatggtcaagccttccttaaaacgatcggctgggatcgaactgaaaaagacatgctggcgatcattgcaaacctgtatgctaatgtcgatgtggtcaaatcctaaaaaaactgactgtgaagctagctcggcgcttgtcgccgggctttttttctgggaaaataaactttggaataatcgacaaaaatcttattatgttcaaacaactaatgtcgatattaaaactttggagggaataacatgtcaacactgggaagtatttttgtgctgctcgggctagtgggattcatatggggtattgtcagattgattcggcaacgcaaacatccgctcaccaagcgtttaaacttgatcatactcgttggtgggcttgtcttattgatcgctggcggaccgctggtagatacgaaagccgcatcgggatcaccacagcaaacatcgtcaaccagcaaaaccaaggcgctatctgccaaacagcagcgccaactcaagagcgaaaaagctcgtgggaaagttttactggcagcgaaagccaagaagacatctgaattaaaagcacttcgcaaacaagaggccagcttagaatctgaagcaagttcgcaagttgctgcttccagcgaagctgaggcttcatcgtctagagcggcatctgaggcagcttccaaagaagcatcggcgagccaagttgccgcgtctgagcaagccgccgcggcctcatcgcaagcagttgcagcagcacaggcagccaaacaagctgaagaggctcaaaagtctgccgctaaggaacaggcagcacaaacacagcaggccacgactaatgaaggtgacatgaatacggctgaacaaggcaccatcatcggaaacagccgcagcaaaatttaccatgtgcctggtcaagctggctatcacatgaattcagccaacgcggtttacttcaattccgaagctgatgcacaagcagctggttatcgaaaggccttacgatgagaaaaaataaattacttcaacttttcatgccgctggccgttgttggtcttcttctcggcggttgcagtacaactaatagtcgttcagtaaagtcagctggcgatccagttgccagccaaaccaaggctaacaaaaagacgcagtcagctatcagcggccttgattcagaactgacggaaaaacgcaaagagatcaccgatctcaaagccaagttagcgaaaacacaacctgctgcaagtgaatcatcaacaagtgctgctaccacgacagcgtccgatctcgccaatcttgactacactggccaacaagaaatcattgtcaacaaaaataatcctgcattcactgatgctgatctatctactgccaagggtgcttgggcaacttatgctgatctcgatggtcaaaatcgcgtgacagatgcaaatgcgcttttaaataaatcactcatgccaacaaccaagcgtgaaccactcacatggaacccaactggctggcataacaagaaaaccgcgcatggttggctgtacaatcgcagccatcttattggttatcaattaaccggcgaaaacaacaaccccaagaaccttatgaccggcacgcaaacccttaatacaccactcatgctggctcatgagatggatatcgcttattacctcaaacaaagtaccggccattatgtccgctacgaagtcaaaccaattttccgtggcaatgaattagtggctcgtggtgttcagatgcgtgcgcaaagtattggtgataatcaagtctattttaatgtttacattttcaacattgaacctggttacacaatcaactatgctgatgggacaagcactaagaattaaaatctatcagcgtcacttaaagtcgttagacgtcataacagtcgaagcggcttttttgattcagtttttggaggtccctcatgacaaatcaaatcttttttgacggtatcctgcttcttttaacaatcggtgccatcacagaaataactggtgtcgttaaagtcataaaagcaaaacgtccgacaaaaggtgccaattcttatcaagttgtcatgttatcggcaaaaatgttgaaaacatttcctgaagaaatgaaacgggcccaaaaagtcgctttgctacttcgccttaacctattcagtctgagtgcctgcatcggtttcctgattgctggcatctaccaacttaatatctacgctgacccaaccgtttgccgtgtaagcgcttggctaacggtaattgtcaccatcactttgatttatctaagctgtcagtcatacacaatctcacgtcacatgatggagaagtatttcgaaatatcaccgtcgagcaaagaagacatcctccccttctcacttgaacaaggtcaccgcagttttatcggtaggatcacggccctatttggcttgttaatcatggacgcagcatttgtgctgatggtgattttttagacttaaacacatcattgacaccacttatgtacgctgctttttaaaattgatacaatctgaatcactccgtataataggcaccaagtactgatgcaaaaagaagctagccctggatcgaaaacgtttcttggcgacctagcttccattatcatatgacatacacaaaaaatggaggatttaaaatgaaaatcattaatgtcaaacttgtcgtcaaaccagatcgtgatgcggcatatcgacaattcatcgccgctttggtccaaggttcgcgtgcggaacaagggaaccttagctacgatcactatcaaagtctcaccgctccgaatgaatatgaaatcatcgaacattggcgagatgctgaagcggttgaaagtcataatgggacggcgcattttcaaaagtttttggctggaatcaatgaattcctgactaagcctttagaaatattgcgcatgaatgaccatgcttaatttttcaatcaaacaccataaacgattgtttggacaatgtcatcgttaaatccttaacaatgcaaaggctgtcttcgtacagaacaagaaagaggcaaatcatgaacatgccaacaattgaaaccttaaaaagggctcgcattaaatggttagatgtatcgttttcttataaggacaagaaccacttcattgagattcgcacgccgtttccagacatgtttcatgataatacttctctggttttatacaaagacgctgatggcaatttgatgctgagtgatgacggttataccatggacgaacttggaaccttaggatttgacacgaacacatcggttaaaagaaagaagtatttcaatgaaactctcctttccttcggcgttcaatataccccaactggtgagctagctatcaaaatacctttcctctccaaatatgcacaagcagaattgcagcttattcaatgcatcacacaggttggcgatatgctcgcaacttcaagagaaagaaccaaagacttatttctagaagacgttgtcaacttcttaattaacagcgatatttcggtcaatacaaatgttaaatacacaggtcaaagtggcaataacatcaactttgaaattctgactggtcgaacgaaaacaacctccgctaaggcattaaaactagtgaataatccaactggaaatgccaacaaagaaccaatcttttcaattacatatgtacgttcatttaatgatgaaattaagttctacttgctcgcaaacgatctggaacgtaatatttcgccaagctttcagtcggcagcagagggttacaatatcacgctcttgccatggtctcaaaaggccagttggattggtcagttgaggctggcttgaagtagcgttgccgaaacacttttctaagacctaatagcactaacggacacgaactagctcgcaacaagcgttctcaaacgctgatattaatatgccaactagatattgggtcaatatatggatataggcttgatttcgcgatgtcgtttatcacccgctgaaatcacaccgtgtttttagtctatacaccaaaagaaagccagtactggcaatccagcggacacaaaaagagcctcaaaattggtacataaatgttttgacccttttggctattcagtcaaaagtcagtcacgaacatttacaacacaattttgtggctctcattttttcctattcaagcaacctcaaacccacgctattaaagccgtgcgttcaattccttggtcatatcctcataacccggacggccgagcaatgcgaacatgttcttcttgtaggcttcaacacctggctggttgaatgggttgatcccgttcaggtagccggagattgaaacggcagcttcgaagaaatagatcagatagcctaaggtgtaggcatcctgctttggaatggagacggtcatgactggcacgccgccatcggtgtgggcgagaacaaccccttcataggccttgcggttaacgaaggacatcttcttgccagccaagtagccaaggccgtcaaggttgttagcatcttcaggaatggttaggtcgcggtttggttcttcaacccagacaacggtttccatcaggttgcgcagaccttcctgaatgtattggccaagactgtgcaggtcagtgctgaagttggcacttgaaggatagatccccttctggtccttaccttcagattcacccatcaattgcttccaccattcaccaaggtattgcaacgttggttcgtagttttccagcaattcagtggtatagcccttgcgatacaaaatgttccgcaatgcggcgtactgataagcttcgttttccttcaaatcagctgaagcgtatgccttacgaccatcaccgagaccacgcatcatttcgtcaatgtcaccgcctgcaacagcgattggcaacagaccaacagcggacatcacagagaaccgaccgccgacatcatcaggaacaacgaattcttcgtagccttctgcgtctgcttcttgcttcaaggcacccttggcacgatcagttgtcgcataaatccgttcctttgcgccatctttgccatacttttcgatcaactttgccttcagaacccggaatgcaattgaaggttcagtcgtggtaccagacttactgatcacgttgatcgagaagtcacggtcgccaataatgtcaagcaagtccgccagataagtaccagagattgagttaccagcaaaataaacttctgggaacttcagatcagggtcaaggttacggaaagtctgggaaagaaaatcaaccgccatccgtgcgcctaaataagaaccgccaatcccaatcgcaacaaagacttgagaattgccttgaactttcttggctgctgccttgatccgggcaaattcgtccttgtcatagttgactggcaaatcgataaagccgcggaaatccttaccagcacctgttccttcacgcaattccttgtcagctgcagtcactaacggctgcatctgttcaagttcattggcatgaacgaacttgtccagcttagatgaatcaaatttgatgtacgacatcgtgtgcttcctcctctaaatacataagtaactgtcaaaagtcgatatgagagtggtttcataaaaaacgtcaattcaattattaattcgaaataactcatcaagtaaacttttaaattcagttacccatgctttgttcaaattcacactctaacaagttaactttaaaattgaatttgtaaaaaagcaagcaatcgagcaacttctcatcgattactttgctttcatgatgccaaggacgacaccaccgagaatcaccagtgccgacccgcagctaacccagatcatttccttgcgtgttttatgctcgccaagcagataaatcgagccgaaagtcgaaatgacaattcccatctgtgacaatgaataagaaaccgctaaaccaacattggccatcgataacaacatgaacacattccctgttccccaaagcaggcctgtcaaaatatttttggcagttgctttagcaaatggctgatggccaatgcccattaataacgcaccaataatcatgccgatggattgtggcatcacaacggccaaagcgccaagatgcccagcgttgacaataatcgtgtagcccgcatacccaactgtcgatatcaataaggttcgcagcccctttgcaacgccactttgtgttgtgaagtcgtctgtttgttcgcgccttgatgtcaacgttgcgcccacaatcagcaatgccagcgcaagaatgcccaaggtcacatcacgaccattacgccactcgtggaacaacagcgcaccagccagtgttgtcgcgacaagctgcatccctgtcgaaataggcatcgtcattgagacacccatatatttcatggactgaaactgttggccttgtcctaatgcccagaaaagcccagagacaatcccaagtaaccaaattttagtatctaagaccggacgcatgacaatcaacgtgccgatcccgaaaaccagcgcgccaaacgtcatccccaaagtttgctgataagcattgccacctagtttgccactgaccaagccaatggagccccatgcaattgctggaatcagcgcaagtaaaaatcccattacgcgcctctttctatttcaatgattgatttaaaaaaattgaacacaaaaaaatattctagcggttttcccacggcaagacaagcacaacctgatctaaagcatttccaagagacagctcaccttcatgatacacagaaaactcatgatgaatactaaaacgactcatgcttatttacgatgatgaaacaagcgatataggctatagccgaaaatcgcaccgatcacattgaaaataacatcatcaatgtccgctaccccactgattagcagaaattgtagggtttcaatacttaacgacgtcagcaggccaaatataaccgtgcccgcgagacgccgtcgatgtttgctcacccaaggaataccaaagccaagcggcataaaccaagcaatattccctagtgattgataccagagatcaaagtgactggcagcatgttgcaatttaagcgtttcaacaagtggtcggatattaatcacagataatggccgattccaatgaaagtgcagttgccacggataatacacatcgcgaaaaactgtcaaagcaaataggagcattaaataaccgacaaaaatgcctagttttaattcccgcccaaaagtggttctccgcttcgtcaccaacagccaaaggcagcgcaaggctgcaaagatcaataggtatagaatagttttgtccaaactaaaaacaatcaatcgaaccaaaggaaaatggttgacgcgactgagcgaggttgtattaatccagttgtaaaatggccccaaaaacagcattgtgctacctccagttgtcattgtagcaaagtgactgaaggatacccacaatgtgttacaacttttaaagactctgtaagaatgatgagcatcaccctctgccattaggaaaatgaggtacgctaatcattgcatgatttgccatgataccagcaacgggatcaatatttaatatcatttcaccaatatgtcgggaggccggcgcgggacatcaaaaagcactaaaatagcgttctcgcgtcattgtcccaaagcagcgaagaaaccaacacataagggtctaagcaaaatggtaattaggccttttgcagttgcttcagaaacacgctcgcaaacacagctcatttttcagatattgaaacacgcttgccacccccaaaaccaagttggctcagaccctgcttttgtgcttcctcccttttgcgggtacaatgacaaagaacaaagtggaaaggagttgccgctttgaaacggttacgactaaatcgcctcgcacagtggataagatcaacccggattggctttttagcctgtctgcttttttgggtatgggctaagaccatctttggttactttgtggacttttcacttggcttaaatgatccgctacaatacaccttgctattattaaatcccttaggaactggaatcattttcctatcgcttggcttgtatcccaagcatgcgcgccgcggttacctcatcggcgtcattgtttacatactcagcactttgctattactcgcaaatgttctgtattatcgtgagttttcagattttctgaccatcaacacggttcttggcgtctctaaagtgagtcagggtcttggagctagctcccttagcatggttaaaccacacgatatcatttatgtaattgatattgtgctcgtggccttggcttattttagttacagtatttggaatatctggcgctatatccacaatgaacctttgcgctggccgcatttcggtctgacgttggatacccgccaacttccctttcactttccgcaagcggtcaccgtctttgggatcgcgctgtttgggttgatcatggcggttagtgaaatgaatcggccgcaacttttgacgcggacttttgatcggaattatatcgttaagtatctcggcttggcgccattcaccgtttacgatgctgccaaaacagcccagaacaatcaggtccgcgcccaagccgacagttcgaatcttgacccagtattgcaacatacgcggtcgcattatgccgctcccaacgccagttattttgggacggccaaaggcaaaaatgtcattattattcatttggaaagcttccaacaattcttgattggccaaaaaattgacggtcaagaagtcacgcctttcctgaattcactcattaaagaaaaagacacactcagctttagcaacttctttcatcaagttagccttggtaaaaccagtgacgccgaaaacatgctagaaaccagcacgtttgggattgccaatggctctttattcagcagtctcggcactgaaaatacgtttgaaggagcgccggccattctcaatcaacgagccggttataccagtgctgtttttcatggcggctctgctagcttctggaatcgcgacaatgtatacaagagtcttggttataacgactacttttccggcaacttttataatcatgacgaaaaagcagcgactgaatatggcattaaagataagttgatgatggccgagacaccaaagtatctggagcatctgcaacagcctttctatgccaaaatcatcacgacgagcaatcataatcctttttatatcacccaagttgattccgattttcctgacgccggtactgatgacgccacgatcaacggttattttcgcacggctcattatcttgatgaagcgctcaaggaattcttcaactatttgaaagcaagcggtttggaaaagaattcgctagtgatgctttatggggatcatttcggtattagtaatgatcgcaataccactctggcaccgttgcttggcaaggatcctagcacttggaatgcgttcgatgatgctcagttgcaacgcgtcccgctgattttccacatgcctggtcttaaaggcggcgttaatagcacttacggcggcgagatcgacgtcttgccgaccttacttcacttactaggcattgatagctcgcgttatgtccaatttggcaccgatctgctgtccagtcagcacgacagcgttgttgccttccgtaatcacaattttgtcacctctaaatacaccgtacttggcagtaaagtctacgataatacaaccggtaaactgctgacattgacgcctgcgcttgaagcaaccatcgccaaggatcagaagtcagtggacacaagactcagcctttcagacgatgtcgctaaccgcaatctcttacgcttctacgtgccacttggctttaaacccgtcaatcctaaccaatatgactacaatcagagtctcagcaatgtcttgtcaatcgaacgcaatctaggcagcaagagcaccagtctctatagcgaaaataatgaccaatcaacaactggactttaccaaactgatgctcctgaattagccgacgacactgatcccatcaccaccttcccagataaagttcaggatcaaactgaagcctccagcagcagcgaatctagcagttcgtctgatgtgaatgtcacaacccaaccatctaaataaattcaaataacatagtaaatgctcggcttatgttcacattttgttcaaattcattgcttatactgcttgtgaggtgaacgggtagatgcatttctttgagcgaacgttttcaggatttcgttatcatcgccgttattatattgtgatgatgctgttatcagtggcgttctgcttgatcagcatcatgctgatgacaagtgaaatgattgaccaatctgctcaggcagcttttttgcaacgcttgaactcatttggaacacaaaataggcagacgattttgctcagtacgcaggtcggacaagcccacattcaaatggtgcaggctgctcagtcgatgctgaccaaagttgtttttgctgacggtcttttgtggcttgcaggaactgcttggctatggcggcgtcgacggtctgaaactgatgctttgtatttagtcggaaaaagcagtatgtcgatcggcttacaatacgcctttgaagcaattttcagctttttaattagcttcattgttagtatttttcttgtggttttattaaatgatcaattgatttatttcttaacgaccacaaatcgttcggtatttgcccatctgctacaacaaaagtatgacagcatcgcaatgaaccacgcatttgagcaactctttgcccgtcacctgactggttttacccgtgaaaccctcttttattacggtagcaaaactgatgatatgacacagccaaccggtttcctgtcagcactgggaaatggtctcgccgtgattttcatcaccaacataggtttggtcacaccactttccatgcttcggaaaaggcgtgccttaccgcgttaggagacagccatgttatttcgatcaaaactacttgatatctatcgcgaaaattttgccaaactttttaccccaacgacgattcagtatctctatgcctcaaacgagaatgacctgattgccttgcatgatcagtacgtgcgcgattttattaatggtggcgtcatcaagcaagtcggcttcattaatagccggcatacaggtatccttgactatctcagcgtgcgaaacaacctttgcatcaatggacgctgcaaggattctgatttcttgcctgaatggttatccacgaattcaccgatcttagaccagccagctgcgacattgaacaccatgcaacgcatttatttgcaattttatcgtggcttgatgggtaaaaaacgttacctgctgctaaccagcactcctgcgatctttgatccttatgttacccgcgacttcctcactgaagccaatcatgcgttgcaacaaaccaatagttgcttgctagttttaacaacagatcaatccttgttaaatgcgaatcctaaccatgcttggcaggaaccgcctgtattgacgctgagtgccctgacaaaatgagtcttgttctcgttgctatcacaacttgaacaggactttttctatggtcaacaggtggcgcaaaatgcggccaaacaaaaacgacgagtctgcactcgccgtttttgtttgatttatttgcttatgctaaaccaactcgtttgaaaatctcatcaacatgcttgaggtgatagtggtagtcgaaagcatcgtctaaatcggcctgacttaaccgatcagtaattttcggatcagcttcaagcaacggacggaaggcgcgatgctcatcccatgccaccgcagtcttgggttgaaccaagtcataggcttgttctcggctcaagccagcctcgatcagcttcagcatcacccgctggctgtaaatcaggccatgcgtcagattcatattggctttcattcggtctgggaaaacatccaaattgtccaaaatactggtgaatcgatggagaatgtaatcaagcagcccggtagcatctggcaacatgatccgttcggcactggaatgcgagatatcgcgttcatgccacaacagcacatcttctaaggctggcgtctcgtatccacgaatgacgcgcgccaagccagaaacattttccgaaccgattggattgcgcttatgtggcatagcactcgagcccttttgacctttgttgaaatgctcttcgacttcatgaacttcggtacgctgcatatgccgaatctgcaaagcaaatcgttccaccgaagtcgcaatcaggccaagtgtctgaatgtaatgcgcatgcagatcacgcggcagaatctgggtcgagatttcttgagcgcgaatacccaactgctctgtgacgtacgcctcaacagcaggcggcgtattggcgaaggtgccgactgcaccgctaatcttacctgcttcaacatcgctagccgcgtcctcaaatcgacggatgtctcgcttcaattcagaataccacgtggcaacaaccaacccaaaagtagttggttcagcgtgcacgccatgcgtccgccccatcatcacggtatccttatgggccttcgccaacttcgctaaactagccttcaaggcggccaaatctgcacgcagaatctcgttagcctgcttcaacaggtagccttgtgccgtgtcgacaacatcggtactggttaagccaaaatgaacccatttcttctcagcgccgaggctttcagaaacatcccgcgtgaatgccaccacgtcatgatgcgtgaccgcttcaatttcatgaatccgatcaacatcaaacttagcatgcgcacgcaatgcttggacatcagcagcgggaatttctcccagtttggaccaggcttcggcagctaagatttcaacttccagccatgcagcataacggttcttctctgaccagattgcggccatttcgggacgactataacgcggaatcacgggctttttcctccttcaagtggacaaaacaacaacaggtatccttggtttgcgactgccagcacgcgatcattgaatgacaaagtggccagtcgcattcacactggctttgattgctttcaaatcacccacgatctgaatctcgccggttagctcgccaccagtcggataaaacgtaaatcgccaatcaggtttaatttgaatctgagtcaaaaccgcgtccatatcttctgaccgcagcggaatgccaacgccgtcctcagccaattgcaactccggcaatggccagcctagtatcgcgcgcagatgcagctcatattcagaaatgtcactcgtattcagcatcagatggccatataatttcggccctggataaactcgtttcacataaagcgtcccattgctggctaagaaaaattcaagactaaagatgcccgtataggctaacttctctgaaattttagcggcgatacgccggatctcaacaatcactgctggatcaacatcagcgcgcacagatgaagccttcaattgatgacgatcaaaataattctggatgaccgggccgatgcgcacttctgaccccgccttcgcaacgatcacagcgacttctttgatgttttgtaagtaagcctcaagaatatatggtcgctgttgcaacaactgctgtgcccgcgcgacgtcatctgccgtggacagcagcaactgctggtcaacgcccatccccttctgaatcggtttcagcaaggctggataaccgattgtgtcaacagcctctttaatatcattcggcgtaatgacttgggtataaggcaaaatgttcatattcagatcgtccaaaaagactttttccaaatagcggtcttgggtgacagtcaaaatgtcgaccccggaaggcaattggttggcagtggctaattccgccagcaacgaaccatcgacattctcatctgtaaaagtcatcactgtgcttaattgcgtgagttctttcagcgctgtccgatcagtggcatcgcccaccaacggaatatccgccttttcaaaagcaatatccgtttgtgtcggcgccaaaacgaccgtgcgcatgcccatcgaattggccgcattcgccatttgaaaagcagtcacaccgccgccgataatgccaatcgttgcacctggactaataaattgcgtcacatctgttcctcgctttgactttatttatctgaatcgcgttcgttcaagccttcatcaaccgacatttcttgcgtccgacgtggcgaattgaacagccaattcagcaaaaccgcactcaagctggtcattaaaatgcctgacccaaacagcaattgaattgtttttggcaagaactgaacgatatgtggctgaactgtcacgccaagtcccagaccgatcgaaatggcagcgacaagcaaattcttatcattgtcaaaatcaacctgttgcaacatccgaatgccttgcacagccaccatgccgaacatcaccagcatggccccgccaagcaccggtgctggaataatcgtggctaaagcgccaatttttggcagtaaaccaagaatcactaagaaaatcgcggaaaaaatgactggcttgcgggtcttaatccctgacaattgaaccaacccaacgttttgcgagaaagtggtgtatgggaaggtattgaacaacccgccaagcatcacggctaacccttcggcgcgatagccgcgcttcaggtcgtctgcttcaatttttcggccgactatgtcccctaacgcgaagaaaacgccagtactttcgaccatggatgtcatcgaaattaaaatcatcgtgacaatcgagctccactcaaactgcggtaccccaaagtaaaatggcgtcggtacgtggaaccagctagcctcaatcaccggctgaaaactaaccaacccaagaaaaccgccaagcaccgtaccagcaatcaagccaaccaaaatcgcgattgaatgcaggaaacctttgccccagacattgatcgctaagatcagaagtaccgtgaaggccccgaccatcagattggtcatgttaccaaaatccttggccgttgttgagccaccgccaagattttgaaaagcaaccggaatcaacgacaagccaatgaccgtgatcaacgaaccggtcaccaacggcgggaacaagaaacgcaactttgaaaaagcaccgccgattaggaaaacgaataacccagcaacaatgatggccccgtacatcgtttgaaaattaaacttctggccgatcatgatcaaaggcgccaccacttggacggcacagcccaaaacgactggcagcttaatcccaaaatacttgttgccaaatacttgcaaagccgttgcgataccacacatgaagatatcaatcgacaccagatacgtcatctgctcagacgtaaaatgcaacgaagcaccaatcagaattggtactaacaccgaaccggaatacatcgccagcaaatgctgcagtcccaatgcggctgctttaggattcgaaatcgctttattcttcatcgtgggctaatcctccggcgcaaagatgacctgaccattttcaaatgcattgatgcgcgccaatgattcgacgcgaacgtgcttttcatcaagcaacttgcggcctttttggaaagtcttctcgatcacaatccccacaccgctcagtgtcgcaccagcctgtgcaatgatatccatcaagccttcgaccgcctgaccgttggcaagaaaatcatcaatgatcaaaacattgtcatcggctgaaaggagcttgcgagagatagcgatctcattggaggtctttttagtgaacgaatagaccgtagctgtgtaaagatgatcttttaaagtcaagctcttatgcttacgggcaaaaaccaacggcttgtgaaactccattgccgttgcaatcgccggcgcaataccggaactttcaaccgtcagaattttggtgatcggctcatcgctgaagcgccggtagaattcatgaccgagatctgccattaaatcaggatcgacctgatgattcaaaaagttatccaccttcaagacatctgttcctattacttggccatcctttttgatccggtcttccagtaatttcaccacaagcactccttttaattgtaaattttcaacaagcttaccataaaaatcagtgtggaacaacacaatcacgctaattcccgaacaaacacgcgaagccgctttcatcaaaagaataagtaaaatccccgtgattctgctttaaaaagtccaaataacgaggattgccgcatcactaaaacacgaacgttcaactatcatattgggttagattccaagtttcaatcaaatgaatcaatttttgtggataatcaggatcagtagcatagccatccgtcttcaaagcagctgccgctgttttatagtccttagcggcacgaactgtggcatattgttgcggattccaatcagtcccattaacgaataacagcgcatgatcgcggatcgactcactgtcgttgtcatacacccgaaaacggccatcgaccgtgatccatttgtcattgacatattcctgcgtgcgcaacactttggtcgtggctggatcggtacctttgatgccaaacaggttatggtaatccttcgccaatgcactggtaccccagttggattccaaaatggcctgcgctaaggtgatgcttgtcaaaacaccatattgcttttgcatggcctgtgctgtcggcaccaagcgcttaataaaggcaactttttttgcgcgtactgccgccttttcatccgcaacttcttgtttttgcgtcacttctgtttgttgttgggcccagtatgaaccaaccacaagcgtcacaccgatcgcaaagaaaccgatgactagccaagcagcaagcggaattatttttaacgtaaaatgtcggcgccttttggccaaaagcattactcctttgttttatcagaacttgtcaataacaaccgtcgtcgtaacacaaccatgtcctgcaactgcatcccttctgcatacagcggattggcatactgatcgaagaaatgcttacggatcccgtcaaaccggaatccctggcgcatgtaaaaacgcagattctcgaaatccacatcaccagtaccaaccagcatatcctgatactcaggcgcatacaccagtccgacgtgccgtaacaagctcgcgccaataccttggcgacggcgggcaggcagtaccgcaagattcttcagttcaatggtggtagcatccacaggcactaccatggccacgccaaccggcacagtttcgtcaatcgctgcaaataacgtgccagcgtccaaataccgccgcaacatattcggatcctcatccccaatcaataaaagatccaaataatgcagccgagcttccggcgcaactttcacaaatcttaacatgcagcccttccccaccttccaaaaaatgtttcaattaacatgctatgaactagtttaacatgcacttacacgcattgagcacctgccaaatgagttttagaaaaagtcagacaatccgccacttttatttgatgccggcacgcaacatcgctactcacccattttacctgtatctgtcctcgtgcacacgcgaaaataaaaagccggttgcatctctgcaaccagctctgaaactttcatattagtctttgttaacgttaaccgcttgtgggccgcgatcgctgtcttcaactccaaaagtgactgcttggccttcttcgagggtcttgtagccgtcgccttggatagctgagaagtgaacgaaaacatcgctaccatcttcgcgagtgataaaaccgtaacccttttcagcattgaaccatttaactgtgccgtgttccatgagaacattcctccttgcgtctgctgacgcatgataatatcgtgtatttctgtttggtacaagtggaagaaagttctgaaaccatgcaaccacgaccattcaaaaagtacatatttagtctaccatcacgccaaacgccaagcaagtatagagcgtgagccaacccggttagaaatcggagtgtaagcggccttggatctgatgactgggctttggtcattgcatccaaggtccttacacgcagatttcttggttggcgatcgcgtttaagagcgtgagcaggcgcgattagaaacctgcgaacgcgtttttgcaatgcaaacgacgtttctcttcagttctattccagtcaagtatctcccctagtccgagctggctacgcggcgaggagggctggcgaccgcgaagctagagctgtgggcacagctttgaactcgcgcaaaccccgcgcgatttcaaagtctggccttgttgtaggcggtaaaccgccaacaacaatttcacggctgagccccctcgccgctccgccagctcttgctttctatcttagaataccgatgacgcaactacgctgttgtactcatgattgctcaaatgatcagagaatgccattattgaattttcgtcactttgagagacagaatcaactggaatatcgttaccttgcttgcggcgatgggacatcagcgaaaattgtgctcaatatcagcccactcttcgggttgataaagtgaaagagatttagcctcagcatatgggtggttaatttttggcactaatgagtaacttccgctcttgtcaggaactaacagaaaagcatcccccgcttgaaactcgaaccacttggcagcgatagtgctaatgaggtaccgagttttatgactttgacatccatcagattaaacgcccctttttattttccaacttaaatgactcaggacatgtaggaaaccgcaaatcaattctgtgatgaaataatattgttaaaattccgctttaactgcaacaagcgggaaaagtcttctaggaaatagaacaaacgcgcgcggctttcgaagcttgcgcggtctgttggcagcgctgatttagcaaaatcgcgttgaatttttttgaccatggtgaccaattgtgtggcgggattgtcttcagtcagaacactggccgtcatcgccaaggcatcgctgataacggctgcttgttccacaggagtttcgatacggtcaaggctgtcttgcatttgccggagcaactcatattgattgtcgcgcatttcaaaataggcttgaaaataatcgttatcggccagcaattgattgtcactatggcgattggcccaagcaacagcggcatctaaggtcattttcaaatctgacagattcgcccaattgtccgcacttttaatgtgatctggacccaattgctggctcatatgatcgagaatctcgcgcatctcggcttcgacttgtgcctgaaactcagtgattttggcttccagacttggcatgaacaaattggcaatcaatgccacaccagcgcccactgcgagcaataatagttcatttttaatccagaaccaactgcagcttttcgccatcataaaatgagtgactagcactgcggtcatgacgataccgctctgcaccgcaaacacgttggtcaaaggaatgaaaatgagtaagaaaagcccgaaagccagtgcattgtaccccagcaccaaaaatgcaccgatcgcaatcacaaaacctaacacggtcgccaataagcgatacgcgactagccgaaatgatgccttggtcgtattctggactgataaaatcgtaataatcccagcggccgtccaatattcaaggtgcaactcgtaagcaatcagcattgccgctgccgtccccactgctgttttaaccgttcgcatacctatgtgcatggccatcaccctccagagtcagtttagcatagaacattccatttaatgaatagtcaacacatgtactcgtcacgccccgctagtatttaatcgggctttacgctaccatataaacagaggagttgctatgaaaaaatcactcattttgttagccagtctggcagtcttgattgttggatgctcggcgactttaaatcctaaaagccagttaaaaaccacaaccgccaccgttcaaacgcaggtgcagcaagaacaagatgcgttaaagacgattggatcaacggtaaacgcctttccttctgcttttgaaaaggcttaccaggaaaatccgcaaactgatttaaaaaaagaaaatggccctgtcaaaaaacttttggataggcgcgccgcggcgtttaaatcactagaagccgccaacagcgctttggttggggcaaataatacgttgacaaagctcaacaatcagccatctgaggatacaccgcaaacacagttgaataacgttctcacaagtctgaaactcgccaagttagatcacaaaacactggtcagttattaccgcgaaatgttaacggctgaggataccttcttctccaccaccgcagatagtgacacctcacaagatgacttagaaagccaaatttctcaagtgaatcaatattacagttcgctcaatcaacaaatcgatgtcatgacggccaatctcacaaccgtcaccagtcaaacagataaactagcaaaagccattaagtctatgcgggattagttttattataacggcaccgtacgagttgacacgtcaaattattttcccagccatcatcaaattaacgcaaaacaggaggccttctcatgccgcaaagtgtggcaattatcattccatgtcataacgagtcagaaaatgtcccgctgatctatcaagaacttgttaaaacattccgcgacgacttaaccgcgttacaagcccaaatttggtttgtcaacgacggttcaagtgacgatacccttcagcaaatcaaacagttacaagcaaaagacgatcaggttcacttcattgatctttctcgctcgtttggtaaggaggcggccatgtatgctggtctctccaccgcaaaagcagactactacgccgttatggatgctgatctgcaagacccgccagcgatgcttcctgatatgtatgccgccttgcaagacggctatgatatggctggtgctcaacgcactgaccgctcaggcgaagctcggatgcgttcatttttctcggatttattctataaattcattaataaagtctcgcaaactcaaattgtgccaggggcacgggatttccgcttgatgacgagacaggttgtcgaagctgtcattcaaatgaccgagcgcaaccgcttctctaaagggctattcagttgggttgggttcaaaacaaagtatctgccttatcgcaacatcgagcgtcaacatggggagacgagctggtccttcatggggctcttgcgatacgcgcttgatggcatcatcgacttctctgaagcaccgctaactttcgtctccattcttggtatcgtgagtttcgttggctcgttttttgctttaatcttcattgttattcgcgcagctatttacggtgatccgaccgctggctggccgtcaatggtctctatctttctgatgatcggcggcctccagttgtttgccctcggcatcgttggccgctacatcggccgcatttacttagaaaccaaacgacgcccgatttttatcgctcgggaaatcaagtaattgaccatcacatcattgggcatcattcaaaaagatttgggcttaaaaatcttctgccgtgccaaactccgcaatatgctctatgaaaaaacgaaaaacggctgcattttccacaatattggaaaatcagtcgttttcatttggcaactatgattctcaccttaaccctagattgtttttactcggacccagccgttatccgctcatccgttgcccgttgcctacgtgtttcacgcaacaaccaccagccgccaaagccaaacgcagccactaaggaaagccagccggtcacatgttgtagcgtcgtacctgtatagacaactcgaacacgatgcgtgcctgctggtgccgttatcgtgatctgagcatttttcccacttggccagtagtcaactgtcttaccgctaatggtcacatgataaccgacgtagccaaattttggcagcttcagggtcaccggcttgctgctggtataggtaaaacgcatatcattgtaagtttgggtcggcatcgttagccgagtcaattgatgagaagccgttaccgaataagttgtctttttaaaaaaagtcgttgaatcaaaatcttctggtgcatactcactcccgccgccagttgcatcttcataataagccgttgcattctcatcggtgatgcgataaatgttggcattaagcatcgtcgcattgatattcacggcataactgaaaccgacaatgcaggttgccagcaccagcccccaagcaacatgtgatgaggctggacgatccgccacgatcaacccaattgccagactaagaaataaagtcgtcagctccaagtatcgccaagggaattggatgacaccgaagatcgttttgctaaacaacgaccacgggaacaaattggtgcttagaaagatcgtcaacagccctaggccagcaactaccttaaccgcttgattcaatttccgccaacgaatcaccagcacaatggctgtcattaacatgaaaatgcccatgccaggtcgaaaggcttggccgacattctgcatattactggttgaggcatacatactcagggagttctcaaaaagatcacccaaactatagaggatgaagttcggccagatcgtcgcagactcgcttaacttcaacgcaatatgactggacatctcaatcatcggcaagtagctgcccagtcccatcagcagcgtactgatcgctgccagtatcgtgtacttgaccattcgccaagtcacgcgccgcatgccaaccaacacgagaaagccgccaaccaaaaattccagcaccatgaccagcgacaacatatgcgcacacatcagaccggtcacaccaaacgccagtaaaaaccagttatcggttcgtttgacgtaaagctcatacatgcccgcggcgatgatcggcaggaaaatgaaggccagattttcacccaaggccccccgcacaaaggcgtctaaggcccggtagaccgcagtcgtatacaccatgctgaaaacaaacgccgccagcggttttcgccgaattttcaaaaaactagcgtaggcagccaatactgtgacgatgagaatgagggcctgataaccatcatacgcaccgaccacccccatccccatcagccgtagccacacatatggcaacaacattaatgaaggatagtacgcgtcaaaagcatagccaaagttgcggactgcctcaggaaaaaccttgggaaaatactggccgtgccgcacactggttacatagctttccaaccgccgcagctgtggcatcgtatcgtcttgatgaaaaatatagggtagatgcagctgcggccactgcacgagcaaaaccaagaccatcgccaaaatcggcaacagccagacagcattttgtgtcatgaatgtcttcagctttgctgatgatgtctgtgcgtgcataaaccgtcctcccaaaataactttcattctattgtaccgttccccgatgctgtttgtcttaccggaaaagattattttcatccctttgaccacacgacctgatgtcacaagtatcaccaattgctacgttttttttaaaatagcagccacagcgctttcattgcgcttccggtcacttttcagttcaaagacgcgttatgattaagttaatattcaagacttgcttatttttaagtcagtcattttttctgcctcaattttcaagtcaagtgcaacgatgataacgaattcttgatagtggtctaggctgttacgccatgcatcggtagtaatcgcatgggcgaagatagttcagaatacgtctgggacgatggttcagtgcggagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggagtgaaattcattttcacaaaggccgcgtctgatttcagaatctcgaagcccgcttcccgcaactcggtcataacttgcggtaaattattatctggaaaagctggtacatagttggcattcaaaaaccgtgacagactgtaattattagttgcgccgacttgttgcgagacaaagagaccgtgcggccgcaacacacgggcaatgtcgcgtatcggcaaaccaccgtgactgttggtgacaatgtcaaaatactcatcaggaacctgcgccaatcgttcttctggatccggatatagcgtaacgccttgcggtaccaacgtgcgttttaacagatcaatattaggttgccaaccttctgtgacggttgttttttcgacaggatgctgaaaagtctgcattaattcaccaccgcctgtgtccatatcgagccactcatcacttggcttcaaatgtcgacgaacccaggccgaataattccacggcagttcttcggtttggcaacgtccctttaaatggctaaagtcccagccacgcatggcctgttgactttcagcaagccactctgattcgattgtctgcattgtgtcatccctcttcatcacgtcgttacaccagcgttttcatgaggtcagtttaccactatacccaaccatcttcgccttaatcgccgctcgtcactttaatcccaatgatcccaatcacaagcagtgcaatgaagaaccaagtcgctggttgcatttgatctttaaacaagaccacaccaacaataatcgatccgacagcgccgatcccggtccaaaccgggtatgccaagcttaatggcagatgtttaacggcaagggccaagaaccaaaagcttaaaaccatcccggccaaagtcgctaacgtaaatcccaaacgactaaagccgtgcgacattttcataaaggttgcccaaacgacttcaaatccacctgctaaaactaaatagaaccactgcatgaatgtgtcctcctcgtatcattttgcagactcaaaacaaaaaggcgacagtatacgcaaccgctgcattgacctaatgcggttgcgatactgtcacccggtagtgactgctatttaaataaatgttgatgttattttttcacatattgacaacggcgtcaaggaaattgctaaaagttccgcgcaatgacccacaaaatgatgagttgcgtaaatgcgaacgaccaagtaaaagccagcgcccatttgctatgttcaacaaccatgagatgcccggcaagattgccaatcaccaccaatgccattacaagccacaacaacgctcttgtacgatggtcgattggtccctttgaagtgcgcatgatccagaaaataatcattgatgtgattgaaacacccaaaagaaccccgataatgtgtaccataacgctaccccatttcgagcgcataccttagttattttgcaaaacattctatccgtacttcttaaccatatcatgtctccacttgatccaaggcaccattttaaacagctttgccaatcagcagctctgtccatcccagcacaaaacccgccctaatcgcaacattcattgattgcacatgggagaattgggtcccataaagtggcaagacatcttggcgtcgaagctggatttcagcggttagttgctgtactaaccggctggcaatgccttggtgacggaaggcagggtcaagcagctcaacgccgatctcccaacagtacctgccattttgactggcgcctgctacggccacgaggtctccgtctagttcgtagccaatcccaaggcgatccggtgccgccggatcataaccaaacgccattttgatcgcatgattggcttggtatttcggaatcgcatccgcttcaatcaaatgcatgcccgcggttaattggcgacttagctggttactcggcacgaagaaaggtgccatattggtcacttttaacccaaaattccgaagcaattcggtgagttgctctacggttttcatttcaaggaaccacgccccgtctgcctgtccaaaagcatctgctaaggcagctgtgacctctggcttcgttgtgcgcacccatagtcgtcctttgcgaatgacaatgtcaccaacatcacgcgcccaactgcgggcagtcggcacaggcggtctagtcacgaaaagatttcctgtattttgcagccgcgatgctggcacttgcaaatccagtgctaattgtttcgtgataagtgacatctcatcctccagatttaaaatgttgggcgttacttttcaaggatcttgcttaaccatgacacgttcgcgaatcgtcccaaacttggtcgtatcttccataatctgatctgtcacgctaaagccaaaatgctgatagaatttctgcgcagatacattattatccaaaacacgaatataaaactggtcaaatttctcatgcaggcgttgtaatgcccgcgtcatcatgacagcaccgacacctgtgtgttgaaactgcggcagcacataaattgaataaagctcaccccagccgttaaaatccggcaaccgcgctggaccaaagctgcaaacaccaacaattttatctttgtcatcaactgctaacagcgtgtcttgccagcgccgttccgggtgccaactggccggtgagaggtgcgccaaaaagtcatctgatatgagtccgtggtatgcgtcctgccacgtcacgtagtaaacctgccgaatagcatcaaaatcagagctagctgtggcttcaataaccttcactttagcagtcattctcttcgcctcatttaccgttaccttgctgagccaaaatccaagtcgcagcatccgccaaactggcacattcaacaaacgaacccgccacctcttgataacctgcatctccacgccctgttgcgacatgaatccccaagatgccagcattaatggcacatagcatatcagccagataactatcaccaacgatcacagcatcacgattcgcaaaacgatagcgaagatgtgcttgtgcaatcagaccggtcttaggttttcgacatggacatccagcgttctcagcatgtggacaaataaaggcatcagaacatcccatttcaagtaacgagatgcgcagcgcggcttcgtccaactgaccagcagcaatttttgtctgattcgtcagcgcaaaaacttgcaacccagccattcgcaaagatcggatggccgccacactgccgggataaggttcgaattgatgaatcgccataaaatgaccgtccccgcctatggtgccatcgcgatcaatgaaaactgtcttgatgaccaagtgtgaggctcctttcagtcgtatcaaacaactaattccattgaattgctttcattatatgtcagtgatgcgtttccaaccatccgaacatttccgtagatcaatatcatccccacatggttcatggcgtgtttttttaagcgacaccttgataattgactttaaaatgcaagtgctctatattccttgttattagttcaaaaaaataaaccattagtcgaggaatatgtcatgaccaaaaccatggaggccgcgcttatcacgcattataaacaggctatgcctgaaattcaaaatgtccctttacccactgtgcgaccaaatgatgttttggtgcgcattgtggcagcaagcattaatccaattgatctcaaaacgaaagacggcaagctgcgactattattaaaataccagatgccattgattcttggcagcgatttttcaggtatcgtcacaaaagtcggaaccaacgtgactcgttttaaagtcggcgacgccgtttttggccgaccacaaaaagaccggatcggaacatttgcagattttcttgcgattgatcaacacgatattgctttgaaactcagtcggctgacatttgaagaagctgccgccttaccccttgtcagtctcaccagttatcaagcgctacacgacttgatgcacttaacgcctggtcaaaaagttctgattcaagccggagccggtggtgtcggtaccgtcgcgattcaaattgccaaagcccttggtgcagaggtcgccaccaccacgagtagtcagaatatcgcttttgttaaatcactaggcgccgatcacgtcattgattatcaccgtgtgccatttcaggatgttctgtcggactatgacggcgtttttgacacactcggcggcaccagtcttgcgaatgcgttccaaatcgtcaaacccggcggcatgattgtcagcgtctggcatccctgatgaaaagtttagcgatgcttataacgtccctatttggaaaaaagtagcctttcgcttggcaaatcaccatatcagcaagatcgctcgaaaaaccggtgtctcctaccgttttctatttatgcatcccagcggatcagaacttaaaaaaataagcgagtttgtcggaagtgacaagctacgccccattattgatcggattttcccttttgctgaattaccaaaggcatttgcctattcacaggctggtcacgccaaaggaaaaatcattttaaagctggtcgataaccctaactcacttttgcaggtataaatcgcgaaattgtgcaatctcacctgccgatagcttgagtccttcgcgcaagtattgctgaaatgacccaaattgctgatcaattacttgaaaataacgcttcagataatccgcatcaactttcagggcttctccgattgattttaactgttgatcagtaaaaccccgttctttgagtccagcaagaatctcttcattggcgactgtgcgctcagcattggtctgaagataatcggccatgatgtcttgctcgctcacgtccagtattttcaaaatcaatgcggcgccaacgccagtgcggtctttgcctgcaaaacaatggaaaatggtgggttcgtttgggcgcaacaaaccttgaataaactggcgatacccagtcttggccgaatcactcagcgctaactgctcataagtcgccagcatattttcgtgaacattgcccttctctgtaatcatgcgcccaaggctagcattattggcggtcgcatccttgagaatgtccaacacggcatagtccgccccttcccacactgtgtccggaaattccgtccgctcgtcgtcactgcgcatatccacaatgtgcttaattcctagcgtctgaccaaggtagtgactttgatcatcctctaattcaaaaagctgcccagaacggaaaatcaacccatccttcaccatttgaccgtgggcgttctggtacccgcctagtgaccggaaatttgtaatctttttcaacgtcacgatgccccttcctgttgttgcgacgaagacgatgatgccgtttgctgatgtggacatttttctagccgataaagctgttcttcgtccaccgtttcgtgaccttttttaaaggtataacccatgtgtcggtaaaaatttacagcagtgattgacgccggaatctcaacacgctccgcctgtcgaaaatagacatcatgctccaacgtgtgaatgataagctctcctattccgcgtttttgatacgttggcaacacaaaaatatcaaaaagactatattcagttgtactgccccagtacgacccaatcgcaccagtaccaacgatgcgattaccgtcatgaacaatataaaaatgagtctgctcggctttgtctaagaaaaattgcggcgacattcgcttaatcgtagcttcaagataagctgatgaataatcttggctattgcaaatgtttaatgtggtggcaacaacttgcgcgacttctgctgcatctgctggtcgaaatcggcgaatttgaatcataactgatcacctcacgaaacaattttggctttatcaagttgtgactaatttatcacacttattcatccattagggaaatatcgttatgtttcaccgtggttgttgccagaccaggacgtcttctaattgtccagttgtctcatcccgatcttgctttaaaagcgtaaagccatgtcgacggtagaaacgagctgcgcctatgttcttctgataaaccgctaacgtcagcttaggataggtctgttgcagtttggccatcaacgctgcccccacgcctcttccgcgggcctgctcatcaacaaagaaaccagcaatgtagttatcttgcaggccacaaaaagcaatgatgtcatgatcacgctgatcctgaacaagccaaagtgttgccttgctaatctgatcacgcaccagcggcacatttccagtccaatagtccgctgggataaaatcatgggcctgcaaattaccttgtagccagatcgccataattcgatcaagttgcgggggtgttggctgggttactagttgaatcgtataagttgtcatcttaacctctgaattcactgttttcatgtgaaactttagctgcatcgtaacttcaagccatcagtgccgcttttaaccaattgctgtcacattcgcaccttttttcccattaagcagttgcgaaaagatgtcgtaccgatgaaggcgcggtgttctcgaatcgtactgtagcccatcgccttaaaaaacggctgagcggtgatcgaaacataagctgtatactgcgatgacccgactcgttgctcaagtgccgccactagtcgtttgccgaccccttcacgctgatgcgccgcactgacgtagagccgatccaagtagccatcagacgccatgtcagcaaacccaatgattgtctcggcttcatccaatgctaccagcgccacgtgtttcatgaagctggcatgccacgccgcaagcgatcgctcatggccagccaaaacggcaatctgatcagcggtatagtctttcgcgttgattttttgaacggtgtctctaaaaagcgccaaggtaggtgcagcgtcacttggctggtaggatctgattatcaacaaacgactcctttttgataggcactttggagcggtgtggcggctggcaagccgattgcctgcttagcttgggcgaaaaatgtttctggtgtcatgctcaaaaccccgtttcttcttgtcaatatcaaatccagctgattggcttactcggctgtcaactaaaaaccagtcggcgatcctcacgttgtccctatttatgatagggactgccaatattaatcataaaggctcgataaatctgttccatcaagactaagcgcatcaattggtgcggcatggtcaacttgccaaaactcaaagtatcattggcacgtttcatgactgcaggcgacaagcccagcgacccaccgatcacgaaagtaatgtcggaatgcccataggttccaagatcggcgatttctttcgcgaaaacttcggatggccgctgcttgccttcaatcgccaaagcaataacccattccttatccttaattttgcctaagatacggtcgccttctttaactttcacatcagccatctcagcctcggagagattctctggggctttttcatcggcaacttcaacgatcttaaccttagcgaatttatccatgcgctttaagtattcagcaatgccgtcgcgaaaatacttttcctttaatttacctacgccaatgatcttaatgttcatgttggtatgatctcccatagtctcgttgtttgaccgatttttttctgtttcaagtataccagacgttctgggtcgaccagcaatgcatccaacaacaaactggttgggatcgttgagagctgatgtagggacgcccaacaaaaacaaaacggctaagccgctcgcgtgtagtcccttcaaaacgcgttcgcaggcccagaaacctgcacataaggacctcccaaagcccagccatttaggcttgaggccgcttatgctccggtttctaaccgggcctgttcacgctctgcctgtttgcctattgtcaatgttcggattatggcgcaaaatagtccggttgaggtttttttaatgaggtaaattgatgattgttattcagcgtctgatcaaagatcgggtcctgcagatcaccgccttgttggtcgtcataagtctgttcattggccggccaaaagcaagcgacataagttttgccacattatggtcaattctcgccatgatgacggtgattcaaatcttcgagcacctacatattcttgattactgggcctatcgactgacttcccgggcgaaaaacacgcgacagttaacgtggtggtttctttttcttgcgatttttgccagcatgtttctttcaaatgacgtgaccgtcttgaccttggtgccgctctatctgcgggttgccaagaagtatcagttacccgagattctcccggtaaccttgattggcatggccgcaaactttggaagcgccttcacaccatttggcaatacccacaatatctttctgatgcaccaatttcaaattgacttgcgccagttcttcggctggtcaattccgttacttgccgttagctttttagtgttagtattgctaagccttttcttgcgtaatgtgcctgtcccgaatgtcccagctgagcacatccatattcaaatgcggccgaccatgtttgccattgccgttgcgtgtgtcgtcttcgctggggtcattggtcttgttcctgcttggttaggggctgttttggcgattgccttatccttagcactggaccctaaagatatgcgagacgttgattacgcggtggtcttaacgtttgctggctttttcattattgtcagcgtcgttggccagattccatgggtaatacacttccttgctggtttagaaaactcagaggaatctgtttatcttagtggtgttttcaccagtcaggttatttccaacgtcccgtctacagtgctgctggcacgctttacaggttatgtcgaggctttattctatggatcgaacatcggcggtgttgggacactcgttggttcaatggctaacttgcttgtcttcaagcaatacatgatttatggtaaccggccccatactcgtttttttgtcggctttacgatttttaacttaattggtttgattttgttgggttgtgccggttactggttgacggttcgttaagcagcaataacctacctcgaaaaagtcagccaattcgacatgcttcgttaaaaatcaggtcatgacagtagtcaaatattacataacaccggtaatgtatgcgttttcattgcttttctccggcaacgtgctagaattaggatttgctaaaaggaacagcgacattcgaagcgaaccaccgcgacaggttatttatggacctgtcgcactttgtttgtacatcagttgagctgttctataatgcgtctgccaatgaagcaagctgtctatctgcctcctgatgtgatgatcaaattttaatcatcacatcaggaggtgttggcaccttgtccgctaaagatattggttgacgctcgctcttaggaggaagtatttatgaagcgcaggacgttgttttcgatcatcgtcatcacgctgaccgcaggattttttaccttattttacggtatgcatagtacttggacagatacccggtcagcgcaggccgttcaagccgctaccgaccaagtcaatgatttgttcaaggatcaatcgcatcaattaccttcagaccagctaaataagcaggctatagcagctgccgagaccaaattacaacaggctcgtcagaaggccaatgatgcagaccacgctgccgcacttgccagcgctcaagccgatgttgatgccgctaaacatatgctgattgttaaagatgctgtcactcaaaattcaacaaaactggatgagctaaaaacgttgtcagatgagtcgcagcaagcattaaccgagcttgccaaacagaaaccgacatttgtccaaacctatcaggaacgggtggcacaactgtctgatcaagaagcggctgtcgcgaaaatcgccagtctttttagtgacactgatttcaagactcctaagccaaatctgagcttggcacaagtacaggctgcattggctgccgttgaaaaattggacaataaacaattcgccgaccaagttatgccgctaatcagtaccgctcaagatgccactgccggagaagacagtcgtgacaccgaaccgtcagcatcgtcagtactgcctagctccgccgatagtagtcagccatctgttgcagacagcagtagtcaggctagctcatctaccgctgtctgcagtgaatcggagcaaagtcaggcatctagctcaacctcgacagcaacttcttcatctagccagaatccgtaattttttggatcactaaccgatactcaggcacgcgttgtctgtcaaaaaaatgacgataccgcacacatgcagacttgtgcggatcgtcattttttattggccaccgctaaaagtcagtgccaattaatttgctgttttcgtcttggccaattgcggcactaactgggtcaaatagtcgataaagctcaagtaatcagcaatgaccacattttcgttgggaccatgggcggcagaatgggcattgccaatgccgcatgaaataatcggtgcgtgattgatatcataaaagtacttcatcggtccgctgcctggagagttcagctcaacttgaacatcatcatccccataagtcgtacgcgccagttgcaaagccgtctgaacacgtggatcgtcaggatcggttctaaatggcggctcgcttaggaagtcagacaccatcacatcgtcataaccgccagccatcaacgcttctttgactagccggacggtctctgccggtgtctgatctggcaccaagcgcagatcaagcttcgccagcgcggtgtgcggcaaaatggtcttgccaatgccgggaccctcatagccgctggataacccgttgatggtcatacttggccgattataaagggccgccttaatgtcatcagctggccccgttgccgggcgggtaatgccgtagttcttagcaaacgctgcatagtcaaaggcggcgtcttgaattaacagcttttgagtagctgtcagcggcttgacgacatcaagaaaatgcggaatcgtaatctcatcctttgcatttttcaatgttgctagagcctgaaccaaccgccatgccggattttctgtgatcgcccctaaactagaatgaagatcaaaatctgccgttttaacgctcagctgaaacgcgacgccacctttcacgccaagcgagatttgaaacttgccttgctcatttcgaccgccagattcccataggcagaagtcagcggctaacagatcagcatattgcgctaacaggtgatctagatttggactgccttgttcttctgccccttcaaccaagaacttaatggtacaaggaagactgccttgcgcttgcaggcgctgaagtgctgccaagcgtgccgccagttcacctttatcgtcatttatcccccgagcgtacagatgggtgtcggtcattttcaactgaaagggatcactttgccataaggctagtggttcaactggttgaacatcgtaatgattgtagaacaagattgtgggggcatctgctgtctgcgccggaaaaaccgcgtacacagctgggttggtgcggtctgtgtgcaagatgcggcttgttgttgcgcccagcttggtaaactgggttcgtagaaattcggcggtttctggaatttcattttcctctgctaaagagacggaatgaaactgtaaatacttcgttagaaaatcctgcatgggtattgtcatttttcgacctgctttcttttgtcactatttgaagtaagcgtgccggtattccgccggttgtaacatgctgtagtgaagcccgccaaccttagtattgatcagccgactattagcactttggaaaacgggaatgtatcccgcaacatcaataacccgcgcattagcggccaattcttcctgataacgtgccttcgcgctttggccattggtgttatttactttagccatcaaggcagtgaactggctatcactgaacttagaaaagtttgaaatgttagtggctgtggcggtattgagatagtcggatgggtcttgaatcgttgagttccagctcatcagtacggcatcaaacttaccatcaagtgagcgttgaattcgggtcatttttggcaagctgctgacggtaacttttaactgcggtagaaccttggtgagctgactttggatgtactcgccgacttgtttatcggtgtcaacatctgaggtcagaatcgcaaaactgatgctgtcggtatgcaattctttcaaggccgctttgagataagccttggctttagttggtgaataagtcagtggtgtgtcagcatctgcggtgaaatctttgccagttgatggattcgtggctaagccttgcggaacaaaggctttagcaggcttggagccgtcctgcaacactttagttgtcatggcttgacgatctaacgccgcagagacagctcgccgcaaattaacattgttgagctgtgggttcttggtattgaattgcagataattcatgttggccgccactgttttggtcaacgcaggatttttggcttctttttggattaagttgcccgacaacggtgcatcatcgagcttgcccgttgcaaaaaggttatcgatcgtgctggaatccttcaaaaccgtcacatgaactttagcgattttgacagcctttttggcaaaatattcgggatctttcacatagtcccagctatcactcgtggtattaaagtttttaattttatatgcgccattggtcacgattttatccgcgctcgttccgaattgcttgccataccgtttcacagcggcttcattagtcggataatagccagtcatctgactagcaaaatagggggttggctggctgagctgaattttaagtacatatttgcttggtgccgaaacacctaatgtatcaggggatttcttgccagcaacaatgtcctgatagttagcaatcgcatcgtattgatatgcaaattcggttttcgtcttaggatcaacgatgcgcttcaaggagtaaacaaaatctttggctgttaccggggtaccatcactccacttcacatctttgcgcagcgtcaacgtatatgttttcccgccatcagttggtttgacaacctttgtcgccatcgccggaatgatcttcccgtccttatcatggtcgtaaagcggcgtcataatttgttccaaaataccgccgctggttgcatcaacggcatgcgccggatcaagtgaactggcctctgtgctgacggcaacgtttagcgtacgctgggtcgttgcagccttggtttgctgtccgcatgcagcaagtagtgcggtgatcccgaataagcctaaacccaagaaaacatgctttttcatttttgtgcacctcgtttggttgatttgtgtcgcgtgctgccatcaagcatgttttgcttgatggactagcttccataacgcgctcgccagcccagaaaccgggctgactcgcgctcacaaaaaaagccgtccataacaaacatcttgttaaggacggtttcccgcggtgccaccttagtttgatcaaagagactgcgcctgtgtgcctgtgtgatggtagcatctggcagtgtttgatcacgcttagcccgaggccaacaccccggcgacaactgacgtatgtcaacacgtttccccgtactcgaaaaactttcgggggaaccctcagtggtccatttactgacctgcgttcggccggactcgcagcatcgccggctctctgtacgtgcacaatcagcttgatctccacttcaaaggtttgcatgaacggttatttgattgactcaaacactaaccgaatacctgcatggttgtcaagcatccaccgattaaataacgggaaacgcttcgcgaggcttataaaataacggcttttcatttcctcaaaaagtgtagtcatgctgatccagcaaattttggcatcaagagcattcagttcggattatcaggaaaaaactaaacagcatgaaaaaaggtgcaagttcattctcatttttgaatgaacttgcacctttttagtaaaccccttatattacaaatacattaatgtgtaacaaaaagaagttgtttcgtgacctgtttgcaatggtcttgttaagtccggcccgtatcattaggatattggaggtgccatcaatgaagcgaaaacatattttccaaatcttgatcgtaaccctgcttgcaggttacttaaccgttttttacgggatgcggaatacgatcgatacctcatttgaacaacacgccgtccaagcggcaacgcaacaaatcagccaactatactcgtcatccaagcgaactttccctgcgaaacacttatcacgatccatggtgaccgcagctcaggccaaggtcaaccgattagttcataacgtggaaaatcgcgatcaaaagaaaattgtcgccaaggacaaacgggatgctgacgctgccagtaacatgctaacgattcaagaggcaactaacgcccagagtagtaatctggcgcagatcgaatcggaaggtacccgagccagtgcagcctataaggccattgtcgcaatcaaaccggcatttgcagctgactatcagcaagctgtcacacaactttacaagaaatctttagcgattgcgcagatcaaaaaactttataacgaccagaatttacagcacccaaaggccgatctgagcagcagtaacattgacctagccatcaacgccattgaaaatgtcgaaaatcaggactttgccaaaaacgtgttgccattggtccaagtagcgaagaaatcacaagctaacaatgatacgaccgtggcaatggaatcgacagacacatcttcaaccaagcaaaccgcaactactggtcggcaaaatcagcaagacactggtgaaccagctaacggcgtgtctgggaatcatgcgacaactgcaggtcaagcttctgatcaaacaagtcaaccgagccagaaagctccgagtcaaccgactacttcaccgagtgggacaagttcaagcaccgacaataatgctggtgcaagtgcttcctcgtcaatatcagcatcagccaacaaagcagagcccatgacggccgttttgagcggcggtttgtataaaacctatgacgatgcagttgcatccatcaaaattcaaggcaaagccgttgatgacatgacgatcaggtctgtcacaatgagcgacggttcctttcagtggacttggggaccaaacggcgacagtggtagcagtagttcaaaaccaagttcctctgcgccatcttcttccaatcccacagggcaagatgcaaacaaaaacagtcaaccgcagcattagacctttgctactttcaaaaatcgctgataatggcctcttcacccaccatcatcggcgtttcgctacgttatcatatgattcaaacaacgtttaagtctcacaaaagacccgcatcagttcgacagctacgtcgaattgatgcgggtctttgggttttctactagttgatctgctgaatctgttcacgttcagcagttgcccggacaggatccacaagtgcctgccgatgcaagccattgcgcgctcgcagagcatagagaatcgtcacggtatcgacaacttcttgcagcattgcgccaataattgttggaatgacaccgaagctggcgattaacatcaaacctgtacaaatcgcaatgccgatgaggaccgcttgcttggcaatgaccatggtttccttagcaattaaagtggccgcagcaactttcgccaaatcgtcgcgcagaaccacggcatcagccgattcgcttgccgcggttgccccatgtgcacccattgcaatgccgacatcagcaatcgccaatgaaggtgcatcattgacaccatcaccaaccatcacaactggccggccatccttagggacgttatccaaaacttcaatcttctgttgtggcaattgttccgcatagacttggtcaatgccgacctgtgccgccactttatcagcgattgactgctgatcgccagaaatcataatcagcttagcatcatttaattcgtgcagtttcgtcatcgtttcttttgcttctggacgaatctgatcggaaaatgtgatcgcacctgcgtactggccatcaacattcacatacacggcagtcgtatcaaccgtagccttcgtcccagcaaactcggctttaccgaccttgactttgcggccatccaccgtggcattaacgccaaagctagttgtttccgacacatctgtcgctggcagccgatcagctgtcggcacagcatctgtcagtgaacgcgccaaaatatgagtcgattgaccttccgcacttgcggctagcttcaaaagctgatcctgtgagaaaccggcttgtggcaaaatcgtcgcaacttttaaaataccgcgtgtcacggtgccggttttatcaaaggcaaaggttttagcatcacttaacttttctagcgtagtccctgacttgacaatgatcccgttgcggctattacgactcatgccggagaccatcgcaattggcgcggccagaatcagcggacaaggcgaggccacaaccaatacctgtgcaaaacgaactgggtcgccagagaagaaccagccaagacccgcaatcacataagcaatcaacgtaaacggtaccgcataacgatcagccatccgaacaaaatgtgctggtcgcgcttcggattccttaaccagtttaataatcccttgatactgactatcttcagcccgttgcgtgaccttaacagttagggcagcgtcaccattgacggtcccagacataatgtcactacctgcgtttttggcaaccggtttagattcacccgtcaaactggcttcatccaccaaactctcacctgccaaaaccgtaccatcaactggcacgacttcctgcggcttaaccaaaatcgtttcgccaacttggacggcctcaacttcaacatcttcaacgtgtccatcaaccatacgatgcgcggttgtcggtgcattttcgagtaattgctttaattcactgcttgcttttgttgctgcgtagctttcaagcgcatcgccaccagtcagcatcaataacacgatcatcgcagcccaatactggccaaccgccaaggtggcaacaaccgccgtaatggcaagcaagtcaacaccgaagttaccagaacgaattgtcttcaccatgccccagaacataattaaagcaatgattgaccccatcaccgtgatcagcccttgcgcgatcaatggttgctttaaaccgaaagcaaagactagcgcaatggcacttacagcaagcaccatcattaattgccagttctttttcatcactgccactccctttttctaagtaccccaattataacctttacaatctgaaagcacaaccttttttagaacgaatataatctgtcccacttagatgctcgacattcatggtttctattaattgagccatggctaaactcttctaccgaaaattaactcaagtgtccatcatccccaaccagaatcttaaaccggcaatgattgaccccgttaattttatggcttccctaatattcacttcatattatacgcttctcatatgataaggctcacataacttgcttttttaacaaaataaaagaccgcaccattaaaatcggtacggtctctcgtatataaatgaagctaggcaaataattcgtagatcaatcaatgttgatctgatgattgcccttttggtcgcttgtcatttttggcagatcgatcgtcaggacaccatcattgaccttggcgctgatctgaccttcattgacatttggcagccgataactacgactcatgcggccatagctacgttctgacattaacatgttaccgtcgttgtcagcatgatcagcctgctcctcatgtttaacggcaatgctgagcacatcacgatcgtaactcagactgatattttgcttctcaatgccaggcacatcaactttcacaacatacgcctgatcgttttcctgaatatcagtctttagaacccgactgcgatcaacatttgctggtgtcaagctgtcaaaaagatgacgacccaaatcgttaaagaaaggatcgctcagccaatcattacgacgcatcaaatcattaggcatattcgaatacttcctttcatatcgaaggcgtttcatgtcttccctacaacacctttagtataccacaaaaattagcactcgcaaacgtcgagtcctaattttgtggtcctattcaatgactggttgatgcaaaaagtgacttaatagcccagagctaccttagcaaattttgccgcccagttttgtcatgtcatcccgacgttgtgcatcattttgtggtaaggcagcgtccttattcaaggtcacagccccatcaagaatgccgctgtcatcacgcagagccaacgatgcgtttttgaaatcaagtgtcagaccactgccgaaataatccgtttctgggtcacccgttgtcagtttgaaaccagcttcgttgtccagtggcagcgcataatcttgatcatcctcatcggcaaccactaactgatatttatttccaatggcacaagaaccgccaagtttggaatatttgcttgagccgtcatccagtgccaagaataaccgttgatcctgattgacatgatccttcaagtaagtgactgctgctggtttgattgagatttgcatccgaaccatcctctctattgagttgtgcacaaccttttaccttctttatcgtactcacatttccaaatgaagtcaaattccgagtttttcgcaacgaccaacaggttatccacacgtcttatccacaggttcataacttcatacgccaaatatagtattaagtattcgaattgacaccaaataggcgatttaaaaaattcaagcaaaaaatttttaaaaagaagtcatccacagtttttgatcgttcgatttcacaaacttcagctcacgcatcccgttccagccgctgggaacaaacgttttgtcacaagttaaaaaagtttatccacaggttatccccaagtcagtgaataacttagtcacaccccagaatcttagttatgaacagtatccacagagttatccacaggtaaagcatcaactttaggtaaaagttacccactcttgacaaatctttttcttgaacttttccacaggttggccccttgaattttcggataaaagctcaaaactgcagagaaaccgcttgccactaacttcgcaagtgcatcaaaaaatcctcgagccagaaacgaacattttctgactcaaggattatctatttgtgtgatttagttcttaaggtcgcttgtcgtttgcgacagcttcacagagactgtctgctgttctccggcacgatacaaagttaatttaatcgtgtcgccaaccttgtgcttgtatagctgtgtatgcaaggctgctgtgtttgaggtgcttaccccatcaagggccgtgatcacatcatactgcttcaaaccagcagatttagcactgctgccgctggtaaagccagcaaccacaacaccatccgtcacactagcgggcaacttcagaaccgatttctgctgtgttgcagaaacagtggataagtcacgaacttcgatgccaagcgctggtcgaaccactttcccgttagcaacgagttgattgatgattgaaacgacttcatcacttggaattgcgaagcccatgccttcaatggtggcattactgccagagttgccggataatttcatagagttaataccgacgacttgccctgaaagattaatcagcggaccaccggaattcccagaattaatcgctgcatccgtttgaataaccgttgcctggcctgttgtgttaccactgtcatcagtgacatccactgtccgactctttgcgctgacaatccctttcgtcacacttgtcgcgtattgggaaccgagcggagaaccaatcgctaagacagtttgaccggtagcaatcttgctagaatctccgaagctggctactgtattgaccttgctaccatcaattgtcagcactgccaagtcagacgtcgagtccgtgccaacaagactggccgttagtttcgtaccatcgctcaaaatgacttccaacatatctgaaccactaacaacatggttattcgtcacgatataagctttgccatctttcttttgataaatgacacccgatccttcactggcctcttgaagactggacgaactgctctgcgaactactactgctttgactgtcttgtccaaaaataccttcgagaccgccaaatgtgtctagaccatcactgttgctctcggctttttgcatattcacaacggaaacgacagcgcctttaaccttcgcaaaggcttgttccgatgcactgttttcattaacagaaacgttggaaatcttggtcgtaccggctttccctgacgtatcggttacaccgagactttgactgtggttgattgccaaataggcagtcccgccgccaacaccgccacctatcaaggctgccacaacagcaacaatcgcaatctgcctccagccactattcttaggcttttttggtgcccgctgtggctgttgctcgttttgtggtgtctcttgaaagttatgacttccattatccataacggaattcctcctttaaacgcgctcgtttgcccagaaactgactcataagacctagccgtttggctgaggccgctgatacattggtttttacctggactagttcgcgctctatgggcagttctaactcgccctgattacatttataattgtaaggggcaattttgactaaattatgaacaatctcgggattttttaatacagtctcagacccgcggtatcgcgatattagttcgtggggttgcttattttttgcaccatcaataaaaaatgaaaggcagtgaatatgctaccggatttttgggtcgggatattcactgccttgggtagcgtgtggtagcgttggatgacggaaaatgcttaagacgccaccgctgctgcggaaacgcgctcgcagtcgcagaaacctccatgtaaggacctcaggcgcaatggccaaagcccagccatcacgcctgaggccacttacattccggtttctaagcgctcctgctcgcgctttgctttataccacaaacagcggatctgcaactgcaggatcggtgtcgtagatacgaaagtcgtgatcgacggctaggccttgttgagctaatagtgaagcgacggttaggtgtgcgagtggtttattattgttgtgcggagaaaggtgtcctaaataaatgcgcttggttcgcagcccgataacatccatcaaggcatcagcgccgtcctcattggaaagatggccttggtcgcctaaaatacgctgttttagtggccatggataaggccccgttcgtaacatctcaagatcatggttacattccatgacataggcatctgcatcacgaatggtacctgcaacacggtcagaaacataccctgtatccgttagaatcgtgaaggttttcccgtcatgatggaactgatagaactgcggcgccgcagcatcgtgtgaaacgccgaaactctcaacatccaaatcacctaatgtcaacgttgcgcccatgtcaaaaagccgcaattggtcttctggaattttgccaacacttttgggcagtgccgcaaaggtttttgcattcgcatacacactcagtttcggataacgtcgtgctaaaacaccgacaccacggacatgatcactgtgttcatgggtgatgaagacactatcgacatctgtcaggtcgcgcccgatgctttgcatcagcgtctcgatctttttgccggacaagccggcgtcgaccagcaccttatgacccggcgtttcaatataggttgcgttgcctgaactgctgctagcaaggacactgacacgcatcccaaaatcttcgcccacgatcaacatctcccatcttctaccatttaactgatgaacaaattgatcatccagttgttatttcattacattctaacactaattgtcattacgattcttcataacggttcgggtaatggcattcacgcgtttaaccgtcacattgccggttgcacggtttttaacaccgatataccacgctggcacgtaaaccgtgctcccctttgcatctaacaagtaactataggccaatttagtagatacaatcgcggaattgttcggaatatcgttatctcgatacaacgtaatcaccgcatcctgttcactcattaaatttaagcggtcgcgcaaaacacttaactttgcaaggtaagtttggctataactgaccaaccgatcgtcaactacatgcaaggtcactgcagcccgccgatcatagatcaagccagccttggggtgctgagcaaagacaacacgttcatcactggaaagcgccgccgcatattcgtattcgctgccatggtaaatactgtctttcacaaatgtcgtcagttggcgtatttgctgactctttttcaaagtgatcggcgtgtctaagcttgcctgcaactcttggtaatcgccttcactgatgctgacccgttgcttcaccaacttgctgtgcgcagcacttaacgctgtgttcgcctgacttgcaagataatcgccttctggtgtttgcttgctcaaatgcggcagcttaatctggtcacgcgtaatgtcggtgatcgtggcggcatctccacttttggttgttgccaaatcgacctgctgcgcctgaaaaaagctaatgcctaagaaaatattcagaccaacaaacacgactagaaaaatccattcaatgcgtcgaaaatccacaagatcgcctccctcagcgtgcccgaagctgcgttgttacgctgttaacatgacttattgcgactgacttgaacctgatgtgctgacactcgcgcttgctgcatcattactcggtgtagccgtgctggcagctgtttgttcactagcagcattagcctgctgatctgtttggtgattgatccaactctgataatcgcggtattcgcctttcatctcaatataatacgtcggctgcaaatcgaccacttgttgatcattgctgctgcccgtccattgatagccaatcaaaatatccgtaatttgattagcgcgatagccagcggcttctaattgactcaggatcgtcgcagttgctggcaaggtctgggcagcttgatcggttgggatcgggacggtcaaattggtgtttgagaaattaatctcttcagatgtctgggtatagcgcaccgtaacatcccctttttgatagccattaaaaatcggaaagccctgaacaaaggtcttatagataacagcactgcgacttgcgtcatattgaaaataacgcatgctggccagattggtcatctgcaaatcactaagcccttcaaacgtcgcctggaagaaattagctaacccagtactaggaaaattggccgcataattttcaaactcgattgccccagtggatgaatcagctgtcatccgccgagttgatccggcggtgtataacgtactatcgccaatttctcgtgaatccacgttgctggcggttttcgatggcattaacagcgaaacatagtaattagcactctgttgatccatcagataggcatatggctgcaacttaattggacgggtgaagaaagcgacttcgctattgcccaagcgtctctcctcgaccggaaaggcccctgtagcctgtttagccaccgcatcgcgtaacttgctggttgtaacgttagccattttggcctcgtaaaccgttcttgtcgcgtcattgataaaaatcagtttattgcctgatccatctaaatcaaacaggatccggttaaaatgaaaatcagctgattttagattaggctgcttgttaaagaaccatcgctcaaaatgattaaaactcatcacgtcttggtaaactaattgcagactgccattttgagtcaaaaagttctcatagttattctgcgaaacttttccaatggttttgatctgttgcatatgccaacttgccatctcttgatggacacgtgatcccatactggcatttgcctgaaagagcatttgcttctggtcgccatgcgtgtagtacacgcgactaggaagataaaccgttgcttccatctttttaacattgggatcattttcagttgtgacctgcatgcttgaagtgctgcgccgttcctgacgcgatggattacgccaaattaaggatgtgaaaataaaactcaagatcaccatggcgatcaggctgattcttaagatccaattactaagcttcatcccaatcatcacctccgtctgtgatcggttcatacggcagtgagatatagaaggtgctgccgcggccttcttgcgaatcgacccaaattcggccatgcaaggcttcaacaacttccttcgagattgccaatcctaaaccggtaccgccttgcttgcgtgatcgtgccttgtcgacccgatagaagcgatcgaagattttgctcagatcttgacgtggaatgccaagtccttgatcactaatcgataggatcacgtggtcatgcgtctggaacagccgcgccgtgatggtcccgccatccggactgtatttaattgcgttgttcataatattatcaatcacttgcataaacttatcggtatcaatttcgacccataagtcctgatcagtaatctcgcgcttaatcgagtaccgtttcttttgaccatctggctgtggcagcggttgggccgttttggcttcacccgtgtgttcattatcggtttttaacatcatgtcaaaacgatcaagcacataattgaagaattcgttgagattaacggtttccaaattgaacttgctggtgccagaatcaagccgtgacaagctcaagagatcattaatcatccgaatcatccgatccgtttcttcttgggtcacgttgagaaaacgtggcgccagctttggatctttccacgcaccatcactcaaagcttcaatgtaactgcgaactgatgtgaggggcgtccgcaattcatgtgacacattggaaacaaattccttgcgatcacgatcaatcttttgttgttcggtaacatcgtgcaaaacagcgaccaaaccggaaataaacccggtttcccgctggatcagactaaaatcgacacgtagaatcaattcatgatccagttgctccgaaaagtccaacaacagttctgtttgatgttccagcagatcgcgcaacgtgtaatccttagcgatgttcaacagctttagaattgaaacaccgatgacatcttcattcttggtgttcaggaaattcagtgccgtctggttgatgatgataacattcccacgccgatcagtcgcgataacaccgtccgtcatgtgagccagcacactatccaaccgccgacgttccgcttcagacgcctcttgtgcttcttcaacgcgaacactgaggttgttaacggcaactgccaactgacccagctcgtcttgtccataaatccgaacctgtccagaataatcgccgcgcgccatgcgaatcgcttgcttcttcatttcatcaattggacgagtaatagcccggctgatgacaatcgatagtaaagtgcccagtaagccagctactaaacttgagattaggaaaatgcccacgattttattgatgctatcgtaggcctgttccatagatgccgaaatggcaatggcgccgatcactgaattgttgtcgcctgtcgcattcgggtttttgatcgggatcactttataataagttgatcccgttcgatcacggtattcataaccttcgtattgctggccagaatacaatgtgtttttaatgctggagttagctgacttttgccccacattagtttgcgcattaatatcactgtcgccgcgaatagtgcccttcgcatcaaccacttgtaaatccgccgagttggcaatatctgcctggctcaacgtgcttttaatatcatcattggcgccttctgtatcagtccgcaacaaatccgcggccagcttatcttgaatatagctgtccacgttcacactggtcttaaactgctcaatgttttgctgctcaagggtcttaacaaagtaagccccaattaactccaacgtcacgactagcaagagaataaagacgatcgcaattttgaagtggattgactgaaagaagcgaatctttttattcaacagtggtgctcctaattattcagcatcgggattccgcagatagtaaccgacaccgcgtcgagtcaccagccattcagggtgagacgggttgtcttcgattttttcacgcagacggcggacggtcacatcgacggtgcggacatcgccaaagtaatcgtagccccaaacggtttgcagcagatgctcacgggtcatgacctgcccaaggtgtcgagcaaggtagtgcagcagctcaaattcacggtgggttaattcgatgttttcaccgcgtttagagactgtataggcatcggggtgaatcgttagatctccgacttctaattccttgtttgcttcgtcttcttcattgctggctgcgttggatgatgcggttcggcgcaagttagctttgacacgtgccaccagttcacgattggaaaatggtttggtgacgtaatcgtcagcaccgagttccaacccgagcactttatcaatttctgagtccttagctgtcagcataataattggggtgtcatgttctttacgaatttgtcgggcgacttcaagcccatcaatttttggtaacatcagatcaagtaaaattaagtcgggtgactctgcttcgacttttttcaaggcttcttcgccatcataagcggttacgacatcgtaaccttctttatccaaattaaacttgacgatatcagagataggcttctcatcgtcaacgaccaggatttttttcgccatcattggccctccttggtttaagatacactactgtagtataacggttttagggaaagagcgcgaggggcctagtttgaaaccgaagcataagcggccttaagcctaaatggcaggacttagttcctttaagcttgaggttcttatatgcaggtttctgggaccgcgagcgcattttctacaagcacgttaggtcgcacttcgatagattccggcttgcattaaatgctgctgtaagctggctccgcggcgattgggctggaacgcactgggcacgacttttagccaacgcgcaagcccggcgcgctgtctaaaagctcggccttttcctaaagcgggaaaaccacccgcttaaggaaaatttcagtgctgagcccatcgccgctccgccagcttgcctttctatccaatgtctcaatatcacatcatttcaaatcagtgctgttaattcataagcaagcttgaaagggtcagttaataaacacttcgccattcacctcgtcttcacactaaacgcgcatcgctattccggtgcttgccgtcatttaatcacccaattatgaacttttgaggttgctaatatgttcttttatcatgatcagctcaggctttactatcaacggtgcggttcgggaccagtgatcgtgttgttgcatgggaatggtgaggaccatacgatttttgctaacctgattgagcaattggcaccgctgtatacggtgattgcagtggatagtcgcgatcatggtcagagttcgcggacgaatcgcttgagttatgatgcgatgacggcagatttagcggccctgatcactggcttggagcttgagcagccgattttacttggcttttctgatggcgcgattgtggcattgcagttggcgattcgtcaaccccagttagccggcgctttaattcttgctggggcgaatctgaccccgcaaggcttacgctggtattcgcgagttgcttttcgggttgctgctggttaccatccatcacctaaaatggcgatgatgctccatgaaccgcaaatcacaccggccatgttgcatcgggtagccataccaacattggtccttgcaggcagtcgtgacttgattgcacgaaaagaaacgctcaccattgcgactaatattcaaaacgccgagctgcatattcttcccggtgaaaatcacaattcgtacatcaaagacaacgcgaaactctggcaattgattcggccttttcttgctggtttaaacagaacagactaaagtttagtctgtattttttttgcatatttaacattttcattgcatattcatataaatgagtatatattcaatccataatcaaaaatgaggagtgaaacatatgcggggaatcaaacattgggccatggccttcattgcgctggtggctatgctcgtcggcttcgctgcaaatcagccggtaccaacggcggcagcaagcgaggatctggcggcaattcaaaaacgtggttacttggttgttggtctgtcagccgattacgcaccacttgagttccatgccaccctcaatggggccgataccattgttggtgcagatatctccatgtcaaaacagatcgccaaagacatgggcgtgaaactgcagatcaaggaaatgaacttcaccgccttaattggtgccttgaaaaccggcaaaattgatttgatcgtctccggtatgtcaaaaacccctgaacgtgaaaaagaagtcaatttttcaacgccttacctatatgagacacaggttatggtgattcggaaggctgataaagccaagtataaatcgatcgctgatttttccggcaaaaaggtcggggctcaaaagcaaacgacgcaggagcagcttgctaaaacgcaactcccaggtgccaaaatttcaagtctcgacaaggccaatgatgtcattgctcaagtctcctataacaagctggatggtgccgttttagccagcaccatcgctgattcttatgtggcgcggacaccaagcttaatggtactcaatccgcattttgctacccccaaagcaccaacggccattgccgttagcaaacaaaattcagccctgctcactcaggtcaacaagacaatcagtaaggtcaaaggcgccaaatacaagacctatctgcaagccgcttataaactacaggatcaaaaccaaagtttctgggctaaatatggcaactacttccttcgcggcacactctacactctgatctttgcggttttgactgttttcttcgggactgtgattggcacgctgctcgccttgatgaaactaagccacagttggtttgccaaggcaatcgcgaacgtctacatcgaattcattcgcggtaccccattactggtgcaggctttcatcgtcttcttcggaacgcaaattctcggtctcgatcttagcgcattcgttgccggtgccatcgccatggccatcaactcaggtgcctatgttgccgaaatcattcgtggtgggatcaactccgtcccgatcggtcaaaccgaggccgcccgttcactcggactccatcaaggtcaggccatgcgttatgtcatcctgccgcaagcaacaaagaatatttggccagcgttgggtaatgaattcgtcaccgatatcaaggaaagttccgtcttgtccgtgatcggtgccactgaattgatgtttgaaggaaccgtcgttcaaggtgcttcattcaaaccattcttaccgctagtcgttgtggcaattctctacttcatcatgaccttcaccctttcacgcctgctgcgactgattgaaaaacgctttaattaagatcaaagtaacgctcaaatagcacctcaaaactaaggaggatttttaactcatgacagaaaaaatcgtactggcatattcaggcggcttggacacttcggttgccatcccgtggttaaaagacaaaggctatgaagtgattgcggtggtattaaatgtcggccagccaaaagccgactttgacgccattcagcaaaaagcactcaacgtcggtgcactcgattcgattgtggttgacgcccaagatgaatttgccgatcactatgttgccccggtcattaaagctaatgccttgtacgaaggcgactatccgctggtttccgccttatctcggccattgatcattgaacatctggtgaaaattgcccacgcgcaaaatgccacagcgattgcccatggttcaaccggtaaaggcaatgaccaagttcgctttgaagccgcgatccacgccttggacccggaaatgaaaatcgaagccccgatccgtgattttcactggtcccgtgaggaagaaattgattacgccaaggagcataacgtcccggtaccaattggtaaaaaatctccttattccattgatgccaacctctggggccgtgcaaatgaagccggcattcttgaaaatccttggaaccaggcaccagatgatgcttggggaatgaccgtttcgcctgaagccgctcctgatgacccaactttcattgatctcaccttcaagcaaggcgttccggtggcgttaaatgatgaacccatggcgctggcaacgatgatcaaggagctaaacaggctggctggcgacaatggcattggccggattgataaaatcgaaaatcggctagttggcatcaagtcgcgtgaagtctatgaagcaccagccgctgctgtcattatggcagcccaccacgatctagaaaacctgacgcttgaacgtgacgttcagcattttaaaccaaccatcgaagataaaatcaccaacatgatctatgaagcgcagtggatctcaccgttgtttgatgccttgatggcgttcatcgacaagactcaggctgtcgttaatggcacagtgaaaatgaagctttacaaaggcaacgccacagccgttgctcgcaaatccgcccacaactcgctttacgatgaagatctcgcgacttacacaagcgctgattccttcgatcaagaagcagcagctggctttatcaaactttggaccttgccgacaaccgttttcgagcaagtcaaccatgtgcactccgaggaaaaacaacatgactgataagttatggggcggtcggtttaccgaaaaagcggcacactgggttgatgcttttggagcctccatcggttttgatcagcaaatggcccaagaagatttggaggggtcgcttgcacatgtcaagatgctgggcaaaaccggcatcatcccccaagccgatgccgacacgatcacggcgggtttgcagcatctgcagaaggaattggctgctggcaaactgcacttcacggttgaaaatgaggatatccatcttaatatggaagccctgttgaccgctgaaatcggccccgttgctggcaaactgcacactgcccgctcgcgcaatgatcaagtcgcaaccgatctgcacctctggctgaaacatcgcctaccaacaatcaaagaagctttgaccaacctgcaaaccgtgttggttggtcaagccaaggtccacgcagcaacaatcatgcccggttatacccatatgcaacacgcccagccgatcacttatggtcattatttgttggcgtatttcgaaatgttccagcgcgattgggaacgtttcgactttacccaaaagcacaccgacattttgccattaggggcggccgccctcgctggtacgaccttcccgattgaccggacgctggttgctcaagagctgggatttgaccaaatttatcacaacagcctcgatgctgtttcagaccgcgactttgcgcttgagtttctcagcaatagtgccattttgatgcagcacttgagtcgcatggcagaagagctcattctttggtccacttacgagtttaattacattgaactcggcgatgatttttcaaccggtagctcaattatgccgcaaaaaaagaatcctgattttgcggaacttattcgtggcaaaactggccgtgtttatggcgccttaatgggcttgttgacaacgatgaaggcaatcccgttggcttacaacaaagatatgcaagaagataaagaacccattttcgatgcttataacactattcttggctctttgcacattttcactggcatgttaagcgacctgaccgttcacgaaaaacggatggcagaggcaaccacgcatgacttcagcaatgcaacggagttagcggattacctcgcgacaaagggtgtgccattccggcaggcacatgccattgttggtgagttggtactcaaggggatcaaaaccaacactgccttgcaggaaatgccgttaagcgagttgcaagcagccgcaccgcaaattcagcaggatgtttacgctgaattaacgtcaaaggccgccgtagatcgacggacttcgttaggtggtactgcggttagcaatgtgttgaaagaagttgctcgcgatgaggaaatgattgcttctcactagcggtacgtgatcaccttggcattcacgaaataattgaggttggaatatcgttttacaggcactaaaagacgactggttttcctactacgtggagaaatcagtcgtctttagttttttgataaatagctcgtaggaagtcaaagatcccagtgccaaggcggcgcaatcgtaggccagatggggctcagttgcgcaaacaacacagcgaccgggctttgtcgctgatgttgttaggcgacttcgagaccggtctttgggctcgaagtgccatcaccgctctagctatgcgtcgccaccccatctggccggagattgcggagtttggcacggcaaagaatctttagcctaacctattaagcattcgttttttcaagaacaaatgttgaccacgggcgaataagatccagaaagcctagatcatcagcactgacttggccaattttattgcgctgaccgtcatcggcaaatggcgttagcacaatttgaagctcgcctttgtaacggccataagcatcattcacaacaaggatatcgccgcgttcaaaggactggtgattgtcatgcggcgcaatgctttctttgccatacttcacccgcggttgtgtatcgcgcagtaagtaggctgaggcatcgccacggtagagatgcggcgcttcaaaggcaatcttcgcctcaattggcaacatccccggcagcatatcagcatgcaaaatcggatatggtgccacgaagttagcagccacctgttgcaactcagcttcactagcaaaggcattgccgatgatgacatcatcaatcaaaccggtcatgactaagtggctggtttggctggcgatgcttcgatggcgatcgctttccattgttggcagaccatcattgaccgcccatggaccgatcttgccggttggcgaagagacaaacgccgctgtgtgcagtccataatcacgatattgctgagagtactcagcaaaaatctgatcacttaatcccgtaaaggcttgtggataaaagttatgacagccgagcaggttgtcacggtccggttcataggccatgatactagccaaataattggttccgcgactcatattcagctcaatcttcagcccgtatggattacgcgtcatgcgcgcttcttcagcaccggtgaaaccttcatctagtcgcagtccccaaacattgagctttttgaaaaagctcagatcgtcatagctgatctttagctctttgaacaaggccggattgatgtcgacaatcgtttggaagcccagtcgattagcataatcaatggtttggccgaaaacagcgaacagatcctctccgtcatccccatacatctgcaataacgaggtgaagatgcgggtataaccatatttatgcgccatttcgagataggccttgttctgatcaaaactgctttgatccggatagagcgatattcctagtcgtttcattgaaaatcctttctaagccgtgtattgtgccgccatctggcgagacatctttttgaaccggtgcttacgctgccagttgagtaaaaagccggctgtgcgattgttagctttgcctttcgcggttttgccttcaatcgtttccgtgtaatgtaaagccgttttgttgtcaccagcgtcgcttagctgatagtcaaccgtatagtgatcacgctcagtatccagttcgtaagcataacgttggttggcaatggcatgggttatcgtgagtgtcccagtcatgccattagcccatttcttcttgtaagagaaaccattgagactgccagttaacacctcgcggccggtatgggccttgatgtcttcctgcgcggatcgaatgagttggccatacataaatgctgctggcaccttaaatgtcatttggatttccaagtgaaagccacctttctaaaaacgttgttcagcccaaaaccagcgtgatgggatgttagtcgagttcagtcggtttgatcttattggctgccttaacaaatggcacatagatcaggaaaccgatcaccatgttgattaattgtagcacggcagcacgccagtccatcgttgcaactaaggcattcaggaacggtggcattgaccaaacaatctgagccttaatcggtgaaaccaaaccgttaactacggcgccataggcaattgaaaccatcactaccggtgccaaaacaaacggaatgaagtaaatcggatcaagcacaattggcatcccgaacatgactggttcgttgacgttgaagaagcctggtgcaatcgataatttagcaaccgcccgctgatcatcacgttttgagaagatcagaatcgcaatcagaagtagtagagttgaaccagccccgccgatccaagcatacagatcaaaggagttccgggtccacaaatatggtaaggcttcaccttttgaaaaggcgttagtgttagcaatctgagccgtcagccagattccatcaaggattggtgccaagacgttcgtaccgtgaattccgaagaaccagaaaacctgaaccaagatcgtcattatcaacacggatccgtaaccttgactcagattcaacagcggttcctgcaagactttagcaatgaattcaattactgtagtgccatattgagtgaagatatagttgataataccgacagcatacatagcaacagcagcagggacaatcccagtaaacgcattagcaactgctggcggtacggaatcaggcattttgatggttatgtgtttcttcatcagccagatatagatggtagcagcaatggcccccatcagcatcaccgtgaagaaaccatatgccccaaagaacttaccaaaattgaagaagccccacatgctgacatccttgccggtaactgctgccccagcatcggtcagtgacttgatcgctgctttacccaagccggttttaaccgtcatggtgaagttttgcggcaagctcatgatgaaggtaccaagcgtcacgatccccgccgtgactggttcgaccttatactgaactgccagttggtacccaaaagtgaacgagaagatcaggcctaaaattgccagtgtccctgtccagacaacggcgttaataccgatcagccattgcatggaattaacaaagcccgtccagccaaactggttcgggatatcacgaatcaaagcgttcagcaccgtcgatacagcaccagccatcatggccggcatgatggcaataaaagcatcacgcaacgcaaccagccaacgaattgagccgattctggcagcgattgggacaacatgtttattgagccaattaataagtccgttcatttttataacactcctttttaagtgggcgcgagcaggcacggcgtgaaatcaagacgtagccagctttgacggtcatgatctgcttttgatcattgtttttaagctgacagcgtcagattccggcaactgcaaacgcgcgagctattaatttgaactgaggtccccgcctcattggtccaaatcaatgttggtcgtgtggtaatacagtgtgagacctggataaacaaaataagttcgagaaaagttgaagactttgccgctggctagatagttaatcccatccagacataaaagatcgccttttccggatgtggtcatcaggtcagcatattcagccggcagcggccgagactgaatataattttcggttgtgcttccaaccatgtcataggtgttgcgcaaataggtaaagattgaccccgcagcaatttcttccgagagatgcggcacaatgatttgtggaaagtatgattcttccaagtcgtacaactgcccttttaaatagcgcagacgcacaacctgataaaccggatcgccaactgctacgttgccgcggcgggccaatgccgcagttgctggtatcaaagcaaatttgacgactttcgatttaagcggaccgcctttgaccatcgcggtttgatcaaacccgattgacatattcaagacggcacttgattgctccgaatgatcaatgacgtagtagccactgccctgcactctgcgcacgagtccatgggcaaaaatgacatccagcgccttacgaatagtgttgcggctggcttgatagcgatccatcaacacttgctcggtcggcaacttcactggatacttaccagccagaatatcttgaatcaattgctctgcaatatcgtgatacatttatgaccccctccaaaggtgtggttttgaaagcgcttgtaaaatttgtacctacgaattataatagcacaagaaacagaaaacgattacatttttttaaaaaggagccgaaaaaaatggcagagaaaaagattatgttggtctgcgccgctggtatgtcaacaagtatgctggttgcacgcatgcaaaaagccgccgaaaaagatggcgttgaggtcaatatttttgcaaccgccgcttccgatgcagacaacaaattagctgaggaaaaaccagatgttctgatgttaggacctcaagtccgctatcttgaaggtcaattcaaaaaggatctcgatattccggttgatgtgattaacatgcaggattacggcttgatgaacggcgaaaaagtcctcaaggcgtccttgaaggcaattgcagatggtaaacaaggagaagaagcataatgagtgaagaagatcagaacctcgaaactgtcatgggcttgatcatgaatggtggcaacgccaagagttctgcctttgaagctattcacgcagccaaagcaggcgattttgaaaaggccgacgaaaagcttaaagagtccgaccactttctgactgaagcccacaacgttcaaacaggcatgttaaccgctgaagcccaaggcgatcatgccgaggttaccttgttaatggttcacagtcaggatcatctgatgaatgccatcaccttccgcgatttagctggtgaaatggttgatttgtacaaacgattaagcgagaaagaagcctaggaaaacaaataagccttcgccacgcgatgacgcatgaaggcttatttgcagtggccattgtgaataaacggctgttatgaaatcccaaataatcgcaccaaaaaggcgactcagcaaatgagccgcctttttaatactatatgttatttttgctggcgacctgcctgccattcttcccgcagaatgccatacttaacagagtcccagtaacgatcctgataataacgaacttgtcggacacgcgcttcctcctgcatgccaactgctttagccaaaccgatcatccgatcattgcctgaccaggtggtgatacctaaatgcggcaggttgacgagtccgaagatgcgatcaatccactgatccagcgcatcttgcccataaccttttccccaatcagccgagtcatagataacgatgccaagatccagccaccgctgcagatcgccatcttcataatgggcagagacgagcccaatcaaaacgccgtttgaccaaatgccgttgacaaatggattggcaacccagtgaaagccagtttgattggcatgattttcctgcagttcttgtagtgtcggtacttcttggttaaaatacggtccgtcccactgatgccattcagcctttggatcagaaaaagccaccttccacagtgtttctagatcttcagattgaaaatgttttagcgtcactgtcatgcgttcaccgctcctttgatgtttgttaacaacataccacaattattgcccaggaaataatgcaatcgtcaactatgttaatgtcagtatagcggtaaacgattcgagttaatcttagataaggagtgaatctcatagtggcagattatattaaagatatccggacaaaggttggtcatgcgcccttgattatggctggcgtgattggcatcctgaccgatcaggctgggcgcgttctactccaacaacgcagcgattttaccggtgaatggggcttgattagcgggacgatcgaatacggcgaaacccctgcccagacgatggtgcgtgaattcaaagaagaaaccaatctggaggttgaagttgtccggttgcttggcgttaatggcaatctcaccctcacctatccaaatggcgatgttgcccaatggctgtgcccggtgtttcttgtgaaacaattaagtggtgtgttaaatagtgacaacagtgagactgaagccttaaaattttgggatccagcagctgctcctgacctgtttaatcaacaacatcgggaagtcttggcgcactttatcgcaaatgaaacggggtattttgattgaatcgattgatcattctgcgtggcaattcaggcagtggtaaaaccaccaccgcaaccgccttgcgtacccaactggccaatacgctgctagtatctcaagacgtcgtgcgccgtgacatgctcgccgaaaaagacaaaccgggcaatcccacaattgaactaattgaaacgattgctcgctttggattgcagcatcagcgaactgtcatccttgaggggattctgtcggcagcacgctatggcgacatgttgaaaacactcattgcagaagctgatcaaagtctggtttactactatgacctctcgtttgatgagactttgcgccgccatgcccatcgcgcaaaagccaaggaattcggagccgacgtcatgcgtgactggtatttgccccatgatcgtttaaatgtgccgactgagcagctcatttctgccgattggtcgcaaaccatggtcgtcaaccacatcttgaccgatctggctggattgaacaatacagaatctgttaaacctattcactgacaaaagacaccaactcgcgggctcttttccaaactgatttgatagcgtcttcttgtccttaacaacgggcaaaatcagcattggcataatcgggcaaaatattatttttttcatgggtttcggactagaatgggttcgtaaaggttagttcattattagtaatggctataacgcgctcgcagtcgcagaagcctgcacatacggaccttgaaccagaatggccaagttcgagccattctggttcaagcccacttatgctccggcttttaagcgctcctgctcacgctcggttcataacgcgctcgtcagcacagcagcttgcatgtaaggagcctgctcgcaatggtcaaagtacgaccatcacgaacaggcccacttacactccggttgctaaccgtgctgactcacgctcactaaaaggagtgatttttgatgacaagttatccacgccgtgacccggttactgaccggctgctcaccccggaaaattctgctttgattctgattgactaccaaccgacacaaattgaatccatcggttccatgaaccatcacgctttgatccaaaatgttgtgatgacggccaagttggctaaaacgtacaatgtgccaattgttctctctactgttaacgttaaaagcggacgcaataaagacaccatccccgatttaaaaaaagccctcggcgatataccaagtattgatcgctcttcgattaatgcttggcaagataaagagtttgtcgaagcagtcaaagcaactggccgtaagaacttggttatcgcggccttatggacagaagcctgcctaaccttcccaacaattgatgctttggctgaaggctatcatgtttatcctgtcgtggatgctgttggcggcacctcacaaattgctcacgaaactgctttacgccgcgttgaacaagcaggtgcacaattgaccacaaatgcccaactggcttgcgactggcagcgcgactggaaccgaaccgacactgtaccggattttgttaaactgctgctgggtgcaggcgactttatcaatttaggcgactagctttttaacaatatgacatgaacggggctgattaaagcagccccgtttcgtttcttatcgcttatgatgtgtacctgcccatgacatcgcatgatgccatgaacaggtaccttattttattggtgagcgtgagccagagcggttagtcaccggagcgtaagcggcctctggcgtgatggccggtctttggccattgcgactgaggtccttacacgcaggtgactgctctggcaaacgcgttatggttagggggattcaacatgcaacgttctgaaacggcaccaaaacgttggtggctactggtcgcgctgggcttttttgccttcatgaccaatctcgacggttcaattgtgaatattgccgtgccaattatggccaaggatctcaaagtccccgccagtcagatggaatggaccgtctcgctgtatttaatcgttttaagtgcgctgctattgccctttggtaaacttggcgaccgcatcggtaagcagtggatttttaaatggggtaccggtacatttgtcttaggttccttgatggctgggattaatctcggctttaattttttgatgttagcccggatgatccaggcacttggcggggcgatgactttggcgaatacgtacgggatcgtcacctcgactttcgcacttgctgaacgtggccgggcaatgggggttgtgagtaccttcgtcgcattgggtggtgtcgctggtccaagtctaggcggtttgattttggcccatttcagttggccaatgatttttctcatcaacgttcctatcggcttaatcgcattgggtgtctccttgtggtctatgaacaatggcatcccacaacgcggtacgtacgatggttgggggatgattttgcaggcaacagcgattgcaagcggtttttggggactgaatcttgctcagcaaagcggttttgacgatccagttgtcctcagcacccttgcattggcagtcgttgctctcatcgcctttatcgtctttgagcaacggcaacaagcaccattgcttcctttgcgtattttccgtgtccgtattttcacactcggtgtggtcactgtcttcttcatctttatggtgcagtttttcagcacagtgctgatgccgttctaccttgaagatgctcgtggcctgacaccaggtgcggctggcacgctattatcgctttatccactgatgatggtcttcttcgccccgtttggcggttggctggccgataaatggaacgtcccagcagttgctttgctcggcagcatttttatcgctgtcggcagtcttatcggtgccacgttgaaattaaacgcaccgttgaccatttacatcatcagtacactccttgtcggcatcggcagcggtctttttcaatctccaattggcgatgtggtcatgtcagttgttccgaaaaatcagcttggcatcgctggcagtttcaatgcgctcgcacgcaatcttgggatggtcagcggcacggcggttgcgacaacagtgctctttggcacgatgagtcaacttgctggcagccgcgtaacgaactatccaacagcacatcccgaattctttatcagcggtttacaagttgccatgattgtcgctgctgtgctcgctatcctcggagccatcgccatcggcctgacaatcaaaccgtggcaggcacacgaaaaaaactagtgtcagttttcatgacagttcatccgtcagaacacctcatcttccaatgaaagcagacgattgtttcgccggtaaatcaacgttcgtgtaacaagcccacttttcccttcggctcaaaaagtgctagcataaaagtattgtgtccgcttgcacagcgtcagcagacgtgcttaggaagcataacctgaatggccgagttttgactatttatgactggcatgcttacatgtaggttgctgcgactgtgggcgtattctaatgacggaggaaaacagccatgaaaaagaaccacacctcgacagcctggttgacttggggcatcatgctggtcggtgccaatctgcggctgcccatcacgatgatcccaccgttgctgccgacaattaagcaaacactcggcctacctgcatccatggcaggtatgctgacaaccattccattgctcatgttcgcgctggcctcaccgttaatcgccaaaatgggtaatcgtcgtggtaatgaatggagcttgctggtagcgctggttatcttgttggctggtagcctgctgcgaatcattcccagcttgacagccttaattgctggtactttgctcatcggatttggtatctctggcggtaacgttcttttaccggcaatcatcaaggaccaatttccccacgctatcggtgctaaaaccagtctttataccgtgacgatgggacttattgcgtccctcggtactggactctcaggattgctaaatcagcaattcaacatgcagatcacgctggcagctttttcgttagtcggcgtctttggattactcgtctgggcgttggccttccgcacactaccaaagaaagcagctcggcaagacgtccagcgcaaaaatatcgccatttcgcgatccatgctagcgtggtggatcgctttattcttcggcctgcaaagttttctctactattctttgctaacttggctgccaagtctttggcaagcggccggtttctcccaaatcgcggcgggtaatctggctaccatttttcagctgagcgggatgccggcaacattatccatcccattcattgctgagaagcgccatggcctcttatatagtgtctggggcatcatgctaggctttgtactaggtgctttgggtattcttatccctggggcgaactttggcttaaacgttgtctacgcgctgctcatgggcgttgcttctggggccgcttttgccatctgcattgtctttttccagaagaaaaccgccgatgcttatgaaacagctagtctctctggctttgctcaaagtgtcggctacttatttgcggcggttggtccagtattatacggcttcatccaaacggctacaggttcgtgggatttattgttgtggctgacagtcgggctaacgctgctgatgtttgtggcagggctgatcatcaatgcgaaccatcggatttttccatcaaaggcgaatagatagcgcttgcaagtttctattactttttttacactaagcatgaatggctaaggaggtcacaaaatggcaatgacaacgacaattggtaaaagtacggtcacaaccgggaaactaggtttaggcaccaataaagtcggcggccacaacttgttccctaatctgcatgacgaagatggcatcgccgtcgtgaaagccgcgcttgaccacggcattgacatgctcgataccgcttatatgtatggtttaggacagtcggaaaaattaatcggtgaagccacacaaggctatgatcgcaacaaaattattctggcaaccaaggcagcacaggatccgcacaatgatctcaaaccaaataacgatcccaaatttttaacgcaagcaattgatgatgctttgttacgccttaaaaccgattaccttgatattttctatattcattttcctgatgacaaaactgacaaagcggaggcggtcaatgccattgccaatgcccgcaaggccggcaaggttcgggcgatcggcgtttctaacttctcattagaccaaatcaaagaggccaaccaagacaataaggttgatgtcgttgaagacaattacagtttagtacatcgcgatgctgagcaaaacctgttcccgtatttgaatgaacaccagatcagtttcgtcccatactttccactcgcatccggcttgttaactggtaagtatggccttgatgatgctgacaagtttagtcgacgtttctcggcagatcagttcaagaccattcttgccgctttgcgagaagtcgatggcatcgctgatgcccatcaggcaaccttggctcaggttttcttggcttggtacatgaagaatccggccattgcggttgtgattcccggtgcccgcctacctgaacaagctacaagcaatgctaaagctttagacgtcaatttacgcgatgctgaatatgcatctattgacgagttgttcaaaaaattccgtactgaataatcgcgcattgttctaggctacagacttcgcacaatccaaaaagcagcccgcttccagcatgtcacacatgcggaaacgagctgcttctttttattatcgaaaaacggatggtgagcaggcatcactcactttttgcgtctaaatgcccgtttgataacctgccaaaacgtcagtgattgtacaattttatctgccgggaaatgatttctgatggcgcgcaaaacgcgtttcggatctcttgccgcgaacgtatatgtcccatttttcttcgttttgattgcaaaccgtgggatccatttgcctttgaagatcaccgacgcaatgaccaaatcaatctcattccacgggatctgatagaaatcgcgcacgtttttttcgttgaaaaattcaaaccctttatcgccgatcatgatcttgccatatgtcggcatccccatgaaggccgtgccttcgaccactaattcggacttcgtgttgatcgattgaaccattttccgccatccttttaaagtcatcttgaacgattttttactgatggagacgactcggtctgttctccaaacacgattacagttgcagaaatctcctgttcacgctctaaacgcgatcaccagcccagaagcgtgtaaggaccttgggcgcaatggccaaagcccggccatcacacccaaggccgcttacactacgatttctaaccgctcctgttcacgctctccattataaaacaaaagcccagactttgcgcctgagcttccgtgattctttgttcgttttaacggttgatattacatcaagccgacaacgtggaagacaaccccgacaacgaacaggccaaggataatcacaattggagaaaccttcctcttcagtaaccacatgcagaacaaggtcagcagtaagcccatcaaaccaggaatcaagctatccaagttatcttgcagcgttaagaccttattcttggtcagtgacagaccttgagattgtaattccaaagccttctgaatacccttggatccacttggtattgaactccagtcgatgtaagcacccttttggttaggtacgtctgatacgactggtgtgaatttgacagaaacccaacggttaaccagcgaccctaagataaacatcccaagaatcgtggcacccttcgtcacttcttgcaacagaccaccggaaaggtcttcggtaatcttgctcccagctttgtagccaaattcctgcgtgtaccacaggaaagccatacgaattgcattccaaagcacgaagtacaagattggtcccatgatgttaccagccattgccaatgatgcagctaaagcaccaataattggcttaaccgtgaaccagaacactggatcgccgacaccagccagcggacccatcatcccaactttgacaccctgaatcgccttgtcatcaattggcgccccattggcacgttcttcttccagtgccatggtaacaccaataattggtgatgccagatatggatgcgtgttaaagaattctagatgccgtttcaaagcagcggaacggtcttccttggtatgatacaaacgtttcagtgccggaatcagggtataagcccagccaccgttctgcatacgttcgtagttccaagaaccttgaatgaaggttgaccgccaccaaaccttgattcggtcgcttttagttaaatgaacttcttcagccatgtttgtcaacctccttcttagtagttgtcaatgatgtcgccgacaggatcaccggcaccactattcgagctgccgcctttgcttgagccgccgcccattttggacagagccaagtaaatcaacgccagagagatcccgatggcaccaaggccgatcagggtaatctctttaactgttgccaaaacaaaaccaagcgcaaagaatggccatacctcacgggtcgccatcatgttaataaccatggcatacccaacggcaacaaccatgcccccgccaatgccaaggccagcggtcaaccagtcaggcattctttcaagcaatgcccgaacaggaccagcaccaacggctagaatcaagccagctggaatggcaatacgcaggccttgcatgcagatcgcaatccattgccacatatcaatcttccggaaactgccttcttcagcagctgcatccataaagtgaacaagcgcggttgccaaggtacgtaccaaagtggtcagcaacaaaccggcaacagccagtggaaccgcaatcgcgatcgctgaactgataccttttgtgccctgaccgccaagaaccagaataatagcagatgcaacagatgccaaagcggcatcaggtgcgacagcagcgccaatgttggcccaacctaaggcaatcatttccaattggccgcctagaatcaagcaaggtgccaaattgccggtcacaagtccgatcaacgtgcacgcgataactggctgatggaaatgaaattcatccaaaataccttccataccagcaaggaatgacacgatgaggaccagaatgacttgaataaagtttaaagtcataagtcttcttcctccgtttcaaaaaaattacttctgtgcattcagttcgtcttgggctttcttcaaaattgcatccatgttttcggcatggtctgcaggcaccttgcgaacatcaaacttgacaccgtctttttccaattgatggaaagtgtcgatatctttttgatcaaaggccaacaccttgttcggctgaaccttaccaactgaatgggacatggaaccaatgttaagttccttgattggaacgccgccttcgattgctcgaagtgcatcctcaggtgtttcaaataatagcaaggcacgttgcccgccgaaatgcttatcgtctttagcgatcttaatcatctgatcgataggaataacatgcgccttaacgcccgctggtgcagcttccttaatcagattctttcgcaagtcgtctttagcaactgaatcagagacaacaatgatgcgtgtcgggttggttgtcttggtccaggttgtggcaacctgaccatgtagcaaccgagaatcaacccgcgccagaacatactcaagtgagcctggctgaccagcattcgaagtagttggtgctgcttgggcagctggcttcgtcactttgtccagtgattctggcttgatcttgataccttcacgtccagcatcgagcagatgtgctgcaatatcctgtgcagaatccatcgaaagtcgtgaaccatacgcttcaatcagcatcggtaaattcagtccggtcacgattgcccatttatccttatgcgcctcataaatcgagttcgcttggttaaatggtgagccgccccataagtcgatcaagaaaagcacttcatcgtctgggtcgaacttagcgatcgcatcttcgaggtgcttgtgtaagtcatctggaccttcatcgggcatgaaggtcacagcttcgactttttcttgctcaccgaagatcatttgaccggattgcttgatgccagcagcgaattggccgtgactagcaagaataattccgaccatttttacgcctcctaaaaatttgtggttgccttgaaaataatatctgcagtaaacgaaaataatctaaaaaacaaggcttcccaatagaatagtatgacctccttcgcacagctatgcaagcattttcacttgaaaagggtgcataaaaagaagcgcatacattctctatgcacttctgaaaagcgatttcgctgaattggtctattggtaagtaccaattttgcctatgttggattaagccttttgcgaatattgatcggaatcggtaaagactgggtccaaaattttagtgctcatccaaaccaaaaataatcctgtcgccaaccctgccataacgatccaactaacatgagcactagcaaggttcgcaatcgtgaagaaaatcacttgtcctactggcatgccgatcaatgctgccaggttgaccacccctgctgtcgtacccatctgctgttcaggcacttgccgcatcatcacggtggctaaacgtggattgattttgcccatcagatatgctgtcacaaagctgaaccccagtgccgccacgatcgaatggagcaggaaaaagctgctgcttaaacccactatggccgccatcagcagacttagcaatttgaacgtgctcaaacgctgcaaaccatccttggcaaataaagctccaaagataaggccgacagaaaacacaacattgatgattgcaacggtggttccaaagtctcgcagccataggtctggctcctgcacaagcgtgatattcatcaacccgtcaacggatgagccaagcgtattgactaacatcgcgaagagaataaccgcgaataggaattgattgccagcaagaaacttaagaactgcccggatgttaccgataactggctgtgacttgcccgttgtcactggcggttctgcttgcttcaattgcttttttcggaagacaagcgtcacagcggctagtaaaaaggtcaacgcattgagcaagccaaaaagtgcgtaattgtgattcaataacacgatcaagctggctccaagcccttgaaaaaccagttgcacagttgaactcgttgcactttggaaacttaaggcagtgttaagctcttttgcgggaatcaagcgatgcaggagcggtagcgtcaaaccattgccgtactgacctaacgaatcggaaacaatattgattaaaagtaatgatagaaatagcggaaaactggccggtagtaaaatcatgaccgctaaacttaggaacaacaacatttgtcccaaacgggttgccaccatgtgccaagttttagcgtgtgtccgatctgccagactcccagttaaaagcgacagcatggtcggcacgctggttgccatggcggctaacgtcaccgccagacttttgaatggcatagttgcggcataaatgatgaacacaatattatagaggctatcaccaatcccacttaacaaactggcatttaaaatcgcacgatacccgcgattggtaagatattcatgcatctcaatcttcctcctcaaggtgcttactggtttctagacacgcctatgagttttcaaaacgcgttcactgccgcagaaacctgctcataaggaccgcaatcttaaatggccaaaaccctgccatttaaggttgcgcccgcttatgctccggtttctaaacgcgccagttcacgctctgactaaaacgcgttcactgccgcagaaacctgctcataaggaccgcaaccttaaatggccaaacccccgccatttaaggttgcgcccgcttatgctccggtttctaaacgcgccagttcacgctctgcttatttgtatctaaagtgtacgcagggtaaaatcggattgaggtgaaattccactatggtagaaaaaataaaggccacagatggtgcggtttttcggcagttgcgacataatcatcagctaaccttagcgcaagtggcagacgaccataattcgattgcttttatcagtaaatttgagcaaggcaagtctaatatcagcttttcgcgtttaacccatttgctgtatcgcattaatatctctgtcgaagaatttgtctttatccgtgatcttcaatccggcgttgtgccgacatcgaatgatcctaattttgtgtacaacaccttaacgcatcgcgcctttgtcgaagtacttgactatcagaatcgcttttcaactcaggaaccgacaccagcagactatgcttatttcctcaaaaaggagcaggaatggcaagctcgttatgcccaagaccacaaccgccaaacccgcttcgagctgatcagcattcaactttttcggctaaccatgattgatcgggttaaacaattaaaccaatcatctccattcaaaagtgtcgctgacgctatggcccagcttcaggctttggcaaagccggtcgtgagttatctttattcggtcgaaacatggaactactttgaactctattggtttcgccatcttatggtcgccttaccgacagccacgattcaaaacttactgccacttgccatcaaacgctcggaaaagtatcgtgcttttaaccaaatccgcaatatccgaatcaggacactttttgcggccttctccgtttttattaatgatcggcagctcaccgatgcgaaaaaagcgctcgatactgccaagactttattgcatgacagtgacgatttgaccaacgctgctatgttactttttttacgcggttggtatcacgtcatcgccgatcagcctgaaattggctgggagttgtgccatcaggctattagcttggcacacatccttgatcagcctaaacaagaacaacagttgcgttattcattagaatttattcatcaaaatgtcaacaatccggaaaaagttgctttcttcctttaaacttatttatcggcagttgaagtttcacgtggaacttttgagcatttgcaagacacgcttctggcaatcttctcactaatggcgtcctaatggcgtcaaaaatcggtactggaaagtgtcttttctcagtaccgatttttgactgcatgattgctggcgcggatctttaagcttcttggctacacccttttgctgctgcaagccgttcaattgtaggaagccacgtcgccgtccatgctggtgcccccaattgcgccagcattttttttaattgcaaaaactcttgccgtccttgtaacgccaccactttgtcggatgaataaatcataagtaatcgtttcacacaagcaatctgaaactcaatgcctagatcaccaacagttgcttgcccgataagattcaaagcatttcgtgcctcagtcaacttacccgctgccacatagcgaagcacagccgctagaaacgtgcggttagcaagattaaaatgatcctgcggcgtgttaggacgttgtatctgatttgaaaaagcagctatcagttgactcagctcatccaggccaataattttagccaattggacggcaatcagtcgtaatagtaacgaccagtcagccgtcgtcatcagcaatgactgcgcttgtgattgctcatgcggcaaaattgaaaagcgttccggcgcgtcattatgtaaggtcaaatgcaacaacaggcgttgattaacattggcgagtggcaattgacgtaaaatgctggccaattcctgaacgtcagcgtgacgcgcagccgccaaataacgttgtaaaaaaggttgcttatccctagaacgaggttttgcaaacacatcccaatctaaattcaactgatccaacaacaaaaagaaacgatcagcagctaactgcgaggtaccattttcaaactttgacaaacttgacaccgataaaatgccatgcgctgccatttttaaagtcagtcctcgttccctacgtaataacttaaattgtctaccaatcgtcatctcgcagccccctcctccttaagaaaccgctgccaactagttgttaacaattgagcaaaaaatggtgactctaataaccgcaaactggctaacaattgctcaaccgctgccgtttctgctcgatgcttaccgcgatggtacaccaataattgctgctgataccgaagcatcaatcgggaatagagatcatccggcggcactggcatactggtcgcaatggttagcaagcgaactgcttcactaaactcgcgccgatggatcagtaacgcaatgctattcgtgagaatcgcccacaaatattgatcgcgcgtccggtgactctcggtttttggcatatccagtaacatccctgccactaaactaaccaactgtttactgtcgaaaagcaccaacgtcgccgcaaaaagatccagctcataaagtccccagtgcttaattcgttttaagtaacgcataacgtcagtcttcatggctggggttgtttgaaaactcggatcactgaacccgttgtgcgccatgatgttaatctgattaagtcggtaaaaaataagccccgtttcccgccataaccgatactgtcgcttagccagtgccagtagcgtcggtttcccagcaacagtcgcccggttcacctgctggaaaaagttatcctgattcaaggcgcggtatccttgttggatggattcaacgtcttgatcaaaccgtgttaataatttcaaaacaactgccgcactcagttgcgtttccccacgttcaaaccgcgacaaagttgcagctgtcgtaatcccagctgcaatttcttctaatgaatcattttcctcgagacgtaaagcccgcaaatatgccccgattttgacatgttcttctggcatcagcacccgacctttttatgagaactttattagacaaacttaacacgttttgccattttttcaaaatatcttactacttattgcacctcaaatttgaatatttttgtttttaaacgctgcctaaacatgggtgctagtcccaagaattttttacgcatttttctgatagacatcaggcagtagcgaaaattcaatggacgcggccataccagcgccttagccttggcggtcgctactccgaattttcacaaaaccagctcagactatcgaagcgtgcccaacaagcatcagaagagcgaatccttctactgtgccatctaaaacgtgtgagcagacgtagaaactgcacttgctcacgctctgccattataaattgacatccatccctgactccgctaaactcaattttgacatttaaatacaccaccaagaaatagaggttgcggtgggcaacgaaaactggggagtgccgtatcatgttgaaccagttgtaagtgccaccgccgaaatgttgcacgatattcggatcgtgcgcattgggccatgggtgcataacccatggactgtcgaagcactcgcttcggggcgctatgattctggtttatgactaaaatcgatggaatcgacctttattgcggtatcacaacacaataaggtcgattttttgtttccagctctatttcccactacaagaagggagaaatgtcagttatgaaaaagcattgggttgcacgtttaggcgtgctggggttcgtcttgagcctcttactaggcagttttgctgccaccccggtcaatgctgctagtgatagcggcacgtttaaagtcggcatggaggctggctatgcgccattcaactggacgcaaaccaccagcgctaacaacgccgtcaagattcaaggtagtcaggaatacgctaacggctacgatgtgcagattgcacgtaaggttgccaaagccttacacaaaaaggtagtcgtcgtcaaaacatcttgggacggattgccaccagctctaacttcaggcaaaatcgatgccatcatcgccggcatgtcaccgacacctgatcgtcgcaagaccatcgatttcagtaatccctactacatctccaacttgacgatggttgttcgcaaagacagcaagtacgccaaagccaagagcattgcggattttaagggtgctaaaatcaccgcgcagctcagcacctatcattatcaggcgatcaatcaaatcaagggtgtcgtcaaggaaccggctatgaacgattttccagctatgcgtgtggccttggaatccggaaccattgatggttacgtttccgaagtgcctgaagggatcacggcagaacgtgctaatcctaacttgatgtatatccattttgcaaaaggtcagggttttaaaaccgatgccagtgacacgaatctggcgattggcttgcgcaagaatgatccgaataaagcaaagatcaatgaactacttgccacgatttcaagtaaagaacgagcacagctgatgaatgaagctgtcgataaccagccatcaactgaaagcaatggcaactggttcatcgcgattatgaagcaatatggtccaatgctgttacgcgggacaggcatgaccttactgatttcccttgttgggacaatcgtcggctttatcatcgggttgttagtcgggattatccggacaactcctaagccgaaaaaactcggtcagcgcggcttacgcgccgtgatcaactggctgctgtcgttgtacatcgaagttttccgtggcacgccaatgattgttcaggccgcggtcctatattatggtgccgcgcaagcttggcatttgaacatggaccggaccaccgctgccttattgattgtttcgatcaacactggggcctatatttccgaaattatccgtggtgggattatctcggttgacgaaggtcaattcgaggctgccaacgctctgggaatgacccatctgcaaaccatgatgaaggtcattttgcctcaagccgtgcgcaactcactgccagctgtgaccaacgaatttattgtcaacatcaaggatacgtccgttctgtccgttatctctgtctccgaattgttcttcagtggtgagacaattgccggacaaagcttccaattcttccacacctatctgattgtcagcgccatctatctcatcatgaccttcacaatcagtcgcctattccgattaattgaaaagcatctcgacgggccaaaagattacaacgtcatgaccaaccagatgcaggtcgaaaccccgaaaactcgtacggcaaaggagggctaatccatggcaaacgaacctttaatccaagtcaaaaatttaaaaaaggcctttggcaatcacgaagttttgaccaacatcaatctggacgtgaatgccggtgaagtcgtttcgatcattggccgtagcggctctgggaaatcgacacttttgcgaaatatcaaccttttggaaaccccaactggcggggatatccttttccacggaaaaagtattttaagcgatgaagagaaactaagcacttatcgcgccaaagttgggatggtcttccagagtttcaatctgttcaataacatgacggtattgcaaaatgtgatggttccgcaacaaacggttttaaagcgcgatgctgccacagctaaagcgcacgccctcgacttgttgaagcaggtcgggatggatccattcatcgctgcaaaaccggaccaattatctggcggtcaagaacaacgtgtcgccatcgcgcgggctgaggcgatggatccagaagtgttgctcttcgacgaaccaaccagtgcacttgatccggaaatggtcgatgatgtcttaaacacgatgactgctttggcacatactggtttaaccatgatcattgtgacccacgaaatggccttcgcgcgcgaagtgtccgatcgggtcgtcttcatgaacaatggcgttattgccgaagcaggcacaccggatcagatcttcggcgatccacagcaacctgaaacaaaagagttcttgaaacggtacttgaaccgaatctaaacctatggctcgattcttgggcaacaagagcttgagacataattctcagtcaaacgaataaaagggaacaattttccgattgttgtgggaaaaattgttcctttttagtttctcgtggattattttactgcgattttaaagaccgtagtgccaaggcgaagcaatcgtaggccagatggggctcagccgtgcaaacaacacagcgactgggctttgtcactgatgttgttaggcgacttcgagaccgcgggctttgcgggctcgaagcgccgtctccgctctagctacgcgtcgccaccccagctggccggagattgcggagtttggcacggcaaagaacttttaaccaagtcccttttacaacgattttacttttttgactgctgctcacgcttctgcttacggtgttcactccacgtatccaagctcaccacaataagaaacaggaaaaagccgccaacgaccgattctagtgtcaaaatcaaataacgcatggccaagtagcccttaccgcctgtgacatcccgatagccgacgtagccaaatgtcatgagaatagccagccctaaaaccagcaacgtgtacatcagcgttcgttttaaaatgcgtttgaatgtcgtcatgcggtgacctgctttctaatgagtcttacttattatctttcaaaatcgtatcagcttgcttctgcaaattcgtcagtactgttttgggctcagcattttttgaaacggtttggtccacagcatcaagcaagttattgcggtacgtattgtaaccaataaatggcgttgaggagaacgcatcgtcataagcatccactgctgcctgataggtcggattctctttcaagtaggcttgataagcgctggactgggttgcggtcttcacaaccggcacataaccgctagccttagcccattgcgtttgaatcttggtgctcatcaggaatttcatgaaggtaaccgcacctttaatctgatcagctgaagcgcctttgaaaacggaaatcccattgttgcccagtacagaactggccttgccagcaaagcttggcatcacagcggttccccagtgcatggacttcggcgctgttgctgcaatttgctgaatagtcgcactagagccaaacccggcaaaaattttaccttgaacaaatggcacgttaaaataattgtccaagccggcagtgaccgccgtcttatcttttaacatggtcgtgatggcggtcatagccttgatgctggccggtgtgtcaatttttgcctgatacttcggcgtgatcaggcgattaccagcatcataggccaaggtttcaaattcaaaatcataacttttgttgaatgcgaccccagtaatgccgtcgtctttgagctgctgactcattttagtcagttcttcccaagtcttgggcacgctgagatggtacttatccaaaatatccttgttatagaacatcaatcgtgtcccagtggcaaatggaatttggtaatatttaccttcatacttcaagtttgtcgcaatgcccggataaatggctttgagctcatttgcggaaaattgtgacttcacctgactgtcaatgttaactaacatcccgtcatgcacgtattcaggaataatcgtatcagttacctgcccaatggttggcaacgtgcgagatttcgctgaagccagatactttttttgtaggttatcataagacccttgcgaagtagcaacaactttgtactgcttttgactgctgttgaacgtcttgatataaccttcaagcgccttgttataatttcctgtcatgcggtgccagaatgtaatcgtcactggcccccttcgtactcttttgcgctgaactgccgctaccgcaagcaaccagcaggactgccatcaacactgtcgcaaacccaagcaaccaacgtctcttcatcattttccctccattatcgcggtttgtcgtgaacagagacaacttgacctatccctattcggatataagtgcgttgtcgtcaaccacgaatagtataccaatacttaccggatcaaggggaactaaaggcaaaaaaaagaaagcgtatgccttcttttttagcatgaagctatgagatgatgtcaggcttgttcttcggtcaattttagatagaaattagccagtgtcatcgtgcgatatgctatgacccaaattgacgctaagccaaacgtgatcatttccaacaaccaccaacctaggaaactgaggagcaaaacgaagaactcccacttatggccgtacatcaattgacggctgcgcgtgacagcctcggtatagccaattggctggccagcatcaatggcatcacgataaatcaactgggcttgtgaataagccaatcctttgacaatcccgggaacaaccaataacaacatccacaggctgacccaaacgacttgcagcaaaccgatcagcaagctgccgagaaaatattcgccacgttcaaaaattttgaacatctgcgtccagctaaaccggtgatccgaccgaccgcgcaacccgtcaatcatagcgaagctgacaccgatcatgagcagcgctgtcagcaaaccgataaatgtcactgctgtctgccacattgcgatgttgttccaataaccatttgtcatcatccgtcggctgccatgagccacgacacggataccagctcgatgcatattttcattaagcgggaatggcaccagcgctacaaaggctgtcaataataatgccggtaaactaatccgtaaataatagctaaagttgggattcagctcagccttggcctgatcttttaaagaagtacgatccatagatattccccctctaactgtgacaagtcatcacaatccttggggttatcataacagaaaaagacggttgagttatacaaacttcaaccggacattgggatcaagttgcggttcaccgggaacaatagcaaagtgatcaccgctgactgttaattctgtttctgctttaaaaaacccactcgtataacttttgatcaataccggccccaccggcgaatcaaggtgtgcatcatacacatcgggtacattggtacgcggtagaatcaataaattgaatttcgcttgtcctgatgtttttgatggccgtgaataaggaccaataccgtcattaatatcaaggattagcgccttatcggcatgtaacatcggcgccaatcgtgaggcggccacagcagatacattaagctccatattttgcccccaaaagtaaaataatccttgtcaccaatattatggcgcccgaccgatcaagatacaactctcttgtaaaaatttcaccaaatgcctaaaattgggttaaaccgaatttaacccgatgtgattttattcagctaggacgaggtgtgccatgaatatttattcggctttaaagtttatccaaatcgatcatgagccagtcaatcacctgcaagttgtcatcactgatcaaagcggcaagcctgatgccggcatgaccgacttattggctgactgcttgaacaaaattgacattttcgttgaccttagcacaaccgatcgggtcagcgatgtgattgatgagctcaatctgctcaccccgctgccctatgatgtccttgaagaatatcaaaaaattcttgagcagccgatcactggcgtcaatattgcgatgaaaaagcagttgatcgagttgatttacgcaccaatggtttaggtttgtttattttatcataatagcgcggccatttttaccggtgtcttatcccggcgaagatgacgcgctttttatgtgcctgcggaatccctcctttagtgaaaaatcttgcctgattcttgttgtaacagtttcacttaggtctattttctgctattctgacgaaaacggaggcgaggaaatggaacaaacgggacaagcgctaccagcaaccattcaacgaatttggcgggcaagtgctgcgttgtgggcgctagtgctcatgatcatcggtttgggactcattgccgcttggtttttctggcattggcccttttggcttgggttgggtcttattggcattgcgattattcaactgctgttccgattagcacttgtgccgtatcgctatcgtttttggcgctacaacatcacgccaaccgcggttttcttgcaaaaaggctttttcttccaaaaaaatgaagccattccgatttcgcggattcaaaatgtcacgttagaagccggtcctttacttcagtggcagacactgcaacaagtcaacatcgaaaccgccagcaccgcccacgtgattgatggtgtgacgcgaccagtggccgaccaattgcgcaatcaaatcctccaattggctcaggaggcgcgcgatgaagactgaccaaccgcaacgactcgcgcctgtcgcgctactaattatttggatcagaggctttatttcgtggtggccgttatttgttggcggagggctttcaatactgcgcgcagacatgagcttcaatcaatttctattgtggggcggcctaattgttggcgttttggtactcaccctcacctggtcaatcctgcattatttgcgatttacctatcttgttgccccgaacggtctgaccatcaacagtggtgtgttgattcgtaaagtcaatcacatcccttatgaccgtattcagacggtacaacggcaacaatggttttttctaaagccactaggtctcgaacaggttgccatcgaaacagctggcaaagaatctaaaaaagccgaaggaatgctctcggccgtgccagtagccgtagctgatgccatcaaccgctaccgtcaaggaaacgttcagccagtgacacctgatgcgactgataatcaggctatccctgctgcacccgatcaaacaagcaccaccgccgcaccagccgcgcctgtggcagatgcggcctataaaatcaacggccatgatcttaatcaatacgcgctcacttcactaggcttcatccccatcatttccgggattctttggttaacacaaaaagctcaagaatacctgccagatagctggtacaagaatgctgagcatgccatcacgggcttagcggtttaccttattatcggtctgacacttattattctcattctaggtttcctgatctcctatttgaatattattcaaaaatactaccacttcactttggaccgaaccggtgacgaactacgaaccagccgcggcttttttcaaaccaatacggtcagtgcccgactgtcacgcttgcaggcggttcgctttaagcagagcattttgcggcaatggctgcatcttagcaccgttcaggcgttattagcctcaagcgccgctgatgaccagcaaaataatgatctggtcctgatgccggttatcccagaacggcaagcactcagcagcatgcgggcattcgtcagctggttgccggaaacatcaccgaaactgcagccaatcccagttagcaaccgctggtactacatgcgcaacatggtcctaggtcatctgacactactggtgttgccggctgtgctcgcaagcgtgttttggttgcacgtcagttggtggctgtggctggtactggctggcttgatttggttagtcgtcatggcgttgcaaggtcaatatgcggcaaccacagccgccattgctattgcgccacctaagcaacttatcattcaagtcggtgaaatgtggacaaggcaacgttattttgtccgtaaaaaagacattcaagccatgacgatcaaacaatctatctggatgaaggcgcgtggcgttgcccatttagaggtgcatattcgcaaaggcaacagcgatcagacagtcaacttccgctatatggccgttgatttggccaagcagattatgacttggtatcagccattaccatcagtgccgcaagaaggagacaatcatgctgcttaatcgtatccagtacaccccgccaaaatcaaaaaccgcgtatccattcaacttgccttggcaagcttcctttcgtgacctgacattgtcgcaacccgtcacgattttgacaggcgacaatggtagtggcaagtctactttgctgaatgctattgctgctaattacaatgcaatcctcatgagtggggcttcccttgatgaggacccggaatatcaaaatagccgtgccttagcccgttgtctcaagttgacttggcaatatcggacgaaggcaggctttttctttcgggcagacgattttatctcattcattcgcgcaacccgtggccggatcaaatacgcgcagacacagcttgagcaactggcacccgatagtttggaacgcttgccttatctcaatacactcagtgccattcaccatctttatcaagttgatctcgacaagctttcccatggtcagacgttccttgctttatttcgtgctcgactgcgcccaaatgcactttacctgctagatgaaccagaatcaccgctcacgccggaaaatcagctcagtctattagccttactacatgatgcggtagaaaatggctcgcagtttatcattagtacacattcgccgattctcatggcctatccgaatacgcaactactggcgttgggtgacacactagcacccactcaatatgatcaaatcgaacatgtcgcttttctacgtcactttttagatgatccgcaacgatttatttatcacctgttaaacgactgacccgttgcaatcacgcacctggctgttctaaggtgggggcgagcgatctccagcgcgggtaactacgctggagatcgcgttaatgaggaggaatagtatgctgacttcatcttggatcaaacaattaccgctgaccgccatcacgcaagtcaccccggttggtggcggtgacgtcaatcaggcataccggatcgatacggcgacaaagccttactttttgctggttcaaccgggttatcctgctgatttttatgctggcgaaatagctggcttaaaagcatttgacgaggcacaaatcttagcaccgcgtgtcattgctaatggtcaaattgaaggcgatggttttctgctactcagtttccttaccagcggcaatgggtcgcaacgcgatttagggcgattagtcgcgcatttgcatcaacatcatgaaccaaatggacgattcggctttgactacccttatgcgggcaccagcgtctcatttaccaacacctggaccgattcatgggcagatctattcattcaccaacgcttggacaaactcgccgcacacctgcttaaaaaggagctgtggcaagccgacgatgaagcaaccttccaacaggtgcgcaccatcatcagcaaaacactggcccatcatcacagcgatgcttccctgctgcacggtgacttatggggtggcaactacatgtttactgccgatggtcagccagctctgattgatcctgcagcagtatatggtgatcgcgaactcgatatcggggtaacgacagtttttggcggattcacccaagacttttacactggctatcaagaagtctacccacttgatgctggttatcacttccgccttgacttttaccggctgtattatctgatggttcatcttgataagttcggcatgggttacgctggcagtgtggccgcagtgatgaatcaaattctcgaacatggcttaactgaataaatcgcttcgctatgtattttcgaaacgaaaactatttcccaggaaattaaaacagcaaaacggccaacccactagttgatggattggccgttttgctatcttctaaaaatcaatatttaagcgttcagcaccttgttcaggaagctcttggtccgttcttcctttggatgctcgaaaatgtcttcaggcgtgccttgttcaaggatagtaccattgtcaaagaagacaacccgatcagccacttctttggcgaagcccatttcatgagtcacgatgaccatcgtcatgccttgcttggccagccgccgcataacacctagcacatcgccgaccatttctggatccaacgcactggtcggttcatcaaacagcatgatatcaggatgcatcgccaacgcccgcgcaatcgcgacacgttgctgttgcccaccagaaagctgagctggcatcgcatctgccttgtccgtcaaaccaacaacttccaacatggcttttgcctgcttgatggcttcctccttgctggcgattcccagctcggttggcgccaaggtcacattacccatcactgacatgttcgggaacagattaaaatgctggaacaccatcccgattttttcacgaactttgttgatgttggtgcctttatgggcaatatcttcaccatcaatcaagatctcaccgcttgtgacggtttcaagaccgttgatcatgcgcaggacggtacttttccccgcaccggatgccccgatcataacgaccacttcattgttcgccacattcagattgacacccttgaccacatcattgtcaccgtaactcttgtgcacatttttcatttcaacgcgataatcgctcatgccttcaccttcttctgaacccagttactcagccaggtcaataacgtaataataatcaagtaaatcaaggcgaccatcgtccagatcttgaacccttccatgttgcgggcaatgatgatcttcccggtttgggtcagttccagcaagccgatgatcgacaggattgaggtatccttcaatgtaataataaattggttgatgaaacttggaatcatgattttgattccttgcggcaaaataaccttccgcatcgctttaccaaatggcaggcctagacttcgcgccgcttccatctggcccggatcaaccgcctgaataccgcccttgacgaaggccgctgtgtacgccccttcgttcaaggtcaaagttacgatcccagcaatgaatgctggtacttttgatccaatcaggcttggcaccccggtatagataaacagagccaaaaccatcagtggaagaccgcggaaaatgtaaatgaaggtcgtcgcgaccccttgggcaaatttatttggcaagacgcctaacaacccaacaagaatcccaaccaaggtagcgaagaaaatggcgacaactgtgagaaccattgtctcttccaagccgctcattaaggtgccccagttagccttcaacaaaccgaagaaagaacgatcagttgtttgcgcattgccagcggcagttttttgggactttgcactgccgttgccaagataacgttcaatgatcttatcgtattggccgtttgcccgaagtttcttcaaaccagcgttaaacttcgtgatgagcgcccgattattcttcgaagctgcgaagccgtatgaaccttcacgggctggcttaccgataattttcaaggccatgccattgttgatcccgtattgcatcaccggttgatcttcaaaacaagcagctgaattacctgtgatgacgtcctgatacatattgttcgaatcatcaaatgtcaccgttgaaaaaccgtatttgtctttaatactgttggcataatccgcagaatcagtcccggtcttaaccgcaactcgcttaccgcgcaaatcttttagcgacttgatagtccctttttttgccaccgccatgaccacgcctgatttgtagtaaggatcactcatcaaaaacttttgttgccgctcaggtgtaatcgacatgccagcaatgacaccatcgatttgcttagcttcaagtgcctgaaccgccgcattgaatcccagcggcttgatctcaactttaaaaccttccgttttggcaattgccttaatgagatcaaggtcaatgccgacgtacttgttatcctggttcgcaaactcaaacggtgcaaaggtcacatccgtcccgattgtatatgttttttgtgccgctgccactgacttgccaggtaataaagctcccagcattaaaggcagggcgattagcagccctagcagccattttcgtttcaaccctaacaccacgctttctatgatatccgattgcaaactcgtttagcttgcaacaaatgcgctttctgcccacgatcaggctgacttaagcgaccttaattaaaaaaactactttttatgctagcggaaagcaacagtcgctgtccagtcctgatgttagattaattgacatttgtcacattattttacgccaacggtctaggcctccatacgccgttgaacccaattactgagccaagttaatagcgtaataatgatcaagtaaatcaaagcaaccatggtccaaatcttaaaaccttccatgttgcgcgcaatgataattttcccagtttgggtcaattcaagaataccaatgattgagagaatggacgtatctttaagggtaataatgaattggttgatgaagctcggaatcataattttgatcccttgtggcaaaatcacgcgccgcatcgcttttccaaaaggcaatcccagactgcgtgcggcttccatttgaccatcatcaaccgcctgaatcccacctttgacgaaggccgcggtgtacgcaccttcgtttaaggtcaaggtgatgatcccagccacgaatgccggaatttttgaaccgattagacttggcacgcctgtgtaaatgaataaggccaataccagcagcggcaatccgcggaaaatgtagataaatgtcgtggctacaccgcgagcaaactgatttggcaaaacgccaagcaagcccacaagaatcccgacaacggttgcgaagaagatcgcgacaatcgtcacaatcatggtttctttcaagccacccatcaaggttccccagttttcgcgcaataatccgagaaaactgcgatcactatcttgagtcttggcactggtttgtttttgggcggcttgtgtgccattgcctaaatacttggcaacgattttggcatatgtaccgtcagctttgacctttttgagtccggcattgaatcgttgatcaagatgatcgctacgatccttttgtgttgcaaaaccgtaataactggccttactttctggaccagccagcttgagcttcaaccctgtggcgatggcatattgcagaaccggtttatcatcaaaacaagcgaccgaattgccagtgatgacgtcctgatacatattgttggaatcatcgaaggtcaccgtggtaaaaccatactttgccttcaaacttaaagcatagtctgcggctgccgtcccagttttcaaggccacacgtttgccgcgtaaatccttcaaacttttgacttcgctattttgccccacggccatggcaaccgccgttttgtaataaggatcactcatggcaaacttttgctgccgctcaggagtaatctgcataccagcaatgacaccatcaatctgattagcttccaaggcctgcacagctgcattgaaccccaaaggtttgatatcaaccttgaaaccctcggcctttgcaattgcctgcatcaggtcaatatcgatcccgacatactgattatttttatccgcaaactcaaacggggcatacgtgacatctgtaccgatcacataagttttctcggccgcctgcgttgacaccggtgagcctagcacgaccgccagcatcaacgccatgaccccagcaacgcaccacttccaaactcgtctcatgaaaacaccatctttctcatttagttcctgtttctttcaaaaattgctaatgacgcatgctacttcaattcatgtgttttgagacctgtaaacccagctcccattcacagcttacaagtgtaccgatttttctaaaggttgtctacgcgcaagaaaagcaagattgctttatactaagagaaacttaaagaaaaatgtggtgaccttatgtttagctacctaatcgactatgatttgaaactttccctaccgcgaccggaaatcgacggtccccttttattcgaacaaattgagactagccgcgattcgttggctgcctacttgccttgggtcgcaacgacactgactgccgacgacgaaatcaactttttaaatacaacactcaagctttttggtgcaaggactgccttgcatctgaccatttaccaagccgatgctccagttggcatgatcagtttgaacacgattgacaccttggttcgccataaagccgacattggttactggctaaccattcccgaacgcggcaaaggcattatgcacaaatccattgaagcactggccgatattgccttccacgattacgacttaaataagctaaccatcaatgccgctgtggcaaatcgcgcgagcaatgccgttgccgaaaaagccggctttcatctcgatggcactttgcgtcaagacgatcaacgagctgacggtaccttcttagatgtgaatacttattcgctgttgcgttcggagtgggcttaattgtttcatgcgaaacaattgtcacctccatctcaccacgccatatgaaaaccccgcttgcaaaatcagcatgcggggtttatttttgcgccctatttctaattaggtcaatgtacaagcagtcgcagcaacgctggcgtcacaaagccttcgattaaggcagcaacggcaatcatcggaatgatgatgcaaacatactgtaatgcaatagccttcgcatctaacgacgactttcgataatatggatcggcaaaaaaacgcttgattgactggcgaagggccttgttgacttgagcagcgagcgcgacgccgataatcaaagcactcatctccagaataccatgtggcaaaatgcctaagacaaacgctgccaaagctccaccgatacccagcttagcggcataaatgcctagcaccaagccgacagaagcacaggtgagataatacgaaatccagtatagaaaaggaatcggaatcataccaatgatcatgaggccaaaggcaacgcgttcgttattcactaaaatggcccaaaatgcactgagactgtcgtgagtattagcaaacttgccagagaggccagtaaaaataccacgaacaaagttggggttcgcgcccatgaccagatatgtcaccagaccaacaaaaatggtgacaccaaacaaaatgagccaaccgatcaatagataatggccaataacattcaaattgtatccaagccgtttcttcataggttgcccctctttcctaataacagacgctagggtaagtatactccagggtggaaagggtggctattttgagggtttggcggtatgtgtcaagtctttctcggttccactaattgaactattcttttttgctcgactgccggccaggacgacctccacaggaattggcgtggaacggggtgggcacgactttgagcctcgctttgtgagtctcaaagctcggcctctgtgtaggcgataaatcgccaacacagacgtcacccctgacgccattcctgctccggtcatcctggcctcctgagtgggttcagttgaagatgtgtgctaggtgaccagtgcccgaactagtacttgcgtacagcgctatacgtccctgataagcaccctggtgcgttgtgggcgctggcccaaacagctgaaggctccgaagcgtggtcttcacttctggcttgatttgcgtttccagaaacgccgtagcttccagactgctgaggtaatcatcgttctgcagcgcgtcaatgatcctcaactctgcgatcagaccacttcttgtccatgaacggccctgcagcttggtccgatacgtataccgtctatggttagactcacagcttccaagtccacgccgatccaattgtcgattcgaaagtgcctcgatgtaaggccaatttcggtcaagatagcgccgaagcttggtgagattatcgagccattcactgcgcattgagtcccctgaatcggtgtcttgaaccatgctttccgcggtatccaagaccatctctgttctggccttgttgccagtccaaactgacttgcggagtaggtcttgcagatcacgtggcatcatgctgaaccgctccttgagcttgtgattcaggtggtagccgtctagcacgtgcgcccacctagcggcgcccgggaccaactccttgaacgccttaggactataaccagacccattatcactgccggtcaggacgcaggtctcgcgcaaatcgtagtgctggtcgatgtatgacctggcttcatcaaagaccttctcgtgcgacagcccggtgatgctatgccggttgatcaactggtcccgcttgcctgactgcgtcacgccttcactgatttggacgcgatgaaccattacctgagtgccatgcttcagcttcacctcaaaggcatcgccttcgatgaacagttgcggtactgctcgctggtctacctccaccgtgacgtacttggcctcggcttcacgtaccgtgtctagctcttgtccagcctcgcgcactaagttatccacggtcatcgctgacatcgagaatggcgttagaagatcaacggccttcgcggttgtccgcatcacagtcaacgaggctagttcggcgaccttagccatgatcattggtgtgaagtgtcgacccgtagctaagccaaccttttcgtcaaacgggtaaaagagccggccactgtcatctttcaccaagcgccgcttaaacacgacatcaccgaacatggcagtgatgtgccgctgatccttgtgaatgattctgtaatccttatgaccaaggcacaaatcatcatcaagttgctcacaagcctgagctacgccggcacagaccaactggctgagctcggtcatcatttgactttcagcactgataatggagtcattggactttaaagcttcaaggacaattgctacaattgaggacatggaagatcgcttctctctgattttgtgtggtagctcaattagaggacaagcggtcttcttttgtcaatttatccttctgactcggacctaaccaagagaaactttacacctagggtttggcggtatgtatcatttttcttctaatcaggccttctcctattatccaagctgagtgtccatcagttctcactagccgttccttaatccaacatcgtgccacgaactgggacgtttggcgtcgcctattttcttgttctgccttagcactaaaattgaaatgacgctctgaataaatgcctttataaactataaacagcgtttcacatctttcgccatgccagccgtcagttcgcatgcttgctgtttagctttttttcgtgaataatgacggcatggaggtgtcatgatggaagtcaatgaagcacaagccatttttgatgcagcacgggatcaagtagcgacgattgtggtgggcaaatcaatgccgatcacattgactttcaccgccttacttgcaggtggtcatgtgttgttcgaggatattcccggtgttgggaaaaccaccctcgttcaagcgatgaccaaaaccttagcggtgccattttcccgcattcaattcacacctgatatgctgccaagtgatgttcttggcacatcaatctttaatcgggccactaatcaattcgaatttcaaaaaggacctatttttaccagtattttattagcagatgaaatcaatcgcgccacgccacgaacacaggccgccttgttagaagccatgggtgaaggacgggttacaacggatggtcatacctatcagctagcccctgacttttttgtcatggcaactgagaacccgactgattatgcagggacttacccgctccctgaagcacagttggaccggttcatgcttcgcctctcacttggctacccagatgctgacgcggaaaaaagtttgctgctaacgcctgatcgtaaaacgatgattgctcaattaacacctagactagacgcatcgttactagctgaagccaaaaaactcgtggctaacgtgacggtcagcgatgcaatcgccagttacgttctcgcgctagtacaggcaacccgacacgacaaccgtgttcggctaggtatcagcccgcgtggtggcattgccttggtcactgccgccaaagccttcgctacgcttaacggacgtacttacgttgatccaagcgatattcaaacgctactcgatcctgtttttggtcatcggctcattgccaaggatccgacactttcgacggcaacgatcttagcagatattctgcaaaacaccgccgttccgattcgggggtgagcacatgaactggcgcaacttttttatcaatgctggcattttgcttgtgctcagcctgctgatcgtttttggcgtggcatttaactcatctaccagctggtttgccagtgactttgctatcctgatactactacttgcgataccgctattgtggccattgaaaaacacactgcgtttcacagcagataatcctgacatgatcgccgatagaccggtaacgcgccttttcacgctgactcatggcagatggctacctaatctttttctgcttgacagtgccaaaacacatacatggcatttgccaatcggacaacggacagccaaaatcagtttaaccttacagcgcggcatttatgagcagttaccgatgaccgtcaccgtgactgatttattcggctggtttcgtaaaacattacccttgcgtttagccacaccgatcactgttggccccgcacgcagaccagaagctgccgcacgaattgcagatgacttttcgcaaaaaatgtctgctgctgacgctggcttgcccagtgaccgcattaaaaatttccgcgattatttcccgggtgataatattcaacaaatcgcttggaaagtcagtgcacatgccgatacgctgattgttcatgacgataagcatgaaggtcaggccagctggacattgctgttgctaatcacaccaacgctgtcactcgagcctgccttgagcttattcgcaagtctcatggacacaggcatcttcagcgggaacggctatctgctagacagtcggttaacctccgtcatacaaggacggcaaaacacatcgctagccaactttgagcctgacggtaccgccacgcctgattctttagctgctttgaccaccccacaacatcagcatcgcgcctatcttattttaactgctgatacacaggccgcagtgcctttcacacatgcactggctccggctgctacaacactagtcgacttgtctggaggtgatgaccatgcctaaatggctacaacgtctccttaccattttgctgacatggtggttattggcactttttgtacagcctttctcggtgattaatccgatagcacatcctcgtgaactcgcaggctatgttgtcatcatcagcttaattagttatcttgccgcattatggccacgggcctggccaatttggctaaccactgctttcttgagcatgatcgttggcctttgggcaatactgccgcttaaacagcattttggtcttacctggtttaacacttatgtccaaaccttcaataccgcgactaggcgatttttgcaagttggtggcgtggatgtccctgcgaccctcagcatgacgttgattgtagttcttgtcgcctttctactattaataaccgttgttctccaactttatcctggcgcagtggccattgtgctcagttatttacttgctgtacatgttttcaatggcagcgacctgacgacacaatttttccagttcgctgttgtcaccgggttgttggctgttttgcacctttatcacacccgctggcgagcgtttttaattggcagtcttagtattgttggcttaacccttggactcatgtggctcagcaccagcactccgttgaatgactggttagctaatatctctgttcctgcgcgcgaacgactcaatcagcgaggcttctatgccagccttgaagcttacgctaacggctcaggccgcacaggattcaccgaaaacagtcgtgttttaggcggtccggtatatgatgatcccacaccagtattcaccgccaccagtcgtgaagctcattattatcgcgtcgaggttgactcattttatacaggaacgggttggcgaccatctgcatttcagacgcaagctgctcctttagacggtgctattatgcgtgatccatcggctcgagtcgattatggtcaagcaacgtcagtgaaactagtttttaacggcggtaaaacctttttgccattaccgtatgggcaattaacttttactggcggtaaaccagaccccacgaccgattttttgcttaactcagccacacaaaggataactgcgagcgatgatcaacgcttcgaacgccttgatattcaggtgcagcaaaaacagtttaccgatacgcaactcgaaactgctacgagttcaactcagttaatttcatctaattatttacggcttcctagttcactaccgcaacgagttagaacactggcaaaaagaatcacggctgatgccaaaacgccttatgaaaaagtcatcgccattcaaacttacttgcgctcagatccgcgcttcacctattcaaaaacagatgcacagcaaacaccggcaaatcgtgaccatgttgattactttctgttcgattcacctattggttactgtgataatttttccagtgctatggttgtcctatgccgcagcattaacctgccagcacgatgggcaaaaagatttaatactggcacttttgaaggcggaagtggcgcgaacaaacaatacatcattcgcaatagcaatgcacactcttggccggaaatttatttcaacaatttaggctgggttcccttcgaaccaacaccaggattcagcaatccggccacccctgatgatcctgtaatgccttccgcggcaagcaatacagcctcacaatcagccagcagttcagcagtcagatcagcagtatcttcgtcagaatcgcgttccattgtgagcgcctcatctactcaaccgaaaccgtcttctcgatcgtctctcaacagctttcattggacagctatcatcgttttgactgtcgtcttgactttatgcattgtcttaatctggcaactaccagcgctggtggcgttcaccattagtttcaatttgacacagagaaactttccccgccgttatcgtttgttactttggtcattacggcgcgtgacacgacgccggtcaagtcaaccattgacagtctatgcacaccgcattgatacacgattaggcgatcaacgacacttcaccacgctcacgcatgcctacgaagcttggacatttggacatgtcgcaattcatcctgatccgctcacaacatccctaaaatccttgagcacgcagctagcccaatacgcacgacgcaaattccacgtgaaacaaaattaactttacgcaataatcgttccacatgaaacacagcagcatttctgctgtgttttttgagtgtttaacaaaaatactcggtttttacataccactaatgccggtactatttccaaaaaagtttcccttactttcctagaaattctcgttaaattattcatccctattcattgtcataagcaccatctgaaggtttcacacgaaacataacacctattattcatggaaatgtcacaattcattcttttccggctcgtctaccccgtgagaaccttgctataccaacatttaacagaaaatccttgcacttactaataaaaagcgagtatgataatacaaacagtttctgagtagaccttagaaattgtttggcccctgctgctattcttttagcagccgtgccttttcgactggactctgcagttagatcgtgacgtactcagaagaaaggggggagccgctgactttagcggcgaacacttatgaaagttatgatcgtacttgaaaacatcgtcatggacggtgttaaacgcgcatcaactgttttaggaaatgatctcgttaaacactatgatgtcagtttctatagtttagcagatgcccctgcatattttgaattggacgccccgctgcttattgccccgcgtccgacagatcccaagttgcttaacttctttggaagcgacccatatacacattatcgtgatcaaatcaatgacttgattatgacgattcgtgaccagcattttcaggctgtgattttgcctgctggtttgacgaccagcttcgcaccgctcatcaagcaggcattaccagatgtcaatctgattggctggatgcacaataactacgcaacgtacatggaagattactacgttcaaatgcaagctgagtttgaaggcggcttgcaagctgttgataccttggtcaccctcactgaaagtgacctaaattcttacaagcgtttcaatccgaacacggttaaaatttacaatcccctcacccttaaccccactggtgaggcaaatctcgacgcgcaccggatcgccttcactgggcgcattgcgattgcccacaaaggtatcgacttcttactcgaagccgccgcatctttaccagatgactggcaaattgcgattgccggctcaggcactgatgaagatatgaaaaatttctacgatttgattgactatttccatgtggccgacaagttaatctaccaaggcccactgaaagaccaagccttacgcgatcattatcgtaatgcttcaatcttcgtatcgacctctcgttgggaaggtatgccgttagttatcggtgaagccatggcttctggcttacctatcgtagcaatggaaaatactggctcacgcgaatatcttggcaacaatgactacggtttactcacaaaggcacaagacgtccctgatttcgttgataatctccaaaagatgatgtcacagccagcattacggcatcattatgcccatcaaagtctcgaacgtgccagtcactttagccccgaaaccattgtgagtcaatggatgccgattatcgaacatcaaccaacccgtgtttcagttactggttaaacaagccccgatgcaagcgcctgttgcatcggcttttttgtgagcgcgttatgatgatacacgtacaatcccgattaaaaatcggcccataacgactgtagtttggtcatgacagccaagattcggtacaatgagcttatcttaagtatggaggctctaaccaatatggaatcaatgaagcaaagaatgcttggtggcaaactgtataaagcaaacgatccagaaatcagcgttgagagtcagcgaggcagtgatctcgtctggcagtttaatcatttagcccctgataaaaaagcagaacgagctgcggttttaaaacaattatttcatgcatttggagacaataactacattgagcctcctttctacgttgactacggtgctcacacgtcaatcggtgatcatttttatgccaacacagattgtgttttcttggataccgcgccaattaccattggcaaccgggtttatttagcgcctaaagtgagtttatttacagccggccacccaattgatgccgctatccgcggtgaagatttagaatatggtaagcctatcaaaattggcgatgatgtctggattggcggcggcgtcattattaatccaggtgtgaccatcggcagcgatgttgttatcggttctggatcggtggtcacaaaagacgttcctgatcatgtcatcgttgctggcaatcctgctcgcatgattcggcggattactgataaagatcatgcccagtggcaacaacaaaaagatgagttcttaacctggcagcaacaggctgatgaaagccaacaatcaaagcagtcttaactgaccattaacggagagaacaatgttcaaattaatagcaacagacatggatggcacctttttgagagacgacatgacctatgatcgcgatttttttgcgacgttacatgaaaaaatgcaagcgcaaggcattcagtgggtggtggccagtggtaatcaatactttcagctgactcccttttttgaagctttccctgatacgatttatgttgctgaaaacggcgcctacattcgcgatgctaacaaagtgtatgctttaagttcttttgaaaacggtgccattcagccaattctgactaaactaactagcatacctgatctcaaaattcttgtctgtggtcaatcaagcgcctatgccctgaaaactactgatgctgcccatatcgcaacggcacgacaatactacaagcaattacgtctagttgatactttcgacaatctcgatgatcgcattttaaaatttgccattagttgtcctccagaaaaaaccgcggctattgttgccgaaatgcgccaactgttggttggcttgggagaaccgacaagcagcggccacggcgacattgatatcattcagcccgggatgaacaaagctgccggattggcaacacttggtcggcatttaaacattcaacttgctgatatgtgcgcttttggcgatggcggcaacgatttagaaatgctacgggaagttggtcttggtgtggcgatggcaaatgcaacgccagcagtactggcagtcgccgacacaaccactaagagtaatcaggaacaaggtgtcttgcagtttatgcatcatctgttatctgaaccctgaagccttgttggaagaagccactaaaaaggaggccgcatgcatctcgattttgcgatgcatgcggcctccttttttgtgttccacgtgaaactcactcgaatacgcggacgtttaatgtggaactaggcttaacaaatccctacttttcagcaattgataagtctggcactgtttcctgattcgtcatgaccattggcgaaaacaatcgcgcgatcatcgcagccgacagcttatgttccgagcgcaacaagtcaggaatagcaacgtgctgcttcatgctgtgctgaatcaatctagccgtcgcctcataaccaagatacgggcttaaaactgtggcactgatagccgaatggtgaaccgcggtttcacactgctcacgattaaccgtcagcccagccacacagtttgacgttaaggttgcaatgccgcgagccaagtaccgctccccttgcaacaaatcacggaaaataatcggctcaaaagcattcagttcaagctgtccggcttcggctgccatactgatcgtgacatcttggccaatcacctgaaaggcaatttgattaacgacttctggaatgataggattgacctttcctggcataatcgatgaaccagcctgttttgctggtaaatgtaactcattaagtcccgcctgtggaccactgcttaacaagcgaagatcattggctacttttgacaaatcagtggcaagtcccttcatagcaccagagaaggccaccaaaacgtcgcagttctgcgttgcatcaataaaatcctcagctggcttcaattgcagatcaatcaattgattaacctgacgaataatatgactacggtaataaggcgacgcattcaacccagttccaatcgccgtaccgcctaagttaaccgcctgtaaatcggccgcagcccgtgtcaatcgggctaagtctcgacggaacaagctggcatacgcgtgaaaactgtgtccatatgttgtaggaacagcgtcttgcagttgcgtgcggcccactttaacaacatccgcaaactcatgtgctttagcgtccaaggtttttatcaaaaacgttaatgcttgtttcagcggtggcaatgcctgtaatgctgccatctttccggctgttggataagtatcattggtcgactggctctgattaacatcatcatttggatgaacgcgaatcgttttgagctcagcgctggccaagttggcgacgacttcattgacgttcatattcacggaagtcccagcgctaccttgaatcgcaggcgcgaccaacgcatcttgatgttcccccatcagcaagctgttgcacgcagcaacaatcgcccgcgactttcgaacatctaacgtacctgcagctgcattcacttgtgcagctgctttttttatgatgatcagacttttgaaaagtagcggatcagtccgctctgtactgatcgggaaattcgttagcgcacgggtcgtgtgaattccatataagacatcctcatcaattgccaacttaccaatacaatcttcctcgatacgcattgtgaacttcctttcatataccaatatttactttatcagtataatcgtgtaaaaacatgcgtcaacgtttgttgttaggtagtctgacaacacctataaaaagtataccaatttaaaaaatcactgtgatgaagcttaaatgcgttaaacgtattcatttaacaggtaaccgtccgccgtcacgccattgcccgatcatttgctttgcctgacaagcgttagcaaactttgtcagccgttgacgaaataatttaggttggtgacttttgatttgaatcgtgtcacaacggactcgttgatacaaaggcggacacgactgaaaatactgccacgcacccggacgacgtttaagtgctcgaataattctgggatcaaacttgaaatgacgcgggttcatatcaggcaaaacagcatacccagctgccgtcatcttccctaagtgaatcatgcggcgacatcgttctttattcaattccgaccacgcgctccccacttttcttggtacaaagcgctgcgatgctggttgatcaggtgccaactttttgtaggtactgtcgatccagccaaaacacatggcttcttccacggcgtcaacataccaaaacgtgtcatcctgtttcggtacaccacgcttaacgtctacccaacattccgaggcgtcttgatagtgagctgttaaccaactacgaaattggtggcgatttgctaccgttagatgattgacgatttttctagtcaataaatccgcctcctcacataacaactttcaatggtcattttacaaaaaaatctacgcgacgtatttatccgcgtaaatttttcacctaatttattgatgctgaattgcccatcaatgtccctgatgtttttctaaacgtttcgcctgcttcttcaagcgaacctcacaggcgtgctggtctttcagttgcttgcgtcgttgctttttcacctgcaaatttcgcttgtgtgctagcttcaaaaaagttgttgcttgggtccttttagcgttacggacttcttttcgagcctgacgactacgcctttttggacttgttgtcatctgtaacttggggagaataacatcctgtgcggctacccaatgtaagtcttcccatcgttgttgaattaaatgtaacaactcacttgctgtcggggcttgtgtcccaaatgtgactttagcaacacgatacgtgtctcccattgtttgttcgaacaatccgcgataaaaaggtcgttcaaaataaactgttagcttgccttgaattgtcaaactaacacctcctttaagattttcacgcaatctggacatccaaggaggaaggatactgacagcctaagccgcgtctggactaccaaccagactgtgtttttgatagcgcaatgttattgtctgactttgataaaggtcctgtcaagccaagctagtgtatgacaatatcaatgtctcttaccaagtgcatataagtccgtttagcctcactactacataggtacttagtcagctgtggactgccttgtcagccatcgataagtcactacttccgtaaaaataagcagtagtatcccaataaccagaatgaatcctttcatagataccaattcatgtccagcatgtagcctcgtcatggtgacaaggccgcccaacaaaagcaaatgcacgggaaataatctccgatatttttttgaaagcttcatttttatgcaacaactcgtcagcttttaaaatttttgctgtcaccctataggaccgacatgccaagatttcgagtcatttcttcacctcctgcagcatctagtgtaacggacgacacgcatgataacgtcagaaaaaaataaacgttctgctttctatgattaacgtcaatattcaaaaaacctccccactaagttgacccttgccaaccttgtcaggaggtttcaatattgcttttaagcttctgctgttgcttctgccgcgtgccggacactttccgccacgacttccgcaacatccccgtcaaaagcattaggaatgatgttggtggtcgatagctctgcatccggaatcaaacttgcgatgcccttcgccgcagcgatttgcatgtcaatggtgatcttgcgtgcgcgtgcatccaaagcgccacggaaaatgcctgggaaagcaagcacattattgatctgattagcaaagtcgctccgcccagtaccgacaatataagcacctgctgccaatgcctcatctgggaaaatttccggctctggattagccatcgcaaagataatcggcttgtcggccattgttttgatccattctggcttcaaaacatgtggcgcggatacccctacgaaaacatctgcaccttgcagcgcatcttccaaggtgccagtccgattttcatgattcgtgattttcgcaatggcggcatggtgtggcggtagttgatcggcattcttttcagctaagataccaaccttgtcgaccaccatgatatgcttaacgccagcggccaagaagcgccgggcaacagatagtccagcagaaccgccaccgttgacaacgaccctgatatcgccaatatcctttccagcgactttcagtgcattgtatagcgcggcaagaaccacaatggcagttccgtgctgatcgtcatggaataccggaatacctagctcctcgatcaatcgtgcctcaatttcaaagcaacgcggcgcactgatgtcctcaagattaatcccgccaaacgttggggccactgccttaactgctgcaataatctcttcagtatcttgcgtatcaagcacaatcggaattgaatcaacttttgcaaaccgcttgaacagcgcggccttgccttccatgactggcatagcagcttcagcaccgatgtttcccaaacctaatactgctgaaccgtcgctaataactgccactgtgtttttcttggtcgtcaagtcataaaccaaagacttgtcttttgcaattgccgaggaaaccgcaccaactcccggtgtataagcaatactgagatcatcccgcgtctcaatcgggacctttgagacaacactgagtttgccgccaaattcttttgcctgatccagtgccagttgattaaaatctttctttgccatgattcttttcccccttgtttaaaatgcgctcccaagtcctgaaactggactggtccacgctccgcctaaacgcgatcgctggccctgaaacctgcgtgtagggaccttggtcgcaatggtcaaagcccggccatcacgccctaggccacttactctccggtttctaaccgggccgactcacgctctatctaattatgaaagcatccgtagaatcgcggtcattgagataacagtgatggcaccacccaagcgtgttgcgacctgcgcaaatggcatgaggttcatgcggttcgccgtactcagaatcgccacgtcgccggtcccgcccatgccactttgacaggctgtcacgatggccgtttcaatcggattcatattcaagaaccgagccacaaagaagccggttgaaacaaccgtcaacacaacactgatcacgacgataaaatattgccaacttagcataccaaccacatcttttagcggaatgtataagagaccaagtcccgccatcaatgggaaagtgaagttactggaaataaatttatacaattgcttagcgccacgttgcgtttctcctgggataacgttgagatatttcaaaattgcggcagcaacaatcatcagcactggtcctgggaagcctgtgatggactgaagcaacatgcccaagatgaataaagtacaggcggtcaagacgccagcgcccatcattttcaaatcaatttcgccggtatcgtctttcatcgcatcagcgagatcatcttcggccccgtttaatcgaaccagctgcccttggcctgacaactctggccgcttttcccctaatcgattcaataaacctgaacacataatcgcgaaaaagtttccaataatcgtcgccggaataagctgagcgacaagcgcgccgctggtcgtgcctgtgatcgtgctgtatcctagagatagcggtaaaataccttcaccaataccgcctgccaatactggcgtgacgatgaagaacatcgtgtgtttccattccaaacctagtaatacgccaaccagtgtcccgacacccattgcaagaatcatgccgagcatcattggaataatcatccgcatcaatccttgaatcagaattttacggttcattcccaaaatactgccgcagacaagacaggcaatatagaaataaagaaagtttgcttgtttcatgagcatgtctgcagcttttaacacattcggattcatcgcattgtagaaaacgagaatcgaaggtaccaacagcgataaaatcgccggaccgccaaagttcttcacaatcggaatattggctccgatcgtacctaataaccaacccaacgtcagaatgaccgcaaacccgccgagcatgttaactggcagttgctgcatcacaccggcaaggacgatgatcgctgccatcacgatataaactggcaatggtaccgaccctaccttgaagtccatccactttttctgcggactcgttgatttgttgggtgtaaccgtcttgttctccatgtttccttccccccaatcttttgttacttacagcatattgtaagcgcttcatcaggggaaggctatttaacttattaaaccataaacccatttatttaagcgattgttttactattcacaagatggtttctttactgaacaggagtatgatcatgaaaataaaaggatggcggttatggggctggctctcattaatttttacttccaccttgttattaacggttctaactgtttatggtttgaccatgctggaaaaccgtcagcaatttgaaagccgtgaaggtcaattgttgatctcaattggccgtcagttagcaaaggatccccgtgtaaccgccgcacttgaagcaaacaaggctgattcagccacgcgcacctacgcagggactgtcgagaaaaattttgatttagattttgttgtcatcatgaatatgcaaggcattcgcctgacgcatcccgatcccaaacaaatcaatcgacattttcaaggtggtgatgaagtgactgccttgcgcggtcatgagcatgtttcggttcggcgcggaaccttgggccgctcactgcgcggattcgtcccagtgtaccgccaaggcaaagagatcggtgttgtggcactaggcattaaggtcacctcactgcaaacactcatcaagacctcgcaagatggcttccggctggcgctattcgccggtacgatcataggcctgctgacagcgtttttagtcacctactatattaagcatcagcttcatgaccttgagcccaaagaaattgctaggctgcttgaagaacgcaatgcaatgcttgaagaaaccaaggaccctgtcattgtgattgatttgcaccaagtcatcatgctcatcaacaaagccgctgccaagctgcaaaatcaccttatcaccgaaagcgcctttattggccagccattgacgaccttgattgccaaccctgaacgtgtcaatctgaatgtcaaaaccgagcagttttatcaacaggatggccaggattatcttttctctgccgcacctattatggtgaaaaaacaaaaaataggttacgttatctttctacgaaacgctaccgaagcgatctttgtcgccgatcagttggccaacaccaccgcctatgccaacgcactgcaaagccagtcacatgaattcatcaataagctgcacgtgatttacggcttggtggcaataaaacaatatgacgaattggccatctacttgcaagatttgttaaaacccgagcaggaatttgcaaatcgcttggccttgctggtcaaaaatccactcgttgccggcttcatgattggtgaacgcgaaaagtttgccgagcgcaaaacgaccctcgactttgaaatttcccccgaactaccacctaatcctaatacccaagaaaccaaaacgctgttaacattaagccgctatctacatttcgggctactgcagcacgatttgccggacaccattttgatccagctagagtacgcacagaatcgtctcacgatcgcctatcatttagacgaaccagccaaacgaacggactttatctcgcttattcatcaagactacttccaacaactgctgacggagttgaacggctcagtcaccgttagctcaaccgatccgctgacactaacattaactgtggactaccacgaggaggctcaaaatgacgaacattctaatcgttgaagatgatccaatggtgcaatttatccaccgcaattatttagaaaaaatcggtacttttgacaccatctactcttcagaaaccatcgctgaagccaaaaaactcttgtccagccgatccatccaactcgttttactcgacattcgcctcaaagacgggaacggcattgattttttaaccgacctgcgccgcaccaaacaaaccgttgatgtcatcctcatcaccgcggcaaacgaggtcaacattgtcaatgatgccttgcacttaggcgtgattgactacctcatcaaacccttcacgttggaacgcttcgaaaaaagtattcaacgttacagaaccaagcatcaagcattggtaactgatcagcttgatcaaagtcaactcgacacgtatttcgaaccgcaaacaaccatcgctccgacagtcgatctagacaaaggcctgagcaaagccacgttgcaactcattcaaggcgccattaaacaactcccgcaaccatttaccgtcgcacaattaacgacagaaaccggtctctcgcatgtttctgtccggaaatatttaagttttctagaggatcatcattttctgaaaggcgatacgatttatcgcaagacaggccgaccttataaaacttatcagatggtcacggcaccacatgcgctgtcgtaaacatcattcaaatctttaaaaaggcagtgatcttaaatactaagatcactgcctttttgttgttaatgattgaggttgcttacatacaatgaacgctaatactgtatttcctaaaatagataagtttcacgtggaactcctcagaaaattaaggcctacatttggttccacgtgaaactcgctaccactttccacaaaaaccggttcacacacccgttaaagacgtctgaaacagtccattggcaccgtttctcctattttttcgacgcttcaggcaaagccgtatttttgttcgtgatatcaataaactgtgcttcacctgctactgaatcaacggctttttgtagacgacgcatggcggcgcttgcaattggcaaatctacaaagtccttggtcgcattgtctagttcgacttcatcggctacggaatcttttagcggccgcggattgctttcatctaaagcgcggatcacaactggcttcaatggacccatctggagcaagtcgagtgttgtttggtagtcaatatcataggcatcggctagtcaagtgtctcacgaatgccggcctctgctgccatgatggcaacattcgtgatcaatttcagtttcgcaccgtttccctgctcaccgacatattttacagtgccaaacgttttcaagataggtgtaacatcagcaaccgcctgtttgtcgccagcggcaatcagaaccaagccagcttcacgtgcatacttcacgccaccaatcattggcacatctagtagatgggtcttggtcggcatgacggcttgaatcgcagtaatcttacgcgggtccaaagtcgaggtcacaatcagcgtactccccggctgcaaataatgcacaatacccggagtttcagtggtcccaatatgaagtgctggcacatcgtctgacatgaccgatgtgataatgaccctggacgctgtcacagcatcttccaatgaagttgccgtgcgaacgtgatcgcccgctactgccgccatcttggcgggcactttatcccaaactgtgacgtcatagccagccttggccaaatgtggcaccatatgactgcccatatcgctaacaccaataaatgttattttcatgttcttcttccttcccgatcgaaaatattcacctaggcaatagatacttaaaaaacaagtctttttcttgaagaagcattttatcaagaaattcattgccagctaaattcgattaaaacaggatcaataacacctgtaaccattaacttagcatgattgaaaagcgatttcaataacacagatcggcacgagtcattgtcgtcttttttccctccaccttacctgtttgatgccaacaaaaagtgttcctaataggtttacagtgctaattttttccatttacgaattttcggtcgaaaatttgtgaacggcgcaacactattgatgtgaatccacttccataacggccattgcgccttggtcgtagcccacctccgaacgcctgcatcgaaaagctccgattgtgataacgtctcgatccaagtacacaactccttgaccagcagatcaagcgcagcaagttggtcttgaaggctttgttgaccatagtgctcataaaaagattgatacaaaccacctaggttattccatttatagcccggtgcgggcgtttcaacctcaataccagcaacctcatcgcgatcccagctcagcaacaagttgagccaacccaattggtatgacagcatttctgacggtgtcttatcaaccccttcaaccagcaactcgcgcttttcttcggggatatcggtaaattccgccctaaatttcgcatagcgctcttcgatcgtgtccagcaaggcttgtttatcggcgtatgttttcaacttgatcagctcctttagctaaagcgtaccaagtcacgtcgaaggttgctactcttttaggataataagaagcctttcattctctttatcaaagagcaacaggcactgattcaagaaccttattctagtgcctttccagaaactcgtgtcaaactcaccgtcaacacattatcggccgttgtattgtaatcagccaacatgcccttcacgatccctcgcgatgggccatgcgtgcttgtcgtttcctcgtaattttgaatccatgtgctgactgcattaaatccgaattcgaatccttcaaaaacctgcatgtaaaccgggagcgtggatttgttgccacaattgtgattttcaaaacccggccatcagcgatctgcatggttagcttgatcaacccatcatcgatgaaaatgacgtcgccatctgcggcagtctgcggaagtttatacgccgccagtcgcatgttttcgttataaacccgttgtacgtaatcgtaactgcccaagtctctttgcattcttattcaaaacctttctgttaaaatatggctgatcatttggtgtttgcgaatacacatcaacctttcaaattgacgtgtggtagcttccacagtgtaccgtttagtgccagaaataagaattaattagctcacccgttccttgcctaacgactaaaacactcactaaagcaatgaaggaatgactacgatgcgaaaaccatccgggcgtcaccgcggtacgaacaaaaccttatcctttacaagtgtcattctgcttgggatcaatggcatcattggatccggtatctttttgttgccaggcacactttatcaagaagctggcttgggtagtgtcagcgcgattgttttggctggactcagtacaacgttaattgcactgagttacgctatgctcgcctctaaaatagacgatgatggcggtgcgtgggtctattcaaatcgcgcttttggcgcttttatcggctttcaaacaggttggtttggatggtttctgggcgtgattaccattgcggctgaattggccgcttttctcactgcattgggcggattaatacccgttgtcaagcaacgaagcgtctatattagcgtggccttagtgatcattgctgctttaatcgccattaatttagtcggaccaaatatcctcacgttcatcgataatatctccagtgccttgaagatcatcattctcatcgcggtgattgctgccggtggctatttcatcagtacacacggcctgcacgtaagccagccgcaagcagtttcatcagattttcgcacagctttctcgacagcattctatatgtttaccggcttttcattcctgccagttgccgcgaacaaaatgaaaaatccagaaaaaacactcccacgcgccctcatggtggtcatgttgatcgttattgccatctatggcatggctcaaatgacgacgatcgttattctcagcaccaatctgatggctgaaaccttaccagtcgcggcagcgttcgccgcagttgttggtaccatcggaaaaacggtggtgatattaggtatgctcatctccattctgggtgttgctgtcgccgtttctttcgatacgccaatcgaaatggcttcattagcaaccgaaaaaaatttgctaccagcagtattcgggcgaaccaacaaaagtggtgccccatttgtcgctatctggttgacaatcggtattgccgcattgctagtggtatctggcagctacctatttttagtcaacctgatcgtatttagtgcctttcttcaatacatcacgaccatcctagcatggttcaaattacggcatgatccaaccctacccgctggtattcacctaccaatggcgccacttttaatgggatttgccttattgctgatcggctatctaatgaccagtgctacatggctgacttggctgattgccgtgatcgttgcattgatcggcagcgtcatctacgccaccgacacccgcagacgaggtgaatgacgcagcttgctggtttgtaaaagtcacaaaaataaccggctgaaagctctgccggttattttaacaacatgttgttatcgttaccgattaatggacctcgccattctctgtatggtgtgccgctcgccacggatcgccttgctgactgcgtataagttatcgacaggtgattcgaatccccatgcagaatcgcccacatgctgcatatcaacgccacagattttatttcgaatcgccatctcctgcaacacatgactgccgctgccttcttgactcgtgccaatcgcactcatcaccaaaccacccaaacgatgaacaactttcacaaccgccttcaagtcagcttcatcaaatcccggaattgatccaaccgccggcaccaaaatcacatctgcacctgcttcaataaactttttcgccgtctcttccgtcatgagcggttcgtcaacaccagaagcatgcattttccctgcaataattaggccggtaaaatacttcttggctaacgcaatactgcgaatggtcgcttcatttgtaacgccagtacccggattaccggtcagcaccatgaactgaaaacccatttcttcggcttttttgatgaccgcctcactggcagtgcatcctggcaaaatggcaatttgattttccatcattttgggattgtcgccaatcggttcaatattaattccaattggtcggccaaccagttttcgcagtctcgtgatactctctttgccgtcatgcttaggcgcgctgtataaatctctttcaccaggatataggccaaaaattttgggatcatcaacatcaaggcgattgcaaagaatcatatcagcgccaaatgctgcagcaatttcggctgtggtaatactgtccaaattctcttgcgtcacgatattttcgctaacgataatccgcccttcgctagccttgatgctttccttaagctgctgcccatcaaacgtcatgacctcgcttgtactggcacttagtagtcgtttcaccattttgttcattgcctcctattggttgtcttttaattaatagtagcaccttgcttattgaatcatgctacttctgctgctgcctcaatttcgtcctcatcaaacattgattcatcaacaccccagaaccaattaagaacaaataaaactgctgttgttatcaataaccctatgaccgccaaaatgaaattattgccgcctgcaggattgataaactgcggcaagctcaggattgaaaccgttacgagtgagaataccttgacatgaaaaagtccgaagaacagaccaccaatgccggaagcaataatggatgggatgatcggtttcttcatttttagcatcaatccgtaaactgcaggctcggttatgcctgaggccgcaacagagaatgcggccgtggcggaaaacgtcttgacactgcgcttcttccctttaacaagaatagctaaggccatccccaattcggcaaaattccaaaccgcaaatgcgacccagagaaatggatcatagcccagccgtttaagattagaaatcgcaactgggaaaaagacccagtggctgcctgtgataatgaagaatccaatcaacagactaagcagcgtaataccaacaacgggcgcttcgtcatatacccaaagtgatccattagcaatgacactggctattccttgcccgattggtcccgtaactagcagtgttaatggtgccatcactaggaataccgggaacatcttgagtaatccaaacttattcattgcgggacgatcaacgactttttccagtagtgattgaacccaaacggtgatcaaaatcggaatcaaactggttgaatagtcaaccgctgctactggaagtccaaacaaatgaatgccgcctccagtactcaccatcttggcaaaatctggttgcatcatgatgcctgccagaatgagacttagaatcgtatctgttttgaaataccgtgatgcgccaaatgctaccaagaagggtaagaagtagaaaagtgaattacccatcaaataaagtaaccggtaagtctgacttccttgggtcacaagatgactcacagtcagcaaattcagcagtgcgagaaataaccccgccatggctaatccaccaatgaccggcgtcaacgagttagagattgcatcaagaatgccattcagcaatcgtttgaaggtgattttttcgcgcttcttattaactttttcagtcgttgcgttagccttcgatacaccactttcaccaacaaactgagcattaatatagtcaaagactttgtctaagtattctggcataacgatttgcaacttgccatcagaagaaaaggctttgacaaccccatcaattttattgattttatccgtcgtcacttttgaatcatctttaatgcgcacgcgcagtcgtgtatagcaacgtgcaacactttcgacgttatctagatggcccatactttcaatgagctgattaccaattttttcatatttttccatcattaagtctccctaccccatgtgcaatgctttctcaaccttcttcaaaaacatgatcatttgtagttcagttctccaatcatttctttagcagttacatttttagcggaaatttctggaaaagacttcaataaagccatatttgtgtagacaacggcaatcgtggtgtcgtgatctgagtcagcaaccaactttaaattcatattggccagtaagtctccggcctttactttttgattcctcgataccctgacatcaaatggcctgccatccatctcaaccgtatcgaatcccatgtgaacaagcacttcaagcccttgaacagtcttaattgaaatagcatgcttggtaggaaaaatcatggtgatattaccatctactggcgcatagatttcaccattcttgggctttattgcaaagccatcacccatcattttttgagccagaacaggatcagacacctcggttaaaggaatcaacaccccagtaaccgctgcatacacgtcctcttttttcttcttacctaatccgaacataacatacgctacttaactgtctgtccacacaacgaactgtagagaccgagccaacaagtactgataatttatgaacaaatgccattaaaaaaacacccatgataaatgatgaaattaggggtctacactttctggtgttgagaaataatcaacactgaacgtgtaggccctttttggataacgcaaaaagacaccagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattataaactggggcaaaactttttctcattttctttcctccaaatggtataatttatttgtggtaatgaagcatttccctgtccgccccaacggataggaaattttaaatactgccatagaattctttgatggcattaattgcatcgtctttcgtttaaattatggcggactttttgcttgccagagaagtaaattccgagcaatgcctcgtgaaattttcgtaaactttcattttaaaatggaagttgtccgggcaagcctcgaatcattgagccacaaggggtaaaaacaattagtaatttcaaaaagttattacgtattgttttggcagtaatgagataaaagacaggttaattactacttgttgtatttctaaggtcaattatcttttgatatttatctcgaagtacttgcctgatttcctttgttaagggctgttttgtggagattcgaagatacaaatcaactagcatatcagcagcgggaagctcggtttgaatatcggatagtcggcacatctgaagttgcgtgaaaaattcagatgtatattggtaatcaattgactcgtattgattaccatttttcttatttgtcgccgttcgtagtatcttttcggcacgcaacaagatgaagtttgagacgatggtattccctctagttgttgaggaatgatcatcaaaaataaattcggatccatctttagtctttatatgcttaagcattttcttcctccagcatttccataaagagtgtttcggtaagaatcgtgatgtcttgtcctgcgttcatcaactcgttagctcgtttcatttttccggtgatgccgtttttgacatttgtggagtaacttatatcccctataaccaaataatctgtttttttgtttattccattttgggcagcaccgccaatgttaacaacgagctgagcggcgtcttttctggggatagataaagcaccggtaaagcagatgcttttttgatagaacgcactgtcttgattgattgacgaagaggtgctgatcaaggttcttaaatcgaattttgatttttgtttggcacgttttgattgtttaaaaaaattctcgtcaatccggatactgagctcatctagaatggatttttggtcatagcagtccgctaatgctctgtgtcgctgttgatgtgtgattcctagacgaggcatcacatcaaccacccgattatgacgttcacccttgaaaaaacgccttgctattcgccaaacgtcaacataatcattattaaaatcgcctagattaaattgttggtaagagtcaaaaataaaattaatatcgaagttaacattataaccaactatcagagattcttcgacaaatgctttgaactcagaagtagcctgttttggagagataccttttgatctgatcattgtggtggttattccagtcaactctgttatgaaggacgggacaatatcattttctgagtattttatcaatcgtgagaattcatttatgactttgccgcttttcactttaattgcagaaatctcaaggattctatcccagtctggacttaacccagtggtttcagtatcaatcatgatataggtgtctggaataacgagcagacttcttcctttgtttcgtgtaaccattacttacacctccaaaataaaaacacattagtagaaccaaaatttttgcgtcaaactgtgtcggtagtcgactagaagcactgattaaattaaccatataactagcagcgagtgtaagcacgaacgaagaaaccgttttcatatataatattcaaaattcatttgtttggcaaatcaaacgtttgtcagtttactctgtaggataaatttcatataaaacggtgctacaaatgtgaagattgatgaatgtgctcatttttgaaaattggggaacaattactcgaaaattgctcatcacataacatgctgacacaaatctaatcctcgccatcattgaattaatacacgaaatgagccactttccctcgcatgaaaattccattagaaacaacccgaaactcgctttcaaaaaaggctgcaagaggggaccaggttttagtaaaatccgaataatcttcacatcaataaaatagatgttccaaatttgccgaatatgtgattgtttctggacgattagggccgcagacttgcgataaagcggaacccctgctacaattggtcttgttggtaaaggaaaacagcatttgttgggttcctaatttttttcagcttgctgggtcggcgaacgactcggagggacgtgaaatgacccattaaagaaggacgtgccttatgcatactgaacttgcgtggctcaaagcgatcgcgcctgatctgatgggcgttgtcactaaacgctatcaggtccttcaatttattaactggatggcaccagttggccggcgaacgttggccgaacagatgaagatctcagaacgtgctttgcgcacagaaacggattttctgcgtagtcagggtttgttggaaagctcaaaatctggcatggtgctaacagcaaaagggttagagacatttcatggccttgatcatcttatgaatcggctgttaggaattaaggatgatgaaaaacgacttgctgcccaacttcaaatcgatcattgtttggtcgtatctggcgatgccgatcaaagtggtcgggtgcttgatgagctggggaagacgttgaattcgaccttacaattactgctgccgccgggtcgcttgacggttgccgtgatgggtggaacgacaatggcacatcttgcaaggcagctgacatttcagttgtctgcagggcgtgaattgacgtttgtccctgctcgcggtggcttaggcgaagcggtgacgattcaggccaactcgattgctgctgcgatggcggaagcaaccgacagcaactaccgagcgttgtatgtaccggaaaatcttagctcggaatcctacgaatcattgattaaagagccttctgttaaagaggttttagggctgattgataaggctcaggtcgtgattcatagtgtgggtgacgctttagtcatggctcgtcgccgtggcatgtcatctgacacgatcagcatgttgaaagccaaacatgccgttgccgaagcatttggtgttttctacgatgcgagcggcaaggtcgtttacaagataccgcagattggtttacagctcgcggatcttgatcatataccgtatgtattcgctgttgctgctggcaaaagtaagtccaaagcaattgcggcatatatgcaacacgcaccgagtcggacgtggctgttaacagacgtcggtgcaacaaattcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcaattaacgatctgaccagcccaaccatgctggctcacttgctgaagtatgattcaacccacggtactttccctggtgaagttagtgcaaccgataacggtatcgtcgttgacggtaaagaataccgtgtctacgcagaaccgcaagcccagaatattccttgggttaagaacgatggcgttgactatgttcttgaatgcacaggcttctacacctctgctgaaaagtcacaagctcatttggacgcaggcgcaaagcgtgttctgatttctgccccagccggcaagatgaagaccatcgtttacaacgtcaacgatgacactctgaatgcagacgacaagattgtttctgctggttcttgcacaaccaactgcttggcaccaatggcttacttcctgaacaaggaattcggcatcgaagttggtaccatgaccaccgttcatgcttacacctcaactcagatgttgcttgacggcccagttcgcggtggcaacctgcgcgctgcacgttccgctgctgctaacacgattcctcacagcacaggtgctgctaaggctatcggtttggttatcccagaattgaacggcaaattgcagggtcacgcacagcgtgtttctgttgttgacggttctttgaccgaattggtttccatcttgaagaccaagaacgttactgcggaccaagttaacgaagctatcaagaagcacaccgaaaacaaccctagctttggctggaacgaagacgaaatcgtatcttccgatgttatcggtacgacacaaggttcaatctttgatcctacacagaccgaagttacaactgctggtgactatcaattagttaagacggttgcttggtacgataacgaatatggctttacttgccagatgatccgtaccttgctgaaatttgctactctctaatccggagtaacgcttttctagccgcaacatccgaagcggagggagcttactccctccgctttttttggaaataggcgatcaattctcaggatgttttagcatcctgctgaaaacgagcgctatttctggtgttaagcggtcgttacttgaagttaagtcatctttaggaaaaataggaggtcatttctcttggctaaattaattgtttcagacttagatgttaaggacaaaaaagtcctgatccgcgttgacttcaacgtgccgatcaaagatggtgttatcggtgatgataaccggatcgtggcagcattgccaaccatccagtatgttattgatcatggtggcaaggcaatcctcttgtcacatctcggccgtgtcaagaccgaagaagacaaggctaagctgaccttgaagccagttgcagaacgtttgagtgaattgctgaagaagccagtgacatttgtcccggcaactcgcggcaaggaacttgaagatgctatcaacaagatgaatgatggcgacgttcttgttatggaaaacacccggtttgaagatcttgatggcaagaaagaatccggcaacgatcctgaacttggcaagtactgggcaagtcttggcgacttattcgttaacgatgcctttgggactgcacaccgcagccatgcttcaaacgtcggcattgcttccaacatgaagcaaactgctgccggcttcttgatggaaaaggaaatcaagttcttaggcgatgccgttgacaacccgaaacacccattcattgctatcttgggtggtgcaaaggtttccgataagatcggcgtgatcgaaaacttggtacctaaggctgataagattcttatcggcggcggcatgacctatactttctatgctgctaagggtatgagcatcggtaagtctttggttgaaaaagacaagatcgaacttgccaagaagatcatggatcaggctggcgacaagctgcttttgccggttgattccgttgttgcaactgaattctctaacgatgccccacataaagttgttgacggcgacattcctgatggctatatggccttggatatcggaccgaagacaatcaaagaattcaaagatgctttgcaaggtgccaagaccgttgtttggaatggcccaatgggtgtcttcgaaatgagcaactatgctgaagggacccttgaagtcggccgtgcccttggcgacttgaaggatgctactacaattatcggcggcggcgattcaacagctgctgctaagcaattgggtattgcacctaagattacccatatttccactggcggtggcgctagccttgaatatcttgaaggcaagaccttgccaggtatcgcagctatttctgacaagtaattgtcaggcatgctgatctaacagtcactaccggcagacggtgtctgtcggtacatatgaaaggaagatatgccatgcgtacaccattcattgctggtaactggaaaatgaacaaaaatcctaaggaaacgcaagaattcttagacggcgttaaaggcaagttgcctgatgcaagcaaggttgagactgtcattggtgcacctgccattgatttgaccaccttagttgctggcgctgaaggcacacctttgaagacggcggctgaaaactgttactttgaagacgaaggtgccttcactggtgaaaccagcccgaaagctttgaaagaaatgaacgttgattacgtcattatcggtcacagcgaacgtcgcggctatttccacgaaaccgatgaagatatcaataagaaggctaaggccatctttaagaacaatcttttgccaatcatttgctgtggcgaaagtttggctcagcgcgaagctggccaaaccgaagactgggttgcttcacagattgaagctgctttggccggtttaagtgctgaccaagtcaaagtttcagtcttagcctatgaaccaatctgggctatcgggacaggtaagacggcaactgccgatcaggcacaagaagttgtcgcacatattcgtgcaacggttgagaagttgtataataaagatacggcagatgctgttcgtattctttacggcggctctgttaaaccagcgaacgtcaaggaattaatggctaagcctgatatcgatggcggcttagtcggtggcgcttcgatggatcctgaaagtttcatcgccttggctaactaccaagattaatctgggttctactattaaacagccttctggcaaaaaggagaagaatttatgtctatcattactgatgtattggcacgcgaagtcttagactcccgtggcaaccctactgttgaagttgaattgtacactgaagacggcggctttggccgtgcgttggtaccatcaggtgcttcaaccggtgaacacgaagccgttgaacttcgtgatggtgacaaggatcgttttggcggcaagggtgttttgaaggccgttggtcatgtgaacaacgaaatcgctaaggcggttattggccttgacgtgactgaacaacgcctgattgaccaaaccatgattgaccttgacggtaccccgaacaagggcaagtttggcgccaatgctatcttgggtgtttccttggctgcagcccgtgctgctgctgatgaagttggcctgccattgtatcaatatcttggcggcccgaatgcccacgttctgccaacgccaatgatgaacgtcctcaatggtggtgcacactcaaccaataccgttgacttccaggaattcatgatcatgcctgttggcgctaagagcgttcgtgaagctgttcggatgggttcagaaaccttccatgctttacaggcactgttgaagagtaaaggcgacatcaccgctgttggtgatgaaggcggctttgccccgaacttgaaggataacgaagaagccttcgaacttcttgttgaagcaatcaagaaggctggctacaagccaggcgacgacattgctttggcctttgacgttgctgcttcagaaatgtacgatgccgagagcaagacatacacaaccaagtggtctaaccctgacaagaagtacaccactgaagaatggaccgacatgattgatggttacatcaacaagtacccaatcgtttctgttgaagatcctatcgacgaaaacgactgggaaggctggcagacattcaccaagaagatgggcgacaaagtccaaatcgttggtgatgatctgtttgttaccaacaccgactacctgaagaagggtatcgatatgggtgttgctaactccatcctgatcaagctgaaccagatcggtacattgaccgaaaccttcgaagccatcgaaatggctaaagaagctggttacacagctgttgtttcacatcgttccggtgaaactgaagatacaacgattgctgacttggttgttgcaaccaacgctggccagatcaagactggttcaatgagccggacagatcgtatcgctaagtacaaccagttaatgcggatcgaagaccaattgggtgcacaatcccagtacaagggccgcaagtccttctacaatgtgaaagcaatcgactaattcgcttaattagttggcagcttggaaagcacgtttccgttaaggagcgtgctttttttgtggagcgtgagctggcgcggttagaaaccagagtgtgtaagttcaagatccttacatgcaggtttccgcgccagcgagcgcgtttaattgtgcgcgaacaggagcgcttagaagccggaacataagtggcttcgaccaaatggcgtggttttagcgaggtctcttgggttgaaagaatcaggattttttaatcggtgagactgaatcgcggttgtcgggtgcacctttctgtatactagggataagcacaaatgaaaggacggttttctatgcaaacgacgccacctcattggcaacgaaacattggtatctttttgcttggtcaatttctttctggcattaccagtatgacggttcagtatgcgatcatttggtacttaactgctaaaactggttctgcaacgattctcagcattgctactttattaggtatgttgccgacgattctgctgagtccttttgtcgggccttatattgatcgcttgaacaagaaaatgttgttgattgtaccggatattgtcgccgctatggtggcacttattttgagtgccgttggcgagttcggtggcttttttcctgtttggctgatctttgtgtcgttgctggtgcgggcgttggcacaaacattccagatgccgacgattcaggctattttgccaaccatggtacctggtgatcagttgacgcgcgtgaacggtcaactcggtgtggtgaattcggcgaacatgattattgcgccggcactgggagctgtcctttttggcctgatgccgatgccgcttttgattttgttagatgttttaggtgcgattctaggagtcagcttgttgttgttcgttagtattccagaaaatcgcttggtcgggacaaccgtccatgttgcgcaggatgccaaggtcgggtggcaattgttgcgaggcaatcgtggcctgtggtatatgactttaattggcatgttgacgacgtttgccttcatgccagccgctagtatgtatcctttaatgaccatgcgttattttcatggtactgtcggccaagctggattgattgaagttgtttattttgctgggtcgctacttggtggattgctcattagcgtctttggccattttcgtgatcgtattgatccgattgtctgggggatggtggtcattggcgtgacgtttggattaagtggtgttttgccacgaactgaaaatggctttttatggtttcttatcttgaatggcgttgctggcttagcttggccgtttttcaacacgcctttgatcgcgatgtatcagcaaagttatgcccctgagacgctcgggcgggttatggggattttgaatgcgctaatgagtctgccagggccggtcggcttgatctttgctggtcccatcgccgatcgctttggtgtcgcaactttatttgtagttgcagggatcggcgtgttactggccgctggcgttatgttcggcttgaagatcacccgcgaatatgaccgtcagttgcaagcagacgggtcatcagatttgactaaaaggggatagatcgtttgaaaaaatttttcaccgtgtttgcttggctagaagttgttttaggattgacgatgttatggatgacgtgggatgtcggcttgcgagcatctggccagatttttggcgccttagttgttttaatcgggattgtgcttttatacgggttgatcatttatgcgttgattggctggttcatggatcctacgcaccgttactggtatgtgctgacactggtgctaactttgctgtacaacgtgttagcctggacctttcccagcgtcatgatccaaacatgggccacatatccatttccgcttatcactttgttaatcggtgtaatgttggtttgggtggctcggcaagaaaaacaataattggttttgctgactcgggtgactgagtcgtttttgattcccagccagaggtatatactgagatcatgttgtactggaggggaattacttggcacgacctgtaaaagaaaaatttgacgttactcgcctgcgatttgtgctactcggactactcgttggtttaatgagcggcactgttgtcagcgcgtttcgctattgtattgaggtagggctgcgctatagtcggctggtatatgggcacttgcgaatagcaccgtttgtctggtggcaatgggcgttgttgatcggtgtcaatcttggtttggcgtttatcgtggcgtggcttctcaagaaagagccctatatttctggctctgggattccgcaagttgaaggccaattggctggtgaattggaaatgcactggtggtcgatcctctggcgaaaatttgtcggcggtgttctggcgctggggcctgggttgtttctcggacgggaaggaccgtcgattcagttaggcgcttcagtcgggcaaggtttagctgctgggttcaagctatcaggaactgatcggcgattgttaattgcatccggttccgctgctggcttggcggcggcgtttaatgcacccattgctgggacattgtttgtcttagaagaggtttatcataatttctcaccgcttgtttggttaacggcattggctggggcaattggatcggattttgtttcactgaatgttttcggacttgttccggtgctgcatttaagctattcgcgtagtttacctgtatcaagttattggcatttaattttgctaggcattcttttgggcttgtttgggtacttataccagcgaatcttgttggtgatgccgcggtggtatcgcaacttgacacatttaccgcggccattacaaggcattgtaccgtttctgctggtgattctggttggctattttgcaccaaacttacttggtggtggcaatggtttgattgtcggttttggccagtatgtgccatctttgcttgtattgatcgcaatttttattgtacgtttcgttttttcaatgatttcatatggttctggattaccaggtggcatttttctgccgattctttctttgggtgccgtgattggtgccatttatggcgtcttcatgaatcaactcggcttattgccgcacgtctatatcatgaacttaatcattttttcaatggccggttactttgctggcattgggaaagcaccgtttactgcgattctattggtaacggagatggttggtaatttgactcatttgatgccgttagcggtcctatcgttaactgcttatctcgtggttgatttgcttggcggtgcaccgatctatgaagcgttactcgagcaaatgacaatgccgaaaacagttcaacagcttcatcgacccgaccgactggaaataccggttttcttcggcagtcccttgaatggcaaaatggtccgcgatatgccatggcctaaagaagcattactaatcggaatccggcgtggcgaacaggaagtgattccacatggtgattccttgatccgtgaaggtgatacgttggtgctgttaacggatgcgacccaacgtgctcgggtcaagcggcggattgatgcgctatcggcggcgttagggaaaacgcaccaaaactcatgagcaagttatctgtcaggacgttgacgtgctattattgtgagttattttacttgctgtgagacggttcaagtagctaaaaaggtggatttcagcaaagaggcctcttttaggtagaatgcgttcgcctttatgttgcttttatgctaaactactagggtgagatttttcgcaagggaggcaacaacttgcaaagtttattgaccacatttcttgtgatcgattcgattttgatcgtgatcgcaacattaatgcaaccaagcaaacaacaagatgcgttaagcgcattgtccggtggggcaacagatcttttcgggaagacgaaatcccgcggcttcgaagctttcatggagaaagtcaccgttgtactaggtgttattttcttcggcctcgcaatcgcgctggtatatctggaagcccattaacgaaagtctcctggtactcaggagactttttttgcagagcgttcattggctcggtttctgggccagtgaacgcgtttcgacagcaactgcggtggaatagctaaccatatgacaaggctgactttattcgccaatagacaagacctacaaccgtttttccaccgcaatatcgaaccttttcaccaagagattgaatttccacttgtccacccagccacgcttgccacaaaggatgaaacccatcatgatctttcgtgaaccgcaaccattcgaatacgagggtactgataccggtgttgttttgctgcatgcctatactggcagcccaaacgacatgaacttcatggggcgggccttgcagcgggctgggtatggcgtgtatgcgccgttgttcacgggacatggtaccattgagccaatggatattctgactaagggcaacccagatatttggtgggcagaggccagcgcggcggtttcgcatatgacagcaaagtatgaccgtgtttttgtttttggattatcactcggcggtattttcgccatgaaagctttggaaatattacccggtgtcacagctggcggcgttttttcatcggcgatcttaccgggcaagcatcatctcgtgccagggtttctgagatacgcacaatatatgaatcgtttggcaggtgtaccggacgaaagtactcagattttggcttacttaccaggccagctggcggcgattgacaatttcgccactggggttgccgccgatctgtatttagttaataagccgatctttatcggccaagccggtgctgatgaattagttgatgggcagctggcctatcagctgcgggatgcactcatcaatgcaccgcaagtagatttccattggtatgacaatgccaaacatgtgatcaccgtgaattcggcgcatcacgcactacaacaagacgttatcgcatttatgcaacaagaaaacgagggatagcatgaccacagttggccatattcgtaatgaacttttagcaacatttcgtaaaaatccgaagattgattattcggtccagacgctgagtcgtgccttgaaattaaacgaaggcactgattttaaaacgctggttcaagccttaactggtatggaaaatgacaatttaatccatcccattagtgaaggccgttatgcttggggcggcacgcctaaagtgttgacaggtattttccatggcaatgaaaaagggtttggtttcgttgcgattgaagatcaggacaatgatgtttatgtgccgtcaacgagcactgattttgctttggacggtgataccgttgaagtccgtatcgtccgtgaagtacgcccaaacgatacgcgtggaccagaaggcgaaatcactaaggttgttgaacgcagcctaacgacacttgtaggcgaattcaaaccattttccgacaaagatcgggccaagtctggttttattggtatggttgtcagccacgagaagaaactgaagaattttccggtttatgtcaaagacactggtaccatgccgcaattaggcgacatgacggttaccgagattacggaatttcctaatgaacaccatccgaagctgatgtatggcatggtggttgaaacattgggaaataagaatgatcccggtgtggatattatgtcattagtgatgcaaaaccatatcaagactgagtttcctgatgaggtaatgactcaaactaatgatatcccggatcatgtcaccccagaagaacgggtgaaccgtaaagatatcaccgatcaagccgttgtgacgattgacggcgacgacagtaaagacttcgatgatgccgttgtcgtttggaaattgccaaacggaaacttccatcttggtgtgcatattgcagacgtgtcgcactatgttacagaaggctcagcgttggacaaagaagcgtttgatcgcgggactagtacgtatctggtcgaccgtgtcattccgatgctgccattccggctgtctaatggcatttgttcgttgaatcctggcgttgatcgcttggcgatgtcttgtgatatggaaattgatcaagatggtcacgtggttaatcacgagatttatcaaagcatcatcaagagccatgcgcggatgacttataacaacgtcaacaagattgtgaccgaccatgacccagaagtgatggccgagtatcaggaacttgtgccaatgtttgaagacatggttcaactgcatcaaattctgtacaagatgcggcatgctcgaggtgccattgacttcgaagaaaacgaagccaagatcattgttgatgatatgggtcacccaacagacattgttctgcgtgagcgtggtgtgtcagaacgaatgattgaatccttcatgctggccgctaacgaaaccgtcgctgaacattacaacaagcaacatttaccattcttataccgggttcacgaaacaccagatgccgaccgcattaaagaattcatggaattcattgctagttttggtatcaccgtgccgatgaaaaaaggcaaagaaatcaccccaaagcaacttcaggatgttgtgacagatgtcaccggcacgcctgaagaagcaatggtgagcgttaaaatgctgcggagtttaaaacaggctcggtattcaccagatccacttggacattttggcttggcagcaaagtattactgccactttaccagtccaattcggcgttatcctgacttggtcgctcatcgcttgattcgtgattatgcggttgaaggcactggcgacgatatcaaggcaagctggaataagaaattaccagatattgcagctcaggcatccatggcggaacggcggagcattgacgctgagcgtgcagttgacgatcttaagaaagctgaatttatggctgataaggtcggcgaagaatttgatgctgttgttagcggcgtgacgagctttgggatgtttgtggctttgccgaacaccgtagaagggcttgttcatatcacgcggatgaccgatgattattattcattcatcgatagtcagatggctttagttggcgaacgcaccaagcgcacgtaccgaattggccagtctttgcgagttaaacttgataatgttgatattgatcaacgacaggtagacttttcattgattcctgatgaaaatacgccaacaagtgatctgggcaagttcgtcaaaaaagaagaccggcgtgaacgtcggccaaatggcaacaagcctggttttggcaataataaccatggtgggccaaatcgtaatcaacacaacaatcgaccacgcaaaccagctggtgcgccacatcaaggcaagcactataatgccaagcgcggcactaaataacgctgggaacttttgaaagggggatggttcaatggcgaagaaacatcgacaaaaacctgacaacctgctcgcccagaataaaaaggccggtcatgattacaacattcttgatacctacgaagccggtattgcgctgacaggtaccgaaatcaaatccgtgcgtgatggcaaacttaatttacgtgacggttttgcccgaattcggaataatgaggcgtggttagaaaacgtccacattagtccgtataaagagggcaatttattcaacgttgacccaatgcgtaatcgcaagctgctcttgcacaaacgagaaattcgcaagttaggtcaaatgacagcgcgccaaggtgtcacgcttgtgccgttgcggatgtatctaaaacacggctatgccaaggttctgattgctgtggctgaagggaagcataactacgacaaacgtgaaaccttaaagcgcaaggatcaggaacgcgaggttcagcgcgctttgaaggcacggtattaaacgcccagtggcattaagctaatgctgatctgagcatcaaaaatcgatcttctagcttgtccatcagcaatatcatgatgtcgctgatgtgcaggttaggtgacgttatgccaactgagttttatcagtaaagagcatcgggagaaacctgatgctctttttattttgcttatttatttatataaaatggcgatttttccttctaaggttttacttaagtaagaactaatataaaatagggcaaggagactgtcgttggtcaatgcctttgtcgacgaacttcagttgaggagggaggatagcatttgtggtcacactgtctgatgtcgcgaaagaagccaatgtttcaaaaatgaccgtgtcccgtgtcatcaatcatcctgagcaagtgacgcctgagttaaaacaactcgtcgaacaagcaatggcgattttgcattatcgacctaactctgcagcgaaggctttggccaataatcggactaacgttatcaagtttttgattcttgaagatgtggatacgaccgaaccttattacatgacgttgctattcggcattgcccgaggacttgatcgtcagcagtatgctttgcaattagtgacagattgcgagcatcttgatttggatcacgccgatgggtacattattacgggtgcgcggtcgactgattgtcaatggattgatcagttagcgaaaccggttgttttatttggggaaaatcggcatggttatgattttattgatacggacaataaattaggcgaacaacaagcaaccgaatatgcgctggccaagaattatcaatcgattatttttcttggtattgatgtgagagaaccgtttgaatattcgcgtgaagcagggtatatcaatactttgcagagacatcaaaaagtaccgcagattcatcgaatgggtaatcatagtcacgaatcgcaacattttatcagtgaaaattggcgaaagttcgcgcgaaatactgttttcatctgtgcaagtgatcgcctcgcgttaggtgcggtcagagcgattcaacaaaatggtgggcgaattccaaccgactttggcgtcatcggatttgatggcgtttttctggatcaagtttcaaatccaaaattaaccaccgtgaaacaaccggtggtgcaacttggtgaactattagcacggatgctcttgcaaaaaatcgcccagtcaggcgcacaacaaggtgaactactggtgccgccaaaattagtgcttcgcgggacgatacgcacttaggtgattatagaattccgatctggcaaaatgagtttgtctactgataggtcggggtaacattcacagttatcaaacaggccaacaattttccgctgggaaattgttggcttttcttcacttcattttgataacggtaacaaacgcagttaacttgtatcatgcgtgcgctttcactatgctagttggaaaagggggcgggtcacatgagcacttggtatgatcaggcgattatttatcaaatttatccgaagtcatttcaggacagtgatggcgacggtattggggatcttaacggcattcggcaacgcataccgtatctgcaggacttaggcatcaacgccgtttggctgaatcctgtgtttgtatcaccgcaagtcgataatgggtatgatgtcgccaactattacgcgattgatgagcgaatgggaacgatggccgatatgcaggctttgattcatgaacttcatgaagcgggtatccgtatcatcttggattttgttttgaaccacacatcggatcagcacccgtggtttcaagatgcaagccggaatgtaaaaagtatttatcgtgattattatattttttctggacatcatcataaaagaccaaataattggggaagcttcttcggcggctcggtttggtcgcctgatccagccggtaccggtcaatcctatttccatttatttgatcagcacatgccggatttgaattgggccaatgccgaggttcggcgtgcaatgggggatgttgctgaattttggctaaacaagggaattgatgggttgcggcttgacgcgtttattcatattgccaaagttgatctggcgcaaaactatccaacgtcggaaagccaacaagagcctgtgattgcagaaccgttttttgctaatctgcccaatgttcagcggtggttgcggcccttctgtgctcagatcaaggcagattttccaaatacctttatacttggggaagcggcaagtgcaaatgtcaatcttgctgttgactacacgagccagcataacaaattgatggatagtgtgattactttccgatattttaccgaagatacgacgcaacttgacaccagcatcccagcgcagtatcagccgaaacctttggattttgcaaagtttaaacagacacaggttgtttggcagcaaacacttgctggtgtgtcgttgccgacgctttattggggcaatcatgatatggctcgtctggctacgcgcgttgcccattcagcgattcaggcgagaagtctggcagtgctgatgtatttacaacgcggtattccaatcatctattatggtgaagagctagggcttgaaaatctcacgttgcctgatgcgaaagctttttccgatccaagcgtcccgcgtttcattgcagcagctgtggatgcagggtattcccaggaggcggcgttagcgatggtcaatgcgacccataagttgccagcgagagggccgatgacgtggaatgcgacaaccaataatggctttacgagcggcacgccttggttggttggcaagcgcagcagccgcacgcatgttgccgaacaacaacatgatccgcacagcagccttgcattttacaagcaattgattgctttaaagaaacggtcggtctttcaaacaggcagttttcgactgttgagtacggggccagacagctatgtgtatcttcgccagacagacaaggcgattgccgttgtggcggttgctttgagtgataaaacagtcaaccttagattgccagccggtgactatcaagcggtgctaatcgtcggtgacgcgacactgagcgaagaaacactgacactatcagccgattcagcagcagtattcattcaggaaaaggagcgtgctaagccatgaatttagcagctatgtctcatcgaccagaaagtgaagattgtttcttatataccaataaaaagctacgtttgcggttccatacggcacaaaacgatgtcgccaaggtggttgttttgtatggtgatccttactggcaagagcttgatcagcagcaacaatatcggttgagttatcagcgcaaaccgatgagtcagctagggacaggtcaagttgctgatcattggggagtgaccttggaggcgccttatcaacgtctgcagtacctgtttgaagtgaccggacaggacggtagcaaatggttatttggtgatcggggattgcgaaaagacacagagtccgcgcgaattgataccggcaattattttcgtgtgccgtattttcacgagattgatcgggtgaaaacgcctgattgggtgaaagaaaccgtttggtaccaaattttcccggaaagatttgccaacggtgatagcacaaatgatcctgttggcacgaaaccttggcgaccgtctgatcatcctggacgtgatgattactatggtggtgatttacagggggtcttggatcacttagatgatttgcaagcattgggtgtcaatggtctgtacttttgtcctatctttaccgcgagttcaaaccataaatatgacaccattgattatttaacgattgatccggatttcggtgataagacactgtttgccaagttggttaatgaagcccataaacgcgggatgcgcgtcatgctggatgccgtgtttaaccacatgggctttgctagcatgcagtggcaggatgtcttagcaaatggcaaaaaatcacgctttgcttcgtggttccacattcatgattatccattgacgtcatttcataatcccctgaaaggcgagggagcgccacaatacgatacatttgcgtttgagtcgcgaatgccaaagttagatacggccaatccagcggttcaggattatctactgcaagtggcaacttattggattcaagcatttgatattgatgcctggcgtttagatgtggcgaacgaagttgatcatcatttttggaaaagattttacagcgctgtcaccgccattaaaccggatttttatattttgggcgaggtttggcatagcagtcaaccttggttaaatggcgatgaattttccggtgtaatgaattatgccttcacgcagcaaatagaggaccactttttgaccggtaagcagacagctgcggggatgaccgctttgttaacggaccaattgatgctttaccgcgatcagacaaatcaagtgatgttaaatatgttagattcgcacgatacaccgcggttgttaacggtagcaggtgatgacattgatctagcgttgcaagcattgacctttgcttttcttcagacaggtacgccatgtctttattatggaactgagatgggcatggatggggaaaatgatcctgatgatcgaaaaccaatggattggacaaaattaggtcagccaatttggcaacgggtggcgaagctcatcggctttcggcgtgaacatgcggctacccttgggcgtggtacgaccaaattagaagtgacaccttctggattaattaaagttgtgcgccacggccgtgaaacgctgacggcatatttcaataccacagcgtcatcggttcctttgacggcggcacctgttttgcatcaagggtttgctcaaaatgagttagctccaaaaggatttgttgtagcaataaactaattatgatagcggtaacattcattttgcgattgtatagcgctttcattcatttataataaagagtttcctttaagtggttgttgccatgactatcgtaaagaaaatggtcacaggggagaagtagagaagatgaaaagaacatttgcagtcgatccgtggatgattgcaacccatcagtttcatccagaggacaagcggcttcaagaaagtttgacggcaattggtaacggctacatgggcatgcgcgggaattttgaggaacagtactcgggggatcagctttcgggaacttatctcggtggtgtttggtttccggataaaacccgcgttggttggtggaaaaatggctatcctgcgtactttggcaaagcaatcaatgcacccagctttttgccaattcgcatcaaagtgaatgaacaaccggttgatttggccaaaaacagttttcgggatttctatttggcacttgatttacatcagggattgttaactcggcagtttatctatgaaggggatcaggttgaggttcggtttgagtttcaacgatttttgagcaatgtggtgaaggaagcagccttgattaacgtgaaagcaactgtgcttagcggtaaggcaacgatcacatttgatgctggacttgaaggtcgtgtcgctaatgaagatagcaactacgatgagcggttttgggaaccacaagctgaggatcccgctcaaaaaaccattcaattgcaaaccaaaccaaatccttacgatgtaccgcaattcaccgttctattgaagcaacagttgcgtgtcaatcatcaaccggtcacaggcgttgtcacgaccggcaacggctggctaaacgaacaaattgtggctgatgtgtcagctggcgaaacttatcaactggaaaaggatgtcattgtggttactagccgcgatattgcgccttctgatcagcagcaaacagccgcagctttgatgaccacattacaaacacacagtttttccgaacaactggctgcccatacgcagctttgggcgcaacgctgggagcaaagtgatgtggtcattgaaggcgatccggccgcacaacaaggcattcggtttaatattgcgcaattgtttatgacgtactatggcgaagataagcgccttaacattgggcctaagggttttacaggtgaaaaatacggcggtgccacttactgggatactgaagcctatattgtaccaatgtatctggcagtgacgccgccagatgtgacgcgagcacttcttcaatatcgccacgatcaattacctggtgcgtatcataatgcacagcagcaaggactggccggtgctttgttcccaatggtgacctttaatggcatcgagtgtcacaacgagtgggagatcacatttgaagaaatccatcgtaatggtgcagttgcgttcgcgatttatcaatacacgtcttataccggcgatgaaagttatgtcaaccgtgatggtattgaggtcttggtggggattgcccgtttctgggctgaccgggtgcattttagcaaacgtgccaatcagtatatgattcacggggtaaccggtcctaatgaatatgaaaacaatgttaacaacaactggtataccaacaccatggcatcgtggacgttaagttacacgttagcgcgcctgaccaaggcgaatgccgacgtggtcgctaaacttgcggtgactgcagaagaaaaagctaagtggcaagatattattgatcggatgtactatcccgttgacgatgaattagggatctttgttcaacacgatacctttcttgataaagatttgcgacccgccagttcgattcctgctgaccagcggccgattaaccaacattggtcatgggatcggatcttaaggtcgccttttatcaaacaggctgacgtcttgcagggcatttattttctcaatgaccgcttcacccaagcacaaaaagaacgcaattttgatttctatgagccgatgacggttcacgagagttcattaagtgcgtccatccatgccatcctagcagctgaattagggaaaacggaaaaggccgtggcgttatatgcgcgaactgcgcgtctagatctggacaattataataacgacactgatgacgggcttcacattacgtccatgagcggcagttggttatcaatcgtccaaggctttgcggggatgcgctatgatcacgaccggttacgattcaagccatttttgccaaaagaatggcaccgcttcagctttaaaatcaattatcgtggccgtttgctggcagtggacgtgagtgaagaggtcaacgtgatcttgttagccggcccgtcaattgatattgaagtgaatggtgagctgcagcacttggaaaagggggatgaccatgcttaaaggattcatttttgatcttgacggggtggtcaccgattcagctaagtatcatttagccgcctggggggagttggcaaaacaattagggattaccctgccagctacggcaaatgaggctttacgtggccgttcccgaatggactcgttagcgatcatactcggttacggtgatcaacagaagcaatataccgaagttgagaaagaaaacttagcagatgaaaaaaatcgacgttatcttcaattgattgccaatatgacgccagccgatattctgccgggtatcagtcaacttttatcggacgccaaggcaaggcatttaaaattggcaatcgcatctgcttcaaaaaatgcaccgactattttgcgtcaattgaagttatttgatcaatttgatgcgattgttgatccagctagtctgcatcgcgggaagccagatcctgaaattttcatcaaagcgcagaacttgttgcaattgcaagcagatgaagtggtgagttttgaagatgcatctgctggtattgcagcaattaatgctgctggtcagttttcggtgggtatcggtgatgccaaggcgctcgcagctgctgattatttcgtggcaaacacaggcttattgcgactcgaatcaatcacgacagccttcacaaaatggcaaaacgcgttgaataagaaaggagatgtatgatgtcatggttgagattgatttgaaccatctttataagaagtacccgaatgccgcacaatattctgtcaaagatttcgatctgcacattaagaataaggagttcattgtctttgtcgggccgtctggctgcggcaagtcaacaacgcttcgcatggtcgcgggccttgaggatatttccaaagggacgttaatgattgatcatcaggtaatgaacgatgtggcaccgaaagatcgcaacatcgccatggttttccaaaactatgccctttacccgcatatgacggttttcgacaacatggcgtttggtttaaagctgcggaagtatagcaaggatgcaatccaagaacgggtggcagctgcggccgatattcttggtctgacagagtttctggcccgtaaaccagcagacttgtctggcggtcagcggcaacgggtggcattggggcgagctattgtcagagatgcaccgatttttctaatggatgagccgctttccaatctggatgcgaaattacgtgtttccatgcgtgcggaaattgccaagttgcatcagcgccttgaaaccaccacgatttatgtgacccatgatcaaactgaagcgatgacgatggccgatcgagttgtggtgatgtctgttggccagattcagcaaatcgggacgcccgcggaaatctataaatatccgcgtaaccaatttgtggctggttttatcggttcgccagcgatgaatttctttgatgtgacgtatcgtgatggtgtcatcagcgatggcaagggtcttcgcctcagtgtacctgaagggcgtgcaaaagttctggaggatcaaggctataatggtaagcaactggtttttggcattcgtcccgaagacattcacagcgaagaagcctttttggaaacctggccggaagcggtgatcgcatcgcaagtggtggtttctgaacttctcggtgcgaccagtcagttatatcaaaaaattgatgaaaccgaatttgtcgccatcgtgaatgctcgagattttcacagcccaggagataccgtcaaaatgggatttgatttgaacaaagcgcatttttttgataaagagtcgacggatgctattcgggctgatgcagaccgcactgtcaaggtataaacgcctgaataaatgagggaggtaagtatgacacagtggtggcaacgcgccgtgatctatcaggtctatccgcagagttttcaggatagcaatggtgacggtattggcgatcttaaaggtctgattcagcgtttagactacctgcaaaaactcggcattgacgccatctggttgagtccagtgtatcagtcgcctggtcaagacaatggttatgacatctcagattatcaagccattaatccacaatttggcaccatggctgatttggaggcgttgattcgccaagcaaaagcacgcgatattcgcatcatcatggacttggtggtgaatcatacatcggacgaacatcggtggtttaaagtgtcgcgccagtcgcgcgctaatccatatcgtgactattacatatggcgcgatggttcggccacaggtggcccgcctaacgccatgaaatcaacattttccggttcggcatggcgtcgtgatgaagccaccggtcaatattatttacatctttttggtgataagcagccagacttaaactgggctaatcctcaagttagacaagccatctacaagatgatgaatttctggatcagcaagggtattggcggctttcgaatggatgttattgacttgattggcaaggagccggatcgcggcattcgagaaaatggtcctaagctgcatccataccttcaagaaatgaatcgcgcgacatttggcgatacggatttgctgacagttggcgagacctggggtgcaacccccagcatcgcccaacaatatgcagatcccaaaagacacgagttatcgatggttttccagtttgaaatgatgcaacttgatcagcaaaatgatgacaagtgggcattgagaccacttgacccagcggctttaaaacaggttttaatcaagtggcagacggcatttgattatacaaaagggtggaacagtcttttctggaataatcatgatttgccgcgaattgtgtcacgctggggtaacgatcaacgttatcgggttaaaagcgccaaaatgtttgccattttactgcatcttttgcgcggtacgccatatgtgtaccaaggtgaagaaatcggcatgaccaacgcacccgtggcaagcatagttgatgttcaagatattgaaagcgctaatatgtatcgtgaacagatggcactggggcaatcagaaaaaacgattttaaccgccattaatgcaaaaggtcgggataatgcccgcacgccgatgcagtggcgtgatgcccccaacgctggcttcacaacaagtcagccatggctgcgggtcaatccaaactaccacaccatcaatgtggcggcggccttagacgatcccgattcgattttttatacttaccagcagctaattcgattacgccacgaaaatgatgtgatcgtcaatggccggtttgaagccattcaaaatcttgccccggcggtcatggcatactatcgcgttcttggtcatactcgttggcttgttgtggtcaacttatcggaaaagcggcaaccattagatcttaacgatcagctagaaaaaaccatcgtgacaaatgatgcaccattgcaatcattaacagaccaaactttacaaccatatcaggcattcgctgcgattgtgcggcatgtgtaagctaccagtaccgtttagtttattttaggaggaacgattatgaagttatggaagaagatacttattggaagtgccacacttatcaccgtcaccttgctagcagcctgcagcagcaagtcgacaagttcaaccagtactgatgctaagaaggtatcagggagtgtgaagctctgggtcgataccacccaagtgccttattacaaaaaaattgtggccaatttcaacaaaaaatatccagatgtcaaagttaaggtgacgcagagtccaaatggttcagcgaatgccaagacagatgtcggcaaagatcctgccaaggcagctgatgttttcgaagtgccaaatgatcagctgggttcaatggctgaagccggttatatcaatccgctttctccagatgccaccaaagctgtgaaaaacaacaatgtcgccgtagcatccgaaggggtaacgtggaaaggcaagatgtttgcttatccgtttgcggaacaggcccagacgatttactataacaagtcaaagttaaccgcggatgatgtgaaaacatgggatggcctgacagcaaaaggcgtcttggccactgacttcacgaatgcttataatttttatccggttttcttgtctgccggtacgcagctttatgggaagacaggcgaaaccgtcaaagggacggacgtcaattcggctaaaggcgagcaagtcatggcctggtttgcccaacaaaagagcaacaaaggcgtgatgcaaacttctaatgcgctgaatcaattgaagtccgggaaggcggccgctatccttgatggcccgtggaattctgcgaacatcaaaaagattttaggtaagaattttgctgttgcgccttatccaaccatcaaacttgatggcaaggacgttcaaatgcaagcatttttgggcattgcaacctttgctgtcaactcacatgcttccggatcaaaccaaaaagctgcagccactttagcgtcattcatcaccaataaagaatcacagttgattgtgtatgatcattctggtcagattccggttgataaaactgcccaaaagagcagcaaagttgccagtgatccagtcgctggtgcagtgatgacaatggctaagactggcaattcaaccctgatgccaaaaatgccgcaaatggcgaccttctggaattatgcggcgccactgatcaatggtgcctacaccggttcaatccctgcaagtcaatacagcacgaaactcgatacgttcgttaaaaatatctctaaagcgaactaatcaacgttgaggcacaagcagaaggttggacgctaagctgtccaaccttctgcttgataaggagaaggtatgtttagaagaaaaaatcatttacctcctgaggcgacgtatcgagaagtctggaaaaagggggatgcagcaactaaggcatcgttcttcctaatgggaatcagtcaactcaaaaaccgccagtgggtcaagggaacggcttatttagtcagtgaagtggttttcctgctttggttgatgtttagtggcacgagtgcgcttaggatgttaaggaatctcggggcagtcaaaaccaaacaggttgtgtttgatcaagctcaaggggtttatatcacgaaactgccagataattcggtgctgattttgctttttggcatcatggcattgattctgatggttgcgatggtcggcctatatatttctaatttacggtcggttcgtaaattatatgtgctgcatcgtgagcaacaacatgtgcccaccaatcgtgaagaactagcatctctgttagacacccgtctgcacataacgctattgacgctgccgatacttgggatcattgcatttacggttttaccgacaatttacatgatctcaatggccttcacgaattatgatgcgcaccatccaattgggttctcatggagcgggttacaggcgtttggcaacgtcttaagcggagatttggccggtactttctttccggtcttaggttggacactgatttgggcggtttgtgctactgtgacgacttttttcttcggtgttttgctcgctttgctgatcgaatcaaaaggtatcaagcataaagctttttggcgaactattttcgtgattgtctacgctgtcccgcaatttgtatccttattgatgatggcgcagttcttagatttacaggggccattgaacaatatcttactcggctggcatttgattgaacatccgattaactttatcggggcatccgccagtccgctggttgcgcgcgtaacagtgatcgttgttaacatgtggattgggattcccgtttccatgctggtttcaacagcaattatccagaacttgcctgaggatcaaattgaagccgcgcgaattgatggtgccaatgctttccagatttttcgtaccatcacttttccacaaattttgtttgtgatgtcaccagccttgatccaacaattcattggtaacctcaacaacttcaatgttatctatttactgactggcggcttgccgatgaataataattacaacggcgccggttcaactgatttactggttacctggctgtataatttaacctttgggcaaacgcagcgatacaatgcttctgcggtgttggggattctgatcttcatcattagcgcaaccgtttcattaattgcttatcgtcggacaaatgcatttaaggagggctgatcaagatgacgtcatacaaaacacaacgccggctgtccttgatttttcgctatacattgctgagtattttagcggttgtctggttgattcccatcatttggattgttcttgccagtttttccttcaatgatacaggatttgtgtcgaccttttggccgggaaaattcacactcagtaattacactggcatttttacaagtgaccagtttccgtttgttaactggattatcaacacgcttttcgtttcggttgtctcaatgattctatcaacgttcgtgacgattattgtggcatacgcgttatcgcggttacgctttcggttacgaaagccgtttctgcaaatcgcgctgatactcgggatgtttcccggattcatgaccatgattgctttgtattacattcttaaaggattgaatatgctgaatttcggcggtttaatcttggtttacgtcggcggtgccgggttaggtttctatattgccaaaggtttttttgatacgattccgcgggcaattgatgaagccgccgaaattgacggggcgactaagtggcaagtattcacccatattgggctgcccatgtcacggccaattgtcgtgtacactgctttaatggcatttattggaccatggattgattttattttctcgggcattattctttcgtcttctggtaatgccaaaaattatacgattgcttatgggctatacaacatgctgcacagcacaaaaggcgcctcgaccacgtactttacgcagttcattgccggttgtgtcatcattgcgattccgattaccatcttgttcattattatgcagaagttttatgtcaacggtattactgctggggctgataagggatgatgttgcgaccaacaacagggaccgaatcaaaatttccacttaagaccgaggacttgtcaaattccgaattatccggagaaaaagattaagcaaaggcgttctttgccgtgccaaactccgcaatctccgaccagatggggctggaacgcgtgacggcgcttcgagcccaaagaccggtctcgaagtcgcctaacaacatcagcgacaaagcccggtcgctgatgttgtttgcacagctgagccccatctggcctacgattgctccgccttggcactaagatctttaagtcctatcagtttatctgtaagagaaatgattttccgaaaaattagaaaatcatttctcttttttgtaaacgcaaatggcattgaaatttctttttgtgtcttgaaaagtcaaaatgttttgacatttgaagagttggtattatactaatggtgtcaaaaaagtttgacatttgaggggatggttatcatgcgaaaaatggatgagatggaacgtcactttgctgatcaatcaattaaaaatgcttatctcttcatggttgtctcacttttcatctacacgatttttaagcaatttcagacaggaaagtgggactttgttttcttaatcttgattgttcaaaatttgattctgattggtagcgatcaatggttaaaacatcgagctgatcgcagcgataaaggacccgctcatgttttgtatatgacgattgtttttacagccattctgttggccataggcgcgattggattgatgttccatggaaaataatatccacgtactcagaatgcgccaacaattaacccagcaagaactggctgacgcagtgaatgtaacccggcaaacgattaatgccatcgagaataataaatacgacccaacactctcctcagccttcgcacttgcagaacgcttggagacgactgtggatcaactgtttcaacattagagaagctgaaaattatttaaggctacaaaaagaagagtgactttttccgatcaccgcatgtatgcggcggaaaagtcactcttctttcgttttactgtagatcaaaggtcatagtttaaagattccagtgccaaggcggagcaatcggaggccagatggggctcagccgtgcaaacaacacagcgaagggcttttgagctgatgttgttaggcgacttcgagaccggtctttgggctcgaagcgccgtcaccgcgttccagccccatctggccggagattgcggagtttggcacggcaggagtcgtttttgtctgacgcttgtgccaaatcatcccgcatctaacaaatcataagttctagatagaaactgaagaagcaactactgctgacgattactcctcttcatttaattcatcaaaatcatagtacaaatctctttcaggaagcaccacagcggcatttgtctgggtatccaaggcttcggcttcgcgttccggatggaagctatgccatggcacaatggttcgaggattgacttctttcgccaaagtaattaaatcctcacggctagcatgacccgaggcattcatgaactgcaaggggatgtgatgcgcttctagccagtctttgagttgcgcaaaccgcgggtcgtaatcgcctagtggctcgccgttactgtggatataggtcgtgatgggcatgtcagtcagtcgttccagatggtcaaaactattttgcaggacatagtgttggggatcacgggcaatgtccgttagactgattgtttgaccaagaatagcatcgagtttttgatcggtcatggtggtcagcacagccgcgtcatcaggttcccacaccaattgacggccggcagtgtgtgcactggcctgaaaacccgccagacgctcgtaattgcggatgtaaggattgatgacgacaagcgtcggactttccgccagcactgtctgaaattgcttctgcaggctcatttcggtcaatgggatgctgggatgatcctgatcttcgactggtgcagccgtatcaaaagagaagctggtgccttccaacataaacaagcttagcttttcttggttaaatcgctgggcccaggtatgaacccgttcagcatgcgggccatttaaccggacatcaccggaatgggcatagcgtcgtgagccgtcatcgactaggagcgccatgacgcctggctcgtcgtgatcactgtggaagcctgttacggtgaggtcaccaatggttatgggctgttcataggcaagcggatgcagatttgcaactggcttttcgatgcctagtttgattaacagttgatagagcttataggatggttccgaaagataaatcggaatcggtttctttaaatattgcaatgcacccatgtggtcaatgtgcagatgtgagataaagatggcctcatgtgtgtaaacgtctggttgatcaaaaaatagttccggcacatgcggcaatttaccattatcgatggcagagctgactgtttcgttgctgagatcagcagccacgccgaagtccatgataacgcggctggttttagttgcgaattcgacgatgttgccgccgatggtgtttaacccatttaaaaagcgaattgttgtcacagtgttacctccaattgtttcaatatcattttgagaacactaaagcgtaccccgccggctaccgaaaagcaaacaaaaaccgaatcagcacatagctgattcggcaaagatcacggcggagcaaacaattacttgtttgtcttgatgatggtttcagtttgaccctgaagtgtcttcaaagcctgatctggtttttcatgcttagtcagcatcgcatcaaccgcattaagaagatcgttacgatattctgagaagccgatgaaagcggtggactggaagccaaagcccaaagaatcaactgcagcttggctagttgggttagcactcagatatttcttaaagtcagcagatttaacagcggacttacgcagtggcacataaccagtcaattgggcccacttggaagtttccttctcagaaagcaggtacttcatgaatgcccaagcgcctttttgcttatcgctagatgcggacttgaagaggacgatatcattaccggcaagttcggttgcctttttgcctttgtagcttggtagcggcattgtgccccacttgaagtctttcggtgcattttgcttcatgttggtgatcccagcacttgaaccggcataaaagagtgttttaccagcagtgaagttcttatcgccgtaaatgtcttcgccggcagtcttggcttcgccgctgttaaccatgtccataatgaagttagcagcagttaaggttttcttgctatccaagttagctttcagcggatcagctgaaactaacggattgccagcctgacgtgccagaccttcaaattccatatcaaaactcttatcgaaaccaatagcggcaataccgtctgccttcagcttatcggcatcttttttgatgtcttcccagctggttggcttggcaatattgtatttcttcatcagtgcttcattgtagaaaagaatacgtgtggacttggagaatggcacgctgtaatacttgccttgatacttggagctggacaagaaggctgggtagatatccttcttgtcgctgctgctcatcttgtcgtcgcctttgagcatgtattgatcaagcggggaaataaaaccatttttcacgtagtcaggaacagtggtgtaagttgtttgggcaatggttggcaggttgcgagattttgctgcagccatgatcttttgttgcaaggcggtgtagttaccttgcgcggtgccgacaactttatactgtttctgactcttattgaaatcattgatgatttgatcaagagcattttggtaaggaccgttcatgccgtgccaaaaagtgatcgtcacccgtttgcccgaatcactcttggtacttgaactcgatttgctgctgctgttactgccgcaagccgtcaaaacagcgacaagaacgacagtgaacattgcaagtaatgcttttacccaagtttgctttttcattttggtagattatcctttcaatccagctttagaaatcccagcaataatgtacttctgcaagaagatatacaaaacaaccattggaatgatgacgaatgtggaagcggccatcagaagttgatattgcgtgccggcatcggtcgtgaaggcctgcaagccgactggcaaggtacgcatcttgtcagagttcgtaacgatcaatggccacatgaaggcattccatgagccaatcacctgaagaacggtgaccgcggtaatcgttgacttgctcattgggacaagcacttgccacaaatatttccaatcggacgcaccatcgattttagcagcatagtagatctgattcggtgttgattggaaagtctgacgcaaggtaaaaacggtgaagaagctggccaaccacggcagaatcaaagcgccgtaatggtcaatttgccctaagtgtgacaaggtcacgaagttagggatgatcaacatttcacctggaatcatcatggttccgaggaaaataatgaacaagaggttcttgccgtaaaacttcaatcgagcgaaagcaaaagcggcaagaatactggtaaagagctgcccgaccgttgtgataacagtgacgatcgtgctattaatgaaatactgtccaaacggtgcttcgttccacgccttgacatagttaccccattgtagaaccttggggatccagatcggtggaacggcaatcgtttccggtgccgttttaagtgatgtggagatcatccataagaaggggatcagcatggtgatcgcgcctaaaatgacaatcaggtaaagcagaattttactgatttttttagccatgtttttgcctcctccttagtaatgaacgtgcttgcgggaataccacaactgcacgagtgtcactagcaggatgaggaagaaaagcacgaccccagacgcagcagcaattggatacttgtactcggtataaaatttctggtacagatagtaaacaattgtcaaatcagctttacctggtccgggcgtgccttggaacaaggcgaagatttcatcgaacaccttgaagctgccgatgatcccgttaactgaaaccaagaaagtgattggtgatagtatcgggatcgtgatgttccaaaatcgctgacgcgcgttggcaccatcgatttcagcggcttcgtaatacccgtggtcaatgttgttgagaccgaccaagaaaagaatgatgttgaagcccagacttttccaaatactcataatgatcagcgccagcagtgcataatgcggatcagtcagccagttaatgggatggataccaaaccagcccataaagtagttgatcagcccatagttactgtggaacatccaattccaaaccatcgcaatcgccacagtactggtgacaaacggcaggaaatagacggttctgaagaaaccggagatgatcttcacctggtttagcaataaggcaatgatcaaggataaaatgacagtgatcggaaccacgccgacaacaaaaaccagcgtattccgcacagccaagtgaaaatcaggatcattccaaagataaacaaagttatcaaagccccaagcactgaccttatcagtataaaaatcatacttcgtgtacaaactcatcagaaatgagttaataatcggccagatattgaaggtgatggtaatcaccagcattggcagcaaatacagcgctgctttggcggtcgattttaggcttgctttttcattcagcatgactttcaccaccaaaaatcaaggcgccggattggtcaaaaagaaagaaacccgacttggtgagatagaaatccagatctggttgattagctgcgacaccagccatttctgttgacaacaggtgctcgccgttataagtaatatcggctgtagcttcccgcccatatttagaactttgcgtgattttgccgtgaagcttggctaggacattgtcgccggcatcataagggatgatggcttcactacggatccctgcggtgactgcctgcttcaaaatatcttctgacacagcgctagctagatcagttgtcaacgcttgtgctggcaaggtgttgatcacaggttcaccgataaacttagcaacgaacaaattgttcggtcgctcgtatagtttttgcggggaactgaactgttgtatcgaaccatttgccaaaaccatgatgttatcagaaatgtgtaatgcttcatcttggtcatgggtcacgaaaatcgtggtaacaccggtttcgcgttgaattcggcgaatttcttcgcgcatctcaattcgaagccgggcgtcaaggtttgacaacggttcatctagcaacaataggctaggggacttggctaaggcacgtgcgatagcgacacgctgttgctggccgccagaaagtgcccctggtttcttatcaagctgatcctcaacatgaaccagtttggcaagatccttggctttggcgtgccgttcagccttgctgaccttggccattttcagtggaaaggcgatattgtccaacactgacaaatgcggatacagactgtagttctgaaataccatcccaactttacgcgctaaggcatcttttttagtcacatctgtatcaccaaaaaagatttgcccagcggtcggggacaacaacccggaaatgagattcagggtcgtggttttaccgccgccggaaggacccagcagggaaaccagcgtgccatcgggaatggtaaagttcagatccttcagggtatctgtcttgccatcgtaggacatcgtgacgtccttgaaagtaactttcaacccagtacgctccttcaaatagttttctgctcctcacctccgttcgtcgatctccagcaacaaaggctgtaagaacgcgcaaagagaaaatttggaacaagataatttggaacaagatattgtggttgcttcaccatgattagctacatctagagaaggcaaacacaactcttctcacattttaacccagattcactgaaaaatggactcattcgcccaaaaacattttgattatgtttaattgccatcacaacgcgaatgttcgccttttttgctataatagaaagcatgcaaaaggcgcaacttgaatcaactgctttcgctgctgatgagtgtcagcaaattggcggttcattcagcgccaataaaagaggagcgatttttttgataatacgtccaagcaaaccggacgatgcgccgcaagtagcaccgttgatcgatattgtgtttacggagatggaaatttctcagttaatgaaggttcctaagaagaccctgtattcggttttggaacaagcctttttactgccaacttaccggtacggttacccgcaaatgttggtggctgatcaggacggtcagattgaagggattgctgttggctatttgcatgagcaggaagcccatatcgacgatgctttaaaaccgttgttgcctaagctgggattgaccccaaattcatcgcttttttcagacaccgaaacttatgccggcgagtggtatttagatacgctagcagtcgccgagacagcgcagggacatgggatcgggaccaaattattaaacgcagtcgatacggttgctcgggctcggcacgctaaagtggttagtctgaacgtggatcagcagaatccgcgggctaaaaagttatatgagcgcaatggttttcttaaacacggcgagttgatgattggcagtcatcgatacgatcatatgctgcggccggttgtgggcgaagaagtttagtgttagtcaataggttagcctaaagcccttagcccgccgaacgccgcaatctccgaccagatggggtttgtgacgcacagccagagtggagacggcacttcgagtccaaaaaccggtctcgaagttgcctaatcacatcggctccaaggacaggttgtacgtttgaacgccatctggtctacgattgctgcgccttggcactaggatctctaaatagcaatgagaattaaagacgactggtattccatggaggaaaatcagtcgtctttatttcatagctaggaatgatggtcttagcttttcttttcgcttaatctgggaaatccagcccatattcataacgcttcaatggatcggccacacccacatggcgaaagcggtcgaggatagcagctaacaaaatggccgctggaatgtcgcggttattgggaatggtcaacttaacgatggctggtgcaatttcttcagcactgaagatcgttttgaccccatgaaacacttgataatggttattcaaaagattacccatggcgacccagttgagatctgagataaagatgaactgatgccagaccccaaacatttttttgacgctggcaaccttgcgattggcgatataaagatcatagcgcgggaaaacgctgaccgttttttgtcgaatggatccaagcggttcgccgcttaatgtattcagatcgaagccaccattaatcagtccgtgccgacccgttagaatgtaggccggcttgccgttatcggttttgaccacacttaaactactcgtgcttaaagcattgatatcaagatataacgccatcggccaacctcccttatggtgagcgtgaactggcgcggttagaaatcggagcataagcgggctcaagtgcgatgggcgggttttgcccattgtgcttgaggtccttatgagcaggtttctgcgtcagtgagcgcgttatggtgagcgtgaaccggcgcggcgcctgtgtttaaaaaattaaaatcagcaaactatcgctgcgccaatgattattagaattgagcgtttgattttttcgccttattaatgcgaatggctttgcgaattgcctgagcaacgccgttttcgctattagtggcagtactgccccatgcgagcttggtgatttcggggatggcgttccccatcgccatgccatatttggccattttgatcatgctggcgtcattcaagttatcgccgattgtcatgacctcatccatggtaataccgcgttgcttagcgaaagcttcaacagcataacctttttgcgctttgatgttgttgacttcaatgttattcgcagagcttgaggtgacacttaatttaccggtggcttcaaaaaccttcgctggtgctttcaaaatatcgcgttgctcgccagtaaacgcaatgattttcatcacttggatagtagggtcggctagcagttctttatagtcactaacgtaattgatgttcatgatttccagccgtgcagctgcgagcgcaaccgccagtttgtaagttgtatctgggttgagatcaaccaacagatcggcaacattttgaatacgtttgacgcggctgtccgaaaagacgcctttgttggtgatgatttcaaaatagatgtcgtccttttgcaaggtctcgacaatgaaatcgcttaggtcactagcaattggaatcgtgaccaccaattcgccagcctcatcaaaaaccatggcgccgttgagtgtaatgaatgctggtttgagatcttgggcggcaagtaacggtgtagcttcggtgacgccgcggccagttgcgaccataaattcgataccagcggcttgcgcgtcacgaatggcttgggcgttttcgtccgaaacttccattttgtcgtttaaaagtgtgccatccatgtctgatgcgataagtttgatcatatttactgttccctccggtttgtcatggtgcggttacgcctccaattctagcatgaaaaagcgtttcccggtagcaaagccgcggtgattcttgtacactatttgcggaggtgcacgtcttgaaaacattaatacataatgactggcagacggtgctggaaccggtatttgaaagtcctgagtatgctcaactgcatgtgttcttaaaagaagaatacgcgacaaaaacgatttaccctgaaatgcaccatatttttcaggcattcgaatggacacctttccatgatgtgaaggtggtcattctaggccaggacccttaccacaatccgcggcaggcggttggtgcgagctttgcggtggcacccggtgtcgctttgccgccgtctttgcaaaacatttataaagagttgcaaagcgatttaggctatccaccggtccatcatggttatttgaaggcatgggcggaccaaggcgttctattgttgaatgccgttttgacggtacaagccggcgaagcctattcccatcagaatcatggctgggaagagttgacagatgctgccattgctgccttgtctgcacgcggcggcgttgtgttcatcctgtgggggaacgcggccaaaaaaaaggcggccgtgattgatacgagcaaaaacgcgattattgcatcggcgcacccaagcccgttatctgcatctcgtggcttctttggcagtcgcccgttttcgcgcaccaatgcggcactagaaaaaatgggcgaggccccgattaattggcagttaccagaaacggtgaaggcgaattaacctgaattgactagccttaagtagctcagacacactgtttttccattgtcttcgactagtcacgacccgataaaaacggtatgatgaacaagaataaagcgcttttatggagggataagatttggacctatttgaaagtttaaaagacaagactaatggcaaaaatttacggattgtatttccggagggcgaagatccgcgcgttttgggcgcagcagttcggctcgcagctgacgggttgatacaggccatcgtgctaggtaatcctgataagattcagacattggcagctggtaaaagctgggatctcagcaagttgacagttcgcgatccagccaacgatgacattcacgctaaaatggttgcgtcctttgttgagcgtcgcaaaggcaaggcaaccccagaacaggccgaaaaaattgttcaggatgccaattattttggtacgatgctggtttacatgaaggaagcagacggtatggtttcaggcgcagttcattcaacggctgacacagtccggcctgctttgcaaattatcaagacgcgtcctggcgtgcatttggtcagtggtgcattcattatgcagcgtggccgtgacgaacgctacttattcgcggataacgccatcaacattgatccagatgctgatcagctggctgaaattgcggttgagtcagctaacaccgctgccttgtttgatatcgaaccaccgcgcgtcgccttgctgtcattctcaaccaaaggcagtgccaagggaccgcaagtagataaggtagttgaagccactaagaaagctcatgaactggcacctgatttggccttagatggtgagttacaatttgatgctgcttttgtcccaaccgttgccaagcaaaaagcccctgattccaaagtggctggggaagcgaatgttttcattttccctgaattacaatccggtaatattggttataagattgcgcaacgattcggcgggtttgaagccattggcccaattttgcaaggcttgaatcagccagtttctgatttgagtcgtggggcaaatgaagaggatgtctataagttggccattattacagcggcccagaccttgctatgacaagtttgaaaagagacttcactggtgaggcagcactgcaatcctttgcggcttcactgggaccgcagttgcaagcgggagacgttttgctgctggatggtgacttgggtgctggtaaaactagtttcaccaagggcttggcaaaaggcttaggcatcaccgattacgtcaaaagtccaacatttacaattgttcgcgagtatcgtcatggccgattaccgctgtatcatatggatctgtatcgcttagaagacggtggggctgaggatctcggtcttgaagagtacttcgaaggtgatggggtgtctgtcgtggagtggccggattttttgggattaagtgaaccagagacctatctgatgattcattttcaaaaagatgataatgaagatacaacgcggcatctcgaatttgtgccgtttggccaacactatgagaatttactcgaaagcctatgatagcaagcacgcaaagaacatttgcgtgcttttttgatttggtttggtaaagtggtgcagaacaaagaaaaggcggtgcgttatgaaatttggcgaacagttggccgctttgtttgttgggcttttcgttggcgaagtcacaatctgggcagttatccacacttttcgaagacaatggcgtgcatgagggtcacagaatttggtctggctactttcactaggacaataaatctacttttgataacacgttatactttgataaccaaagtatgcatggtagactattgacaacgtgagaaagtgagctaattcataacgtgaacaggcacgttggcaagctgagatattggtcttaggcgtgatgaccagttgtttgtcattgcttctgaggctcttaccatagaggcttgagcatctgtgagcgcgttttaagtaaaggagtagtggccatgctagaagtcaaggatcttgtgaagaccttcggcacgatgacggcggttgatcaggagagcttcaccgttaaaccaggtgaaatcatggggttgatcggccaaaacggggcggggaagacgacaacatttcggatgattttgaattttttgacaccagactctggtgccatcacttggaatggtcatccgttaacagctaaagattatgacaccattggatatttaccagaagagcgcggtttatatccaaagatgcgggttcaagatcaaattatttattttgcgcgcttgcgtggtatgcgcacgtcagaaattaaagccaagattccagaatggatggaccgatttcaggttaaaggcaagcctaccgataaaatcaaagacttaagtaaggggaatcagcaaaaagttcaggtcattgccacaatgattcatatgccaaagctggttattctagatgagcctttttcgggacttgatccggttaactcaagcctgttgatggctggcattcagatgctgaaagaaaatggcgctgcgattatctattccagccatgacatggccaacgttgaggcaatttctgatcatcttattatgctgaagcaagggcgaatggtcctcaatggcgcagtcggcgatattcgtgaaagctttggccgcacgaaacttttcatcgaatcaggattgacagctgaagatttgcgggcctttgacggcgtgacaaaaataaaccaacatggccaagaatttgagttaacgttggctgatccggcagttggcagacagatttttgcgaaagcgacggaaaatggctatataccagaattccgtcagcagccaccaacacttgatgaaatcttccgcttgaaagtaggtgaagctgatgcataaattttgggttgttatgagtcaggtttataaaaagaatgccaaaagtggttcatggatttttctagtattgtcaccgctatttttccttgcgattgcttttggaatcgttttttatatttccaaaacgcaagcacctgctcaagtcgcagttgtcagtgacgttagcgttgtgcgccaagcattgagtaaacaaagtaccagtgatttacactttaagccgtatacttctgctaaaaaagccaatgatgcactgaacaaagaagatcttgatggcattttaacggtgaatgccaaagatgacttcaagtcgcattatgttgctcgcgataacggtcagacagttgagacttcaacgctggtggcagcgctgagcggattgaaattgagcagcacggccgcagccatgaagctgacaccagctcaggttaaggctttaacggcaccgccgacagtgacatcgaagacggttgccattgaggatggcaagcaggtagccaaatccaatacggcacaacttatgaatcatggccttgcgctcgtttcaatggttttgattctgatggtcaccatggtgtatggttctattctggcacaggaaattgcaactgaaaaaggctcgcgaatcatggagatccttttgtcctctgttagtgccacgacgcaattctttggcaagttggcgggcattttcgccttgttgctgacacaactggttatttacgtgattgccggtgttatcggctggcaatttttgaaaaatcaaacaatggttgccggcttgttaaagcaagtggatctgtcgatactagcttctgggacaaccgccatgattgcgcttttctttatcatcggcacactcacttattcggtcttggctgcattaaccggctcgcttgtttctaatcaggaacaagtccagcaagctgttatgccaattaccatgctggggatgatcggctacttcattacaatcgccgcccaagccaatgattcgacgctggcacaagtaacaagctacgtgcctttcttgaatgtttttgttatgccaacgcagatgtcgctaggccgagcaagtatgggtcaggcatgggtcagtatcggtattagtgtcgtctttctcgccttgtttactttctttacggtcgcggtttatcggaataacgtcttggtctattccggttcgggcttgtggcaatcaatgaagacctcctttagcatttggaaggcggaacgcggtgtggctaaaaaataaatataattaggcaaaataaaaaggcgattcctcagcggagccgcctttttgcgtggcagatgtattcagcagttaatgagcgcgcagtcgggtcaaacgttgagcggttgccagtcgtacctgaatcaacccgcttttgaaagcttcatcatgcttttaatccgggcttcgccaaagtgctcattttcggcgatcaaaattcgtgcgcaggcataactatccgccaaggcattgtggtgatgctcaagcggaatgtgcaaggcggcactgacagtatctaaccgatgattcggcaacttcggcaaaaattgtcgcgaggttttaaccgtgtcaatcacttgatagcgcggtgccgcaatgccgtaacgatccagtgtcagtcgcataaccgaaacatcaaacggtgcattgtgagcggtcacgatccgacctggcgtatagaacatttgaatatgcggccaaacttgatcaaatgttggctgatcttgaaccatttcaggggtgatgccatgaatgtgaatgttttgggcatcaaactgcatctgcggattaataagggtgtaaaaactgtcaaccactttattttgctggacgaccacgagcgccaatgaacacgctgaggctcgcttgcgattggcagtttcgaaatccatggcgataaagtccatcgtgttttctcctaaatcaagtcttttgtgacaagttcaactggacagtggtcactgcccataatgtcggtcagaatttttgcatcctgaatatatggtttgaagtcacggctgctgacaaagtagtcgatacgccaaccagcgttattagcgcgggcatggaatcgataactccaccatgagtaagtgacggtatctggatacaagttccggaatgtatcgataaagccgctatctaactgttttgtaaagtcagcccgttcttcatcggtaaagccggcgttgtggtgattggtcttgtcatttttaaggtcgatttcttggtgcgcgacatttaaatcgccgcagtaaacgagcggctttttggccgcgagttggttcgtgtaggcaagaaaatctttgtcccattgctggcggtaatccagccgcttcagttcaccaccagagttcggcgtataaaccgtcatcaaatagaagtttggatactctaaggtaatgatccggccttcagtatcatgttcaggaacgcccatcccatacgtgacattgagcggttcatgtttggtgaaaatggccgtaccagaatagcctttgcgttcggcgtagttaaagtattgatgatagccaggcagatcgagttcaacttggcctgcctgcattttggtttcctgcaaacagaaccagtcggcgtctaattcattaaaaatagtcataaagtctttttttaaaacagctcgtaagccattcacgttccaagaaattaatttcatcaaatgattcactcctaacgatgcattgcggttccattctactagatttgacagatgattgcgatataccttcacagcctccccgtgttcataacagcaattatctgctaaaatagcttagtagtatttgtgaaaggacctgatgttgtggtggatgcgccgcgtacgcttgaaggaattaccatgatgcatgatgaacctttgagtcattatacgtttacgaaaaccgggggaccggctgatttattggcgtttcccaaaaatgtggccgaagtgcgggcattagttgatgacgctcgtgaccaaggcttgcctttgacggtgattggaaatgccagcaatttaattgtccgggatggtggcattcgcggactggtgttgattttaaccgaaatgaaaaccatcacggccagtggcaatcaagtgacagctgaggcgggggcacggttgattgatacaactgaagcagcttaccgagcaggtttgactggtcttgagtttgctgctggcattcctggcagtgttggcggcgctgttttcatgaacgctggcgcttacgatggtgaagtctgcaacgtcatcagcagtgttgacgttttgacgcgagaaggcgaattaaagacgtatgatcaccgtgaactgaaattccgttatcggcacagtgttgttcaggatacaggtgatgtcgtcttaagcgctacctttacgctcaaagcgggtgacaaaccagtcattcgagcaaaaatggatgagttgaatgcgcgtcgggcggctaaacaaccacttgaatatccttcttgcgggtcggtctttaaacggccaaaggggcattttgttggcccaatgatccaaaaagctggtctgcaaggtcatattatcggtggggcacaggtgtcaaagaaacatgctggcttcatcatcaacctcggcgatgcaaccgcaacggattacctagacatgattcatcttatacaaaaaacagtgaaagctaaatttgatgttgatctggaaaccgaggttcgaattatcggtgaacctggtcaaccaaaatagaccttagaaaggggcgacacaatgcatttagtcgaagccgttttgttcttgatggcacttgtcatcgtctcaaacgtgctcagtcactacattgtggctgtcccggtctccttgattcaagtcgcgctgggattaggcgcggctttgttttttcatttggagatcaatttagcgacagactggttcatgctgttgttcattgctccgctgctattttatgacgggcgtaattttccgcggcgcgagttgtgggaactgcgtggtccgattatcggaaacgcgatttttctggtatttgtcacgatgctggtcggtgggtatctgattcactttttgattccgccaatgccgttgcccgcaagttttgccttggcagcgattctcagcccgactgatccgattgcggtgcagagtctagctaagcgagttcatctaccaaaaggtgtgctgcatctggtgagcggcgagagcttgatcaacgatgctagcgggctgatcggctttaaatatggcattgcggcgaccatgacaggtacatttgtccttggcaacgccgttcgggatttcttttatgtggcaattgtcggtgccttggctggactggtgttaatcagtttaatcaacctaagtcgcaaatggctgctgcagcaagggattaacgatgtcattttgcatactatcttgcaggtgctaacacctttcttcatctatctcgtggtggacgagttcatgcatgcgtcgggtgtcattgcagtcgttgtggcggggttgcttagtaatactcgctacaaccgttacattgctgccttgccagaacttagaattgtttctgaacgtacttgggacattattgtctatacacttaacgggattatttttctcattctcggcattgaattgccggttgcgatgaccgacacgattgctgatcatgaggtcagcacgtttcaggcgctcggctttgtggttgtcgtttacctgggcattttaattgttcgaacgctatggatttacggttacatgctgctggcaaaacgttccaaagaaggcaaagcttcatggcgagcagctcttttgagtggtatttctggcgtgcgcggcgcgattacattagtcggggtgcttgccgtcccagcagctttgagcaacggtgatgcatttccggagcgtagtttaatgttgttcatcgcggctggtgtggtggtgctaagtttaatcgtcgccattatcgcgttgccgttagttacccgttcagtggcaccactgcaaacgcgtggatccacgattgtaactgacgacagtggcgatcaagatgatgatgacagcaacgatattcgtatcatttcgctgagtcaggcacaaacctttgtctttcaaatggcggttcgccgagttgagtcggagcgccgtgagacgaatcaaaaagccgctttggacttgattgcggaatatcagtacctgattcgccggttagaactcgctgaagataccggtgctgccattccgccgctcattcaggatgaactggatctgcgaaaagtcggggttcaaggcgagctatatgctttagacgatctatggcgcgacaacaaaattatgtccaaaagttacgctaaagcccgcaaacaattgcaacaccgcctgaatgatctggactcaatggccaaacgctccggccgaccaactttccgcatgttgttcgaacgttccgccttacgcttatcgcattggtggtacaccgtggccagcgagcaaaatcgttcgcaccgattcttcaacgagcgcttatttattgaaaaagaaaccgcaaaaggcggacttaaatatttatcgcagtttttacgacaaaaggagaacaaagcccacaattataaccgccaagttatttatgctttgattgtccaatatcgaaatcgaattgcttcggtgaaggctttgaacacgcacaaatcaactcaatatgagcaggaactcgggcgcttgcgagctattgcgtttgcagctgaacgggccgctatccacgatctgacagaaaaagggtatatcacgatgacgatggcgcaaaaactgaatcaaaatgttaatttcactgaaaatgcggctaccttaacgtcacttgaagaggtttaaaggccgctgcggacaagtcatgccggttcaaaaagagcgtttggttgggttgaatcagttgatttttgctttttaaaacagacgttaattgacaacggtatcgtccttgtctcgattgagactgggccggtaccgtttttttgatgtccatgacatacgtatttgtcggcgctttgtgaggattcggcgaaacttttttgacgaattacaaatcaaatacttgcgttgttggttggcactcgtataataggaagagttagtaaacttaaagtttagtttaacgaaacccacaaaggcggtgtcttatggagattggcagtcgaattcgagacttgcgaatccggaaaaacttgacccaagaagagttaggcgagcgaacggatctcacaaagggctatatttcgcaggtggagcatgaccagagttcaccgtcacttgagactttttttgatattttgagtgttttgggtgaatctccggctgatttttttcgtgaggaaccaaaagattccttggtttatcacgaggatgatcaagtcacatatttggatgaagaaaaagggtaccgcttgaaatggctggtgcctgaaagcaatgaaaatgaaatggaaccggtcatgatcgattttgccgcgcacggcatttttaaaacgttcgagccttcaccggcagaaacctttgtttacgttgttagtggtcgtgtcaaattactgctgggtgaacaaacttatgttgcaaagaaaggcgagacaatttactttcacgcaaccaagcaacatcaattggtcaacgccgcgacgggtcgtagtaagtgcttgctagtcgcgacggcatcttatttataaggagttggggtcattgagcaacattatcgttgaactgaagcatgttggtaagcggtacggcgacacgcaggtgctgaaggatatcaacattgagatcgaacaaggcaagttttacacgttgttgggaccatccggatcgggtaaaacaacgattttgcgtgcaattgcggggtttttggatgtctcagaaggtgaagtgctgtttgatggcaagcggatcaatgatgtgcctgccaaccagcgcaaggttaatacggttttccaagactatgccctattcccgcacctaaacgtttttgacaatgttgcattcgggttgcggttgcgtcggatgagcaagcaagacattcagacaaaggttgaagatgccttaaaaatggttcgattacaaggttatgctgatcgggaaatttccgaattatccggtggtcaacaacagcgagttgccattgctcgagcgattgtactcgagccgcaagtattgctgctagatgaaccgttatcagcacttgacgccaaattgcgtaaggatatgcaatatgaattgcgcgaattgcaggaacggttggggatcactttcctatttgtgacacacgaccaagaagaagcgttggccttgtcggacgaaatttttgtcataaacgatggtgaagtgcaacaaagtggtacgccagttgatatttatgatgagccggtcaatcattttgtggcggatttcattggtgaaagtaacatcattcaagggcacatgattaaggacttcttagttgagttcaatggcaaacggtttgaatgtgccgatgccggaatgcgtccaaatgaaccagttgaagttgttttgcgcccagaagatttggacattaccccagcaaattcaggcaaggtcaatgttgaagtagacacccaactgttccgcggtgactactacgaaattgtgggttacgacgatctcaagaatgaatggttgattcactcaaccaatcccgccaaagacggcgaaacggttggcttgacgtttgaccctgaggatatccatgtcatgcggcttaacgaatctgaagaagatttcgacgctcggctggaaacctacgaaggggaataacgtcagtaaggatcagttggggcagtgtcatcgaagcgttttgacgattagatagacactggtcggcgctgatcgattttcgaactgaggagggtcatcgtgaaaaaatccaccacaaacgccgcattctacacaccttatgtgatgtggctggcattatttgtgatcgcaccgatggttttaatcgtttatcaaagtttctttaacatcagcggtcactttacccttgccaattatcagacctattttcaatcaggcacttatattatgatgacgatcaattccgtctggtatgcgttcttgatcacgttagcaactttgttaatcagctatccaacagcatatttgctgcattatgccaagcataaacagttatggttgttgctgattattctaccgacttggattaacttgctgctgaaagcatacgccttcatcgggatcttcagtcaggatggcggggttaatagtttcttgggaatgtttggcatcgcgccccagcaattcctgttcacggattttagtttcatttttgttgctgcttatattgaaatcccgttcatgatcttgccgattttcaatgcaatcgaagaattaccggaaaaccttgtcaatgctgcccaagatttaggggccaaaagctggcagaccttcactaaggtgatctggccgttgacaatttccggcgtgaaatccggggttcaagctgttttcattcctagtttaagtttattcatgttgacgcgtctgatcggcgggaaccgggtcattactttggggacagccattgaagagcattttctgacaacgatgaactggggcatgggttcgacgatcggggttgtcctgatcgtcgccatgttcatcatcatgttcctgaccggcgaacgtaagaagaagggggcgcggcgtcatgaagcgtaaattcaaatggtccaacctttatttgatcttcgtcttcatctgtttgtatgtgccgattttttatttggttatctactcgttttcaacgggagatcgcatgagcaattacagcggcttcacatggaaacattatgctgagctgtttgccgacacccggatgattcaaattgttctggatacgttgctagtcgcgctattatccagtttgatcgctacgattatcggtgcgttaggagcattagcaattgatcgtactagtcgacctgttgttaaaaacacggtcttatccctcaacaacattctcatagtgagtccagatgtcattatcggtgctagttttctgatcttctataccgcgttgaaagtgccattgggtttctggtccgtcttgatgagccatattgccttttctatcccgattgtcgtgttgatgatcttaccgcggcttcaggaaatgagccattctttactagatgctgctcgtgatttaggcgcgtccaactatcaagttttaacgcgcgtgatcgtgccttatattacgcctggtattttttccggctttttcatggcctttacgtattcactagatgattttgccgtgaccttctttgtcactggtaatggttttgaaacactggcagtcgaaatatacgctcgcgcacgacaaggcatcagtttggagatcaatgcgttgtcaggcgtcatgtttatctttgctttactgctggtagtcggttactacttcattcaacaagcaggtcaaaatcggcgagccaaacaaaaacacaagcgagaaagcgaggcgttgatcaatgaaacgactcattagtattgcgattgccatcttagctgtttgtctcggattagcagtttggagtgaagggttacaaaaatcgcaaggtgatacgggtgaaaacacgttaaaccttttcaactggggcgattacatcgatccggcgctgatcagcaagtttgaaaaacaaactggctatcatgttaatcaagaaacctttgattcaaatgaagccatgttcaccaagattcaacaaggtggtacaagctacgatttgacagtaccatctgactacatgatcgaaaaaatgaaaaaggccaatctgttgctaccgctcgataaaagtaaattacgcgggatgcaaaacatggacccgcgtttaatcgataaagattttgatcgcaacaataaatacagcattccgtatttctggggaacgctggggattatttacaacgataagtttgtcaaaaccagtgaagttcaacactgggatcaactatggaacccgaaattcaaagattcaatcatgttgattgattcggcccgcgacgtgtttgcaccggcgctcatttcgatgggcaagtcggttaatgaaaccaacccgcaaaccttagcgctcgccaaggcaaaacttgatcagctgtcgcctaatgtgaaagctgttgttgctgatgaaatcaaaatgtacatggccgagaacgaggctaagattgcggttgactggtcaggtgaagccagtgagatgttggccaataataaacatctgcactatgttgtcccgcgcgagggcagcaatctctggtttgacaacttggtcatccctaagacggctaagcattttaaggccatctatgcctttctaaacttcatgatggaacccaaaaacgcggctcaaaatgccgaatatgtcggttatgcaacaccaaatgcagccgccaagaagctcctaccaaagagtgtgcaaaatgatcgccaattttatccagatgatgaaacaatgaaacatttggagatttattctgatctgccaccagctaaggttgggctttataatgatcttttcttggaattcaaaatgtatcgccgatgagaaggctcatcgcttacagtccgctatgattagctaaaaaagctaatttgcgggcttttttttggtcactttttcgattgcttcggtaatcttaaacgacaaggatttaactgatgatctcgcaaaaaataaaccttgataacaaagatcgatgagggaaaatggctttaaagatgagaacgttttctaaaatgcacatcacactagcaaaatctggtacgcttattgcaatgaaaaacatctgattgtgccccagcgtcattaactgacaaagggataaacggttttgcagtcgtcttggttacttgtttcagatacgatcactaagaggtgggcagcttgggaaagagaacttacaaaaatgaagagcgctgggtagacgttgtttgttgccttagtctttggttggcatcttttagtttgatggcagccgctacggtactcaatgtcaatcgtccattcttcattattgtgctgtcattaacggcctgcgccattggcgaaacggtgacgttggttaggaaaaagcgctgaggcggatgataagattgtttaatgctatcacgcgtcacggtaaaatgggccagtattagctgtgtcttttcagtgattatttttgtgactaatcaaccaataaccgactacgaaaaatacagttccaagtgttgcaattcctaaagcatcgagcaatatggaagcgataaagccattccgaatggcaaaccatacaactgcactggcaaacatcacgcaccatcctccaacaaaacttagaccaacaactttatttgtttgcatcaatttaacctccagtagtagtttaagttgccaatgagaatgctttctatcttatagaaaggataacatgaagccgaaaattttggttacattttttaacataggggcagtgatctttcagctttatggcgatttaatgcacgccacttcgcacacaataaaaagcgatccgcctatttttggacggatcgctttttgttcatattaaccgctattacctaatcaacaacatcgactttcttagcagccaatcggcgtcgattgagccacttgcgtccttcttcgatgaggaagagcggaattggaataatagccaagaagatccaatccgttggggcgagtgggccggtgtgaaagagttcctgtaagaatggggtatagctgagaagtgccaataggaaaatttcaaagacgatcccgaaccaaacgagtttgttagcaaaaagaccggctttgaaaacagaagcattttcggttcggcagttcatcgctgcggcaatctgacagaagatgatggcggccaaggtcatggtagtcgccatgacgtaagtgttgccactggttgccagacccttcaacggccaaccattgagatggttgacgaagaagtaggcaccgcttgaaatgattgaggcaatcaggccataccaagcaaacgccttccagagaacggttttactcatgaggtgggcatcgcgtgctcgcggtggcttgtccatgatgctaggttccgctttctcagagccaagacctaaggctggcatcatgtcggtgccaagatcgacggtcaaaatttgcatgacagttaacgggagcggaatcgcaccacgtgagaacaggaataaggctgaaggtaccgcttcaggcaagttggaattcaagatgtagatcaggaatttctgaatgttactgtaaacggttcgaccttcttcaatggcggcaacaattgaggcaaagttgtcatcggttaggatcatatcagcggcatccttggcgacatcggtgccggtaacgcccatggcaacaccaatgtcggcttttttcaaggctggggcatcattgacaccatcgccggtagaagcaacgatctcgcccatttcttgcaaggttgagacgattttgtatttctgctctggggcgacccgtgcgaaaatgatttcgccagcaagtgccttttttaaatcttctttactcattgaatcgagttcgccaccggtgacaacccgcgctttgtcagaagtgaggccgattttgaccgcgacggacttagctgttagggaagagtcgccggtaaccataataattttgatactggcacggtgacatttcttgatggcttcgtaaatttccggccgtggcggatcggacatgattgctaagccaacaaaggtcaaattggtttcagccgtgtcgattgtgaggtcgtcgagttgtttttctttatctgtttcttgaggcacctcacgataagcggtggcaatggaacgcaggccgagggaagcatatttgcggttggcatcgtcaatcgcttttttatcgtcttcagtcagtggccgaactttgccattttcttggatagtgtcacaatgcggcagcaagtcgctcagcgagcctttggtgcaaattgataaggtgtgatcgtcatgttgatgaatggtggtcatacgcttccgatctgaatcaaacggcagctctttcaggcgtggatacttaatgctgtatgccttggtatcaatgccggacttttgggccaaaatgaccagtgaggcttcagtcggggtacctaggattttcggccgagcactgccttttgacggctcaacttcagtatcattattgaaggcaactaagcggatcagcaaatccagatcggcatcggtgccatatttaatgggtttcccgtccagttgaatctggccattattcacgaagccttggccagtaacggtgaaggaatgagcaggtgtccagatgtgatccacggtcatctgattttgggttaaggtgccggttttatctgaacagatcaccgtggtttcgcctaaggtttcaacactattcagatcttttaacaacgcatgctttttggccatgcgttgaacaccttgagccaaggacaatgtgactgttggcaacaagccttcagggatgaaggctacgatcatacccaaggcgaaaatgaaactttgagccacagggtagtggacaaagaagattgccgaaacgaagaataccagaccaagaccgatggcaatcagtgaaatctgtttggttaaacgatttagctctaattgtaagggactcagacttggtttttgttgttgcgttaacgccgcaattcgaccaaactcggtattcatccccgtggcaaatgccactgcagttgccgtgccagcgccaacagtagtgccagcataaacaaggtttgattccgcgaactcaccttgaccagcatcaaaggcaactttttttgattcaggtaccgattcaccagttagggcactttgatcaacttgaaccgaagtggccttaatcaagcgcgcatcaaccggaaccgcattgcctgcctgaagattgaaaacatccccaggtaccattttggttgcattaatttgctgcagtttgccatcgcgataaacttgcgtataagccggtagcattttcattaacgagtcagttgctttttgagcttcatgttcttgccaatagctgaaaacaccgttgataatattgaccagccaaatggcaatccctaattcgagggtgcctgacaggatggcgacaaagccgctgacccacaacagaatggccatcacgcttgtgaaatttttgaggaaaatgagtaattgtgattgttgcttttcccgagtaatcacgttttccccatatttttctaggcggtcggcggcctccttctgcgttaatccagttgacgttgtgtgcaaatccgtcatcagatccgggacgggatccgttgcaaacttgcgccgcgtctccttttcatttttcatgacttaagcacgtctccttcataaagatgtttagcttcattctaacgttctgagcggcggaaaacacccaaagtgctgtttttaagcaattaaacttttcggcttaggcgcggagaccgcgttctaagaattcaaccgcttcgtgaacggcagtttcgagatcaaaagcggattgttcaccgataatgagtggtaataggtaactaagcacggttccaaaaatggctcgtaggactcgatttaatggccaatccaccaattgtccgttagcctgataagttgcataaaggcgcgcggcttttcccgataactcgcggttgaattgctcagcgagctcttgtcctaaggcagcatcacgaagaacagtggctgctaaaacccgtagctgggcttgattagcaatggcaaactgcatacgatcatgaacaatgaacgtcaaaaaagtgtgtaagtcgggtaaatcttgttcaccgacttcattaacaaactcggttaatacgtttggcattacttggcgaatcataggggctagtagcgcctgaagaatcccatctttcgtcttgaactgcttgtaaactgtgccttcgctgacctgtgccgtttcagcaatttctttagtgctagtgcgatcaaagccttgactggcaaataacgctaaactggcctttaaaacggcttgctgtttagcggatagattgcttttggcgagtgaagcggaaaacaaatcggtaatattacgtgtgtgcatcgcgagatcgcttcccttcaataaaaattgctcgactttatacttgccggtattttcgcatcgtgagtagatttaatccaagaaataataggaagaatccgaataaagccaacacatccggatagaggacggcaagcgactggcctttggcgataataccggttaaggcattagcaccatagtataaaggcatgatgtgagcgatgggttgcagccacccaagcatgtgatcaataggaattaatcccgtaaagaaaatttggggaataaccacaattggaatgaattgcagcatctgaaattcagtgttagcaaaggttgaaatcaacaagcccagtgccaaggcagtgaacgctaatagtaaattgatcaaaaagatggcggggatgctgccaagaatttgaattttgaatacgatcaaggaataaccaacgattagcaatgtctgaataatggcgaaaataccataacctagtaggtaaccgctaatgatttcaccgcggcgaaccggcgttgccagtaaccggtataaggtgccagtggtccgctcgcgcaacaaagcgatgcccgaaatcaaaaagacaaagaagaagacaatgaatcccattaaaatcggcaacagggtgtcaaagtaagttgagtcggctgagccatatcggtaatgggttgttaacgtgtaactcggtgtttttggctgatggggttctggaatctgggctgcgccgcgcgtggcctgtttgagagctgtcgcaagcttttgtaaggtggttgcttggatcttaagcgctgtggctgcggcttgcatttttagtttgatagaagcggcttgcaaggtttgtttcagaatcgcgctttttccttgatcagcgttggccaacgtcagggtcagcttatcgccatcctgcgtgagcacaccggcataatcatgagccttgattaatgcgatgggttggtcatttttgacctgatgcaatcgaacgtgtttggtatcgatcgcctttgttagtgccgaatcgacagcatgaactgctaaatcagccttggtgtccgtattggattgaaaaagaaaaaagatcaacgtcatgataaataaaggcgcgataaacatcagggctaacgtgcgcttatcgcggagcatttcttttaaaatccgattaatcaacgcttcaatgcgcatcttgctgcctccctgcggctaaaaagaccgcttcaatcgagtccgtttgataatctgcctttaattgtgccggtgtcccttggacaatggcagtcccgttgcgaatcatcaataacgtgtccgcttcttcggcgtcagccatgacgtgggtcgttaaaataatggcgacaccctgatccgccagacgatgcaattcatgccagatctgttggcgcagctcagggtcaatgccaacggtcggttcatctaaaattaacaactgcggttgactgatgagggcgatggcgagcgataatcggcgcttcatcccgcctgaataatccttaactggttgctttaaggccggttgcagattgacgacattggcagcataagccatttgtttggtaatctgcgcgtgtgggacgccttgcattttggcaaaaaatgtcaggttctcggcaccggttaaactttcatataaagcatcagtctgagccatgaagccgattttcgcgagtagggtacgattcggcacggcttgccctaaaacgctgacttgtccggtgcgtgggcgcaacatacccataatggtactgactaaagtggttttgccagcaccgctaggaccgattaaagcaagaatttgaccatgatttaaggtcaagttgatgtccttaagcacgatctgtttaccatagccttgggtgagggcgctgacctgaacagcttgatttgtttgcatattatcgcgtcactttctcaataatatagtgagtgctcactcacttgccattatcgccaattttggggtaaaagcaactaaaagtttaaaagtcatcagccaaatcaatcagattgttgtcaaaaggatggcatctaaaagctgcttcaagctgtgttatagcgactgaaaccgcttatgctcccgtttctggccgcgcctgtgcacacctcgtggtataattattcagaagtttgattctaaaccacaatggaggaacgcggatgcgcacctatctgacaaatttattaacttggtccaccttgatcaatctggttgacatcctcgtcgtctggtatgtcatttatcgtttgatcatgcttgttcgcggtacaaaagcggttcagcttctgaaaggcgtttttgtcattgctgcgatcaagattatttcttggttccttcagttgaagacggtcggttatttaactgatttggttattacttggagtgtgccagcactggttattatttttcagccggaaattcggcgtggccttgagcacctaggtcgcggttccttgatttttcgatcgaataataaccagcacgaagtcgaagtacggatggtcaaagaacttgataaggctattcaatatatgagcaagcgccggatcggggccttaatgacgatccagaagagtaccgggctggaggattacattgagacaggtattcccttggatgctgatattagtggagagctgctgatcaacattttcataccgaatacgccgttgcatgatggggcggtgatcattcgggacaatcgaattgcggttgcggctgcatacttacctttatctgacagcaatctcattcctaaagaacttggtacgcgccatcgtgctgctgtcgggatcagtgaagtgacggatgcgttgacgatcgttgtctctgaagaaactggggaagtgacgatcacaaataacaacaacctgattcgtaatttgacgcgtgatgactatatgaagtttctgacggcgcaattagtgccaaaagaagaggcgccgaatccgaacccagttgtcagtttcttttcgcgccggtttaagtcacgtaaaaagaaggagggcaagcaatgaatcgcttatgggataatccatgggttaatcggttgttggctctgcttctcgcgattgggctttttgcttatgtcaacgttgaaagcatcaacaataccagacaaagtgcaaatgatgatacaaccttggttgccaacaaaacccagaccgtgaaagtgccgttacaggtaaatgccaacacggacaagtattttattaccggttatccgtcaaaagtttcagttgcattgacaggaacggcttcattagtcacgatgaccgccaacacccaaaattttcggatcattgctgatcttaccaaactcggtgttggcaagcatcgtgttcggttgaaggcagaaggtttgaacaaggatttgagttattcgatttcgcctaaatccgtgaccgttgacattcaggttcgggacaataagacgatgccgattcaggttcgctataataaagccagtatcgcatccgggtatgcagctggtgagccaaagctgtcgacgcgaacagtggatgtcactggcgcacgatccgtgattgactcgatcgcacaagttgtggcaaatgtctcgctgtcgcacaatacccggagtacggttgaccaagaggtgctgttacaggcgcttgatgagaacggcaatacgatgaatgttgtgttggcaccgcagactgttcatgtaaccttaccgatttctcaacctagcaagaaacttaccgtggagctaaaacaaactgggactgccgtgtcaggacgcacgtatgtcttgtcctctgacacaaaacaggttaccgtatacggagacccaagtagtttggacaagctgagtaaattaaccgtggacgtcgatgtcagcggtattagcacgacgacaactcggacttacaacgtaactgatttgaatgatggtatttctgctgctagtccgaaatcacttaaagtgacggttagtgttggcaacactggtaatgatgataataacaacaatggcggttcaacagcgagcaccagtacttcgagttcgagtgccgcaagcacctcgagtgccagtgaatcagactcaagtacatcaacaagcgacaataatggctgaaagaaatgaggaagaattaagatgacaaagtattttggtactgatggcgttcgtggtattgcaaacaaggaactaagtccggaaatggctttccggctagggcggacaggcggctatgttttgacgcagcacaaagaagatgcgagtcgacgcccattggttttggttgctcgcgatacacgaatctcagggcagatgttggctgatgctttaattgctggcttgctttctgttgggattgaagtgctggatttaggcgtgatcacaacgcctgctgttgcttatttaatcaagattcaaggcgccgatgctggtatccagatttcggcgtcgcataatccggttgccgataatggcatcaagttctttggagcggacggctacaaattgtctgacgatactgaagaagaaattgaagccttactggatgcgccagaagacaaacttccacggccggctgctgaaggattaggtacagtagacgattatcctgaaggcgcactcaagtacacccaatttcttgagcaaaccttggcagatgatctgagtggcattcatgtgtgcttggatggcgcaaatggtgcaacgagtgggttagttagtcgaatttttgctgatcttgagaccgattttgatacaatggcaatcagtccagatgggcttaatatcaatgctaacgttggttcaacgcatcctcaggcgttatcgaaatttgtcgtcgaaaaaggtgctgatgttggcctcgcgtttgacggtgacggtgatcgctgtatcgcagttgatgaacaaggcaatattgttgatggcgacaagattatgttcattcttggtagttatatgaagtcacaaggccggctgaagcaggatactgtcgtcaccactgttatgagtaatcttgggttatataaggcattagaagcgaatggcatgaagtccgtgcaaacggctgtcggtgatcgccacgttgtcgaagccatgcgcaaagatggctataatattggcggcgaacagtctggccacgtcattttgtttgattatcacaataccggggatggcatgctgacaggcattcacttgttaaatgtcatgaagaaaaccggcaagaagttgtctgaattagccgcacatgttcaagactatccgcagaaactggttaatgtgaaagttgcggacaaggaaaactggcaagcttatccagaaatccaaagtgccattgataccgtcgaaaaagaaatggccggtgatggccgtgttctggttcgcccttcaggcactgaacctttgttgcgggtcatggccgaagccaaaaccgaagatttggtttcccgttatgtggatcaaatcgtggatgtggtgaagcaagaaatgggcagcaaggaagattaactgctgtctttatcaaaaatttaaactttattttaaccgagttgtcacgggtctcatcgacaactcggtttttttgtctggtgatagcattcgcaattggcacgttttgaaagcgcgttcataaaattccaaaaccagtgtgcataagaattgggtaaattaatatagaccaatatatatgtttcaagtataccagtgaaaaatggtgttgacatatagccttttaaaaactatagttagctttgctttcaacaataccaataaaaaatctgtctaaaccaatttttagacaaaaatgaaaaggatgttgactatgtgtggaatcgttggcgttatcggtaaaaagaatgcaacgcagatcttgcttaagggattagagaagttggaataccgcggctatgattcagccggcatttacgtgaatgaccaagccggccatgatcatctaattaagcgcgtcggccacatttccaatcttgaagaagcggttacgcctgatgttcaaggcgttatggggattggccatacgcgctgggcaaccaatggcggccctaccgaagccaacgcccatccgcatgtttccaatgacgaacggttttatttggtgcataacggcgttgtgaccaatgctaacgaactgaagcagcagtacttgcaagacattgaattacagagtgatacggataccgaagttgttgttcagctgattgccttgtttgcccgcgaaggtctgtctgctaaggaagcactgcgcaaaaccttgaaaatgatccaaggttcttatgctttctcgatggttgatcgccttgacccaacagtgctgtatgttgctaaaaacaagagtccattactgattggccgtggtaaaggctttaatgtggtggcttctgatgccttggcaatgcttagtgaaaccgatcagtttgttgaactgaaggatcaggaaatcgtgaccttgacggctgatgccatccacattgaaacgattgacggtaaagttgaggaacgtaagccattcaccgttaaagttgatgatggtgaagtttctaaaggtacgtacccattcttcatgcttaaagaaatcgacgaacagccaatcgtgatgcggcgtttggtcgaaaagtataccgatgatcatggcaacatcgttttgccagaagatttgctgaaagctttacagcaagctgatcgtttgtatatcgttgcggctggtaccagttatcatgccggtttagtcggtgcacctttgttcgaacaattggcaggtattccgacagaagtgcatgttgcttctgagtttgcctatcatcaaccactgttgtccaagcacccactgttcattttcctaacccaaagtggggaaactgctgatatccgtcaggtccttgtttcagtcaaggaacgcggttatcagacattaacgatcacaaacgttgccagctcaacgcttgctcgtgaagcaacctttatgttgcagttgcatggcggcccagaaattgcggttgcttctaccaaagcttacacggcacaaatcgccgttgaagcgcttgtatcgaaagcagtcggcgaggctaaaggattgcaggctgctaaggacttcgatgtgatccatgaacttgggttggcagcaactggtcagcaggctttgattgaccaaaaggatcgcatccatgaactagcaactgacatgttcaagaccacgcgcaatgctttctacattggccgtggcgatgattactatgccagcatggaagcagcattgaaactcaaggaaatcagttatgttcaggcagaaggctttgcggctggtgaattgaagcatggtacgattgctttgattgaaaagaatacgccagtggttgcaatcatttctgatccggttacagcagcgcgcactcgcagcaatgcggacgaggtgcaagctcgcggtgccaaggtgcttcatatcgcaatggctagtcaagcccaagatggtgaccaaatcgttgtcgatgaaatcaatccattacttgcaccgcttttgacgattatcccggcacagctcttggcttactttactagtgcggatcgtggttacgatgttgaccgtccgcgtaatctggctaagtcagtgaccgttgaataatcgctaagaatttcatttggtgatcggtgtcattcatgtcaagatgtggattcaatccccagcttggtgtctgacgtcgtagcggatcgtgatccatgtatataaaaaagtgttgcatcacgggtatcctcgtgatgcaacacttttttaataagcacaaattaagtatttgtgcgctaagtgacacgctgcaaatcgggaagaactttatttcaagtaaccttcactcaaagtcataaactgttgcgcatctttggcggctaaatcaatgccttgctgccagaaatccgtttgcgttaagtcaaccccgagatgttttttcgctagtgcttctgttgtcatattcgccgtatcccgcaacaaagcaatgtaatcatcttcaaaattatcagatgcttgggcctttgcgtaaataccgctagagaacagataaccaaaagtgtaagggaagttgtagaacggtgggttgtcgaagtagaaatgcagtttgtctgcccaatacatgggatcaaaagaacttagaccacctgcataggcttgttgttgtgcagtcgtcatgagttctttcagtcgtggcacactgacaattcctttttcccgttcctgatagaaactgtcttcaaacaggaagcgagcatggatatttaacagcatcgccaatggattggccattttagcgtctaacaaattaagtttctcagccggtgaggttgctgctttgactgtggcatctgcaacgattaattctgcaaaagttgatgcagtttcggcaacattcattgcataatcttgacgcaatagcggcatatctttcaaaatactgctgtggaaagcatggcccaattcgtgggcaatggtggaaacaccagatgctgaaccatcgaaggtcatgaaaatacgactttctttgacatctgggacgctggtcatgtaaccgccagcgcgcttgcctggccgatcttcagcttcgatccagccattttcaaatgcctgtttggcaaaggcagccattttaggtgagaacttggcaaagttgttcacaataaattcggcggcctcatcgaaggtataggtctttggctgaaaatcgcccacgatgactggcgcccattggtcataccatggcattgttggcttaccagttaattcggccttgcgcgtgaggtaagcagcaaaaggctgtttgttggcgctgatggtgtgccacatttgatccagcgtggcacgttgcatgcgattgtattgcaacggtttgaaaagataatccggataatgatgcaaccgataattcgtaagccggaagccggcaatgtgattcagggtctcaccaaacagactggcatgatcgtcccacgtttgttcccaaacgttaaagacttgttcacgcgttttagtgtcaggatcgccttcgaatttattctgggtttggccagcactaagctctgtggttttgccatcttgtgtgattggaaacttaagactgccactcaaggtggtgtaatgatcgctccagccagtaaaaccatcgactgccagatcgttaatcatcgtttcggtttgatcatctaacagttcctttgcctggtcgcgcatctcttgcaagccaaaacgactagcgcttaaagctgacgtggtcgttagctgatcgaaagctgcttgtgacatggctgcgagttttttggccagcgggttgttaatgttttgaaaacgggtataaagtgtcgtgagctggccttgaacaggtccggttttcagattagctgtatcagcgctggcaatcatctcgacgaagctgctagtagtagctaggcctttgccaatgtcttccagcagttgccaaagtgtgatgaaatcggtaaactcaggagcatcgtggtcagggatccaagcggctacttttgactccagttgaggcaatttggccgtcacatcgctaattcggtcggcaagttgcggtgagtcaataccaccggggaaaatcgaatcgaggttccagttaattggataagacatattggcacttcctttcgaaatagctttattataccgtagatgagaaaagtctgagtgaaagcaggtagaagtttgtgacgtcttttaaaaaacattgggggttgtggctggcggcagtccttttgtttgtcttgttctttagttccagtatgacttacaaagagcaaacaacggtgccgttattggaacgcttgttacacaatgaaccgtttaagcaagccttaagtggtattcattttaattatgcgggtgaacagcaatcaattgctgaggtaggctattttaaatttgttgaatttttcattcgcaaaggtgcgcatgtcagcatctttttcctattaggtcttggtctgacacaaggcacgtttatgtatcagaaaaatcgttggctgcattggccgctgatggtcttaagttgtaccggtgttgcggcatttgacgagtttcatcaaatgctgacaggcgggcggacaccgcttttccaagatgtgatgctcgatactgctgctgcggctgtggccgtgaccttaatgtggttatggttatggcggcagaagcgtcattgaataaagtgccgatctttgctataattttaacgattcatatgctcctaaacttacgaaaagagggtttatcatgtcaggacattccaaatggcataacattcagggccgtaaaaatgctcaggattcgaaacgtggtaaaattttccagaaattatcacgtgaattatacatggcagcaaagcaaggtggtcctgaccccagtggtaatccttcccttcgtttagtcatggataaagctaaagctgccaatatgccaaaagacaatattaagcgtgctttagataaagcaagtgatcgtgatgcggccaactatgacgaagtgacctatgaaggctatgggccaggtggtgtggcgattttggttgaagctttgaccgataatcgcaaccggacttccagtaccgtacgagtggcgatcacccgacacggtgggaacatggcagctgctggtgcggtttcatacatgtttgatcgaaaaggttatctggtgattagccgtgatgaccttgatgttgacgaagatcagatgctagaagatgcgcttgaagccggtgcagaagatatgcagacttcagatgaggcattcgaaatctacaccgatcctaaagaatttgctcaggttcgcgacgcgcttgaggaaaaagggtacaagtttgtccaaaacgaactgacaatggttccgcaaaacctgaccccgattccagaagataaagttgaacaattccaagctatgattgatcaattggaagacgacgatgatgtgcaggaagtttacacagctggcgactggccagacgattaatgcatcgattgatagcttgtgatcaagacgagggaaaatcctcgtctttttttctgcccaaaatagtcaagaggacggggtgatatctgacgctcgcgaactcttttaatacagggggaaaaacgatgcaatcggtgaataagcttttgacaattgcgctggaaaagggtgctagcgatatttactatttgcctagtccgcaaggttatttgattcgcctacgggtaccgacgggcttggtaacaatcgccgagcgagacagcaaacgtgggcagcaagaaattaattacttgaaatttatggcgggcatgaatgttgccgaacatcgccgcgttcaattgggagccttttatcaaagggaatcagcagcttttttacggttaagttcagtggctgactttcgcggtggtgaatcactggtagttcgcataatcaaaggcattccagatgctgcaggcgcacgtcatctgttagatcgtctgttgggtattttactgcagaaacgcggcatgctgaccctagctgggccgactgggtcagggaaaacgacattactctatcagttaacgacgcgtttggcggaatcacgaatggtcttgtcgatcgaggatccagttgagatcaatcagccgcaattcttacagttgcaagtcaatccggaggcagacatgacctatccgcaattactgaaggcggcgctgcgccatcgaccagacgtcttgctgattggagaaattcgtgatcgacaaacagcgcaaagtgcttgcgaagcggcgattagcggtcacattgtcctagcgaccgtgcatgcccgatcagcggcggatacacccttaaggttgagcagttttggcttgccggatgagttagtagcggcggcattgacggcgagtgcggcgatcagtttgcagtatcggccaatgattcacccagtggcggaagtcgtggttttcaagcaagtaggacaagctgatcaggaggtggtttcgtgagcatgccgctggtgattcaggaacggttttgccgtcaaagcgctgcgttaattgctgctggttttagtttgccggatgtgtttgcttatttgcgtgtgagtttaccgaaataccggccaatttgggaacgaatcgaaacggatttggcttctggcatcggattgccagaagcagttggccatcaggcattagctcccatcctctttcaacaactgcaactagcacaggttcacggggatttggcaaaagcattggccgtggctggtgattacttaggcttgcgagtgcggaatcgtcaacggattggtcaactattaatttacccacttgtgttactgggcatgcttgttaccttgcaagtggtcgttgtgtttggcgtgttgccagccttggcgttaccacaatcgcatttagtgcatacgcagttaatgaccatgggtgggggcttagccgccgggttgctaatatggctcgggtggcatcgactgacgttggctcaacgcttgcaactcttacaacgattgcctggtgtccgtggcgtcatgcaagtgtactatcagtttcagttcacagccggagccgcccacttcttactggcaggtgctgagattgccgacttttgccgacacttgataaccgttggcggtccgttgggtgatttaggagcacgcattcaacaaaagattcaacaaggggctgagttggccgatgcgttacacgaagcctttgtgccacctgaagttgcccgtttattgacaatgggccagacacatcacttagtggcgaccggcttaaaactttttggtgaacaactatttttacagttgcagcaacgtttagaacgactggtgaacttggtgcagccattgctgtttttgcttattggtggcgaaattttactggtttatttgcaaattctcttaccactctatcaatctttcggaggatgaccatgcgacgcaaacgattacgggcttttacattgattgaagtgattgcagcacttggggtcattattttattgacgttagctttggttttgacaattcaagggcaaatgaaacgtgttgaaggtcagaatctaaaagctacggtggcaactgtgaattcacaaattgaaatggcttataacgagccggatgctgacaagaaatcacttaaaacaattcctgatttagtcagagaaggcgtgattaccgatgcgcaggcgaaggacttggaaaaaggcaaggcaacgatgagcggtgacaatccgccgaaatttaaagttccatgaaacggctgcgtggctttgtgatgcttgaagtggtggctgttgtggttgtgctggcaggattgacactggcggccgttcccttagggcaaagcgtgattcgccgaaatcaggaaaccaaatttctcgaaaccatgcgggaacaatggggattattagggatgaaggcatatgccacgcataaaattggcaccatgtctgtcaatgatgaggcacgtcaggtgacatttagtctttttaatggttcaaaacgaattttgccatttccgccatccttgaaatatgacgataaaattcctacaaaaacgacgagagaaccatcaggtaaattgaaaggcaaccgcagcgtaaattttctcagtcaagacggctattactggcatataaccctacagtttgaatgggggcggttcttattccaaaaagtaccaaaacattaacaggttctttgttaattgaacatcttgcagctctgggggtgctcttgctggcggttggttggttaatggtgttagtgcggttatatgaccgagttgtggttgaatccagacagcgaacgacggcctattatgcggcacgggtggcgcttgttcatttgccagtaccaggcggagagacgactgttcaagtcggacctgatgtgtggcaagtaaccgtcaatacgcaggaggtaaaggcgcatgcccaaaagggtcgatcaacatatacgttcacgccttaaaggctttactttaattgaagtggtggtcagcctgattttacttgcggcggtcatgctgttatggcgaccggttttattgcatgtcacgcggttcacgcttcaagaccatgtgctaatcacgtcattgcaagcagagcatgacttgcaaatgtttgtacgagataaaaagttgcggtctgtggccttaatgtcggtaagggtgagaagtcccgagaaagcttacacgatcaatttttatcaggccaaacattttcgcggtatggttcgtgtgatgggatctgaaaatgggcatatgccattatttacgcatctaaccggggtcaattttagcaaggtagctcaaggctttcgctatcgtctgtatttgacgacttcgcagaagattgacggtggggtgcaaatcgatgaagatacgcggtagtgttttgatcaacacactgatactgtttgctttacttctaatgctgactgttggcgcgatgcaacgttttcgtgattggcaggaaagttatcaggtgcttgaacaggtagaaaagcgccaatttacggaggcatacaaccattggcgagaacagatgtctgataaatcgaaaagcgaggctgattcctcgacttcagctggcaaggaatctgatacatcagctattcgatcagcgccgccagcgattggtgagaccaaagaagcgactaaggaacagcttgaggcaactagatcagggattcacgcgcttgaataagcttttctcaatcggtacactggtaagcggagtgtcggcgatgaccagcgcctgcacgcatcgttttttaggcctgaaaccgtattgatagggggaagcatcttggcccacgaacatctagagaagctgtacaatgttttggatgaaagcacgacaattttgcatcaacaattgaaaacatcttttattgctgctgttattgaggcgggagaggatcttgcgtcgggcaacgtcatgcaagaagacggtgttcccaacgatgaagctaaaaagaagctaacagcgttgtttgatcagatcaaactcgccacctatgagccggaagagattcgtcaagccattcaattagtgcttgttaaggcaatcaaggtagatggcattgaacccaataagcaagtcacgcctgatgccatggccagtcttgcgacatttatggtgacggtttttgcgcaacatctgccaaaaaagatgcaagtcgccgatctggccgttgggacggggaatcttttatttgctgtgatgaatcagctccacaatgcgcgtcaggtggcagtcaaaggctacggcattgataatgacgaaaccttattagcagttgcaggcatgagcagtacgttgcaacaattagatgttgatctttttcatcaggatgccttagataatcttttgtttaaagacatcgatgttgttgtttctgatttgccagttggttactacccggttgacgaacgcgccaagcaatttgagaccgcggcggccaagggacattcttatgcgcatcatttgttaatcgagcaaagtatgcgggtcttgaagccaggaggattgggtttattttatgtgccgagtcaggttttccgttctgaagaagcggcggggctgacagcttggctggcgaagtcgacctacttccaagggttattgaatttgccggaagatttctttgctgaccaaaaggcggagaagagcctgctggttttacagaaaccgagtccggatgtcaagcgtgctaagcagatcttgttaggccaatttccggatctaaatgaccgcgatgcttttgccgcgtttattgacaaagtgaaggattgggcagctgctaatattgcgtgattgattgatttttaagtaaccaaaaaggagagctgacaaacgcttgtcttgtcagctttttttgtcgtttcaaaacacttttcatcttgtgatagcaaggcggaatggctgctgtcacaggatttaggacgttagaatagactttactgatccggtcgccactgcctttttaaactggaatcggttagaatgggttatcaaacttaaggagaattaatatgtcattattaaacgtggcctacctgctgattgcaattatttcagttggtgtgaccatctttgatatcattcaaattcggatacatgcgcaaccaaaagtctggcgtattcttttgtatcttgcggtggcagccttttctctggtgttgaccttgcagcaaagtcaacattttgacgatcttgtcagcggcgcctttattgtcgttatgtttatctgttttgcctgctggcagaagggtcttgctgatgctgcgatgattggcgggcttggtagcattcgattgtatcagaatctttctggcgttgttttacaggcaaatgctggggggacgctgctattggcgcaagccggtcaagtgatggttttaaaactgcagtttcgccagtcgccaacagatctacaaagctttttggtcgataaaatgccaccagaacagattcaaatcgtgacagggtgatcagttgggcgttttctgaaaatggtgtataattttttctgatccgattcaaagagctgggatatttctgcatttgcaaagacagaacctgttatgacctgatttttttcgggttaacacgtttataggaggatgagcatgcaagccaagaaagatgacaagcccgaactagcgcgtcacttgaaaagccgacacgtgcaactgattgcgattggcggaacgattgggacaggcctttttctaggatctggccaatccatccacaccgctgggccttccatcttactagcttatctcatcacaggtgggatttgttttctaattatgcgggcattgggtgaattgctaatgtccgatgtgaattcacatacgtttattgattttattagcaaatatatgggaaaagatgctggttgggtgactggctggacctactggatttgttgggtggcggtcgccatggccgaagtgacagcaatcggtctctacattcgattctggttgccaggagttcctcaatggctgccgggcctgattgcactggcagtgttgctgctaatgaatctggttagtgttgggctgtttggtgaggcggagttctggtttgccttgattaagatcgtggccattattgggttaattgcgctcggcgtctttatgctgtttgtgcactataaaacgcctgttggctatgccagcctaagcaacctcgttaatgacggcggcttttttccaaaaggaatgagcggttttctaatgtcgctgcaaatggtggtgtttagtttcgtcgggatcgaaatggtcgggttgactgctagtgaaaccaaagatccgcataaagtgattccagaagcgatcaatgagattccgatgcggattttactgttttacattggcgcattgtttgtcattatgtgcatctacccatggcgcgatgtgtcacccgttaatagtccttttgtcgaggtttttcgtaatgtcgggattccagccgccgccgacattattaattttgtggtgttgacagcggcagcatctgcctgcaattcatctattttcagcactggcagattactcttctcactgacattaactggtaaaagcaagtccgcacgttggactgctaaactgtctcggcgacaagtgccagcgcgggccattatgatttcaacaggagccattgctgtggctgtcattttgaacctttttttaccggagtctgttttcgcactggtttcaagtgttgctacaatcagctttttatttgtttggggcatgattgtcctcgctcacttgcgctataagaaacaacatccgcgcggaacggattttccaatgccattttatccttattcgaattatcttattttggcgtttttagggctgactgctgtgattatgattttcgatcgggcaatgctgtccgcattgatctttgcggttatctggattgcgacgttattcaccttgcgccgattgcacgctgatcataaagctcacgaagacaaaacaaaagacggtatttaatctgattgagtgagcactcgcttcaataacggaaaagatacttgaggactcatataaaagtgaaaataattttgagtgttcactcaaaattatttattttagggttgactaactttagcaacgtgttatgctattgatggttcgtagatcaacacgcatccgtcatcatgatggcggtttatagagagaggggccgacaatggcaaaagtcgtgacatatcgccacttgacagacgatgttgttgctgcacctgatcaagaaaccgagatcccggataattatcgctgggagccttcatggcggttccggatcaaagcaaatttggtttatgcgggttcttggctttttgcccaagggtattgccgcagcgtcttacatgttcgcaatcgcaaggcctttcgccaggctgccgggcgcggttattttgtttatggtaatcacactcagccttttggggatgttttcacacccatgcgcgtgaatcagtcgcgccgggtttttacgttggcatcaccggctaatctaagcgtgccaattctaggacgaatcgtgccttatggtggcggtttgctggtgccaagcaagttacatcaattgcgcccgtttgctcaagccattcggcgcgttatcaaacaacgacatgtggtcatgatttatcctgaagcccatgtctggccttactataccggcattcggccgtttgaaaatggtgcttttcattatccggtgacaactaacgcaccagtatttgcaaccacaatgacttatcaagccgggcggtggcggcaaaagccacgccggatcttgtatgtcgatggccctttttggccagatgaacagttaccgctcaaagcgcgtcagcagcagttagaggcgcaagttcgaacggcgatgactactcgcgccgccttgagtacggcaacgtatattcactatcagcagcgagaggaggcggattcatgacgatgaacatcatgttttgcggtgatgagaagatgacggatggcgttttgattgctaccttgtcattgatgcggcataccgatcaaccattgcatatttatgtgttaaccgccaagctaaaagtcaatggccatgcttaccagccattctctgcggtgacggctgagcgcatggctgacttgatgcggcaggagaatccgcagcaccgcttgacgcggattgacatcactgatttatttatggctaatccgccgcaagcaaacatgaccacgatgtttaccccttattgcatgttgcgtttgtatgctgatttgattcctgagttgccagatcgtgtgttgtatcttgatactgatattgtgtgccgtcgatcgtttagcaacctgtatcaagaaccaatgaaagacgtcgatattgctggtgtattggatcattatggcaaatggtggttccatcataaattaacctggtttgattatattaattccggggttttgctgatgaaccttgctagcattcggcaagatggcttgctggttcgctgtcggcgcctgatccgccatcgttggctgtttatgccagaccaaagtgcactgaacatcattgcaaagtcaaagcagattttgccgcggaagtataatgaacaacataaagtcgaaacggatactgtcttccaacatttcaccacctcattccgtttctggccgcggtttcgtattgtgacggtcaagccatggcaaatcagtgctgttcatcatcaacttggccttcatgaatatgatgatctattaaacgattatcgtcagttggccccaaaattgaaagaagtgtcttaaatgcctcaacaaactacggttcccattttcttttctgtcgatgacggttacgtaccgtgtctggctgttgctttgacatctattcgaacgaataaagatccgcaaactgatttcgttatcaacattcttaacagtggtttacttcaaaagaatcagacgcggcttgcggctttagcagcgccgcattttacgattaattttatcgacatggacgcggtcacgcagcagattagtggcgacacaaataaactgcgcggcgattatgtgacgttgacgatttatttccggctattcattgctgacatgttcccgcaatatgataaagcaatttatattgatgccgatacggttgccgatggtgatttggcagaattgtttacgactgacctaggcgataatttagtcgctggtgttgcagatccggtgatgatgacatacccggaaaccattgaatacattcagcgtgattttggtgttcaaccaggtgaatacatcaattccggggtattgattttgaatctcgcccagatgcggcaggaacatttctccgaccggtttctgcatttgctaaaaacgtatcattttacaatgattgccgcggatcaagattacatcaatgtgatcgcacagcatcgaatcaagtacctgccaaaaacttggaatatgcaaacaggtgtcccgactgctgctgaatcaggcggcaagttaattcactacaatctttttggcaagccatggcattaccgcgatgctaagttagcggcaaacttttggcattatgcgccagcatctggttttgaaacggatttgaagcagcagttggcggcgtttacgccggctgatcaacaatcggatcgggacagcatggcggcgatgctaaaaaccgccgttcaagtttgccatactgataacacgatcttgaacgcaatcaagcatggcgaacaggtggcgctatgaaatccggcaagtttgttggaccagaccgagccgcggtgatcgaaaatattcgtcgcgcggtggcggctaaggcattcaacgttaaggtggaagaacacgacccgactttctcggaagcacaagaaacagctattattgatcattatttacatcagcggcaacgctggacattccgagtgaaaactttgatttgccgattgctggtgaatgcctatgcagtgagggtcaccagcgatgttgaagttgttggggttgaaaagattcgggcgattaaaagcggtggtgtcatcacgagcaaccactttagtccgtttgaaaatatggcgattcgcaaagctgtccgtttagctggccgccaccggatgtatatcgtgagtcaagacaccaacttggccatgaaagggttgctgggatttgtcatgaattatgacgatacgattccactatccggtcgtccaagttttcttaacggaccatttatgcaaatgctaacgaaggccttttctgggcatcattgggtgttaatttacccagaacaagaaatgtggttcaattatcgcaagcctcgtccacccaagcgcggatcatatttttatgcggctgaggccggggtgcccattatctcgtgtttcactgagattcgtgatttgaaggcgcgtgagaatgatcaattacgcgaggtcagttatgtcctgcatgtacttgatccgatctacccggatcgcaacttatccgtcagagacaacagttttcaaatgatgcaacgcgactatgctcaaaagcggcaggcttatgaagctgcttatggcaagccgctgacttatgcattcagcgaccaggatatagctggttgggacccgcagtaactagcaaaaaaatttttatttcatttaaaaagaaaatgtgctcggcacttgttggacaatctgtccgccaagtgccgatttttttgagcatgaacggatcgactaaataaccgaggccaaagtgacagtaaatgtctcagtgccacttggtatgctgcggtgaatgccaaccgtaaccttcatagtgatcaattgacagtggcgcgcaggtccttcaccaacttgcttgttatgctataacggaagtaagaggttatatttgaaggaggctacgctttgatagatgttataaataatcaagcttttcatcttcacaacgatcaaatcagttatatttgcgctttgctgccgaatggtcagctcgggcatctttattttggtccgcgcttgtcattaactaagaacgacttagcctatttgtctcaaggcccaagtccgtttgcgtggatggccaatttttcggacgatcaggaatttgccttgggtgatgctcagcaagagtatcctgtttacggaactggtgattttcgccaaggcagcctgagtgtgacccaagatgatatgccaatttatccgaactttgtttttaaagatgatcaattgacgcatacgaaaacgcgggacttgcaccatccgacgagtttcggcaatccggcattgaccgatgtgctgacgattcatcttgaagataaaacggcccaattgttgttaacgttgcaatatacgatttttgccgacagtgcggcaattgttcgttccgccacactaaccaatcaaggggcagcaccagtgatgattcaacgcatgctgagtggcgttttgaacttgccgcaaggacggtatgacgttgttcatttatctggtaattgggcgaaggagcgtcatattcaaacgcaaccgttaactcagggaacattttcagttgaatcgctacgtggtgcctccagtcatgaacagaatccttttgtggccttacatgcagcgggacagccgtttgcagcaggcgatacctatggggcgaacttgatttattcgggcaactttctggacagcaccgaggtcaacgaatgggatcagactcgattgctaactggcattcatcccgcatcgtttagttggcggttggatccaaaaaccagttttaccacgccagaaaccgtgtttagttatagctctggtggtcttgccggcttagctcaggccaatcaacgttttgttgctcgccatattattgatccgcaatggcgtcaaaagcagcgtccggtcgtcttaaacagctgggaagcgacttactttgatttgaacgagaagaagttgctcaagttagcggcactcggcaagcaggtcggtgtggactgctttgtgctggatgatggctggttcggaacgcgcgacaatgatttgagttccttgggtgattggtttactaataagcataaatttcccgacggtctcggccattttgctcaggaaattcacgcgatgggcctgcagtttggcctttggtttgaacccgagatggtttcaccgcgatctcaattcttccaagcccatccgaattgggtcgttcgaccaaaaaagggtcgtatctcgattacgcgtaatcaatatgtgttagacttcagcaaccccgctgtcgtcaataatatttttgaacagatgcagaaggtcatcactgaaaccaacttggattatgtgaagtgggatcttaatcgcagcattacagaggccttttcaccgtatctcgaaaagatcggtcatccgcaaggcgagttcttccatcgttacgtacaaggcgtgtacacgctctatcagaagctgctaacgtcattcccgcatttattgattgaagggtgtgccggcggtggtggccgctttgatctgggcattctgttctacagcccgcaaatttggactagtgatgattccgatgcgatcgaacgcctcgccattcaatcaggcacggctttggcctatccactgagctgcatgagcaatcatgtgacagccgtgccgaatgaacaggttggtcgatcaacgccgctggtcacgcggtttcgggtggcggcctttgggattcttggttatgaactggatctgaccaaacttgatgcgcgaacattggctacgatcaaggctcaaattgcctattaccacgctttacaaccgctagtactgaaaggcgactttagcctattgttaccgcgacagtccaatggtcagaatcaggtggcgtggttgctcagcgctcatgatcgcaagcaccttgttcttggctttttccgagtcttggctgatgcagacagtcgcaccgtgcagtatatgaaggtaccattggcaaaatctgacacaccgtattgggtcaatcagcacacaggcccaatttcgggggatgtcctccagcgcgttggtgtgcgcttaccagtccaattcaatggtgccaatcgcgcacaggctcagttaatcggtgactatcaatcggcactgttgacctttgatagtgtggcaagtttggatcacagtgaaagccagcagaccgatgccgacaagcaaacagttgcctattaaatgtgctgccaaacagctttggtttgacaatggctgttcagatcaggaatatgagtaaaaaaagcccgataaacgagttgcaagtatcagttcttgacttgcagctcatctatcggacttgtttgtccctttttagtcacgatgcttgcttaccagcaaaataccagtaaccaagctcatggtaccggcaacgatgccaacagcaccagcgacaagtgtcacaacaccaacagatcgaaaaaaaattttgctcaagagattaacacctttctattgtttggcaggatcgtaactaacaacaatgcatgaatcttgattaggattctcaatccgttcatcgttcgattcattgttcaataaatctggttcatcgctatgacgaaagcgcgcagtaaaaacattttcgtcattaatccgtttaatgtaacgcgcagctgcgccgggactgaccaattgaatggacgttgatttgccatcgttaacggcgtcattcagttcggcaacagtacctgctagatcgtcgtgcgaaaacccagcagattctaaaatgctgagaagtgcttttactttgtcgttcatgattttcctcctacttgtcattttcagactcacggcactattgtagcaaatatttacttacggaaggtaagcttttgtctgctaggtgacgacaaggacacattttccaaacaacccaaaataaaaagccccaaaacgctgatgtaccagcattttaggactaactagaagtaagggaaaatgtcataatggaggtgaggagaatcgaactcctgtccatcacccctgctacatgcagctctacacctatagctgacttatttaaaattcgccgcgatgtcgcgccagccagcaaggctaacacaaggcggctaacctactagtctcttgttaatgcctcaggtggcaacattaaccgtagctcaatcatttgagacccagacccgacccttgagcgaagtcggaaggatcacgctagctggttattaagcagctaaagcgtaagaattttcgttctttgcagttatattaactgttccgttgatgacggagccgagcctccgaggtgcactgcatgtgcgaaaagcaatgtcgagaccattacacccccgattaaggtgcaaacattatgataccacggtataattaagcttgtcaaaatgtttggttttagactggcatcaaattcggatttaagctatttttatggaggcatgtctatgattctacttattgccggatgcatgcaattactgatgggcatccttcttgctgtttttcgaccacgtcatcaatctggtttttggggctacacgtcctatcttgccggggtgaatgccgaaagttttcgcttggcacaacgttggttttgccaagcattgatcatcacaggcgcacttgaagccggtgcgggctggttgatccattttctggcatgggacaatttctttattgtttggctttttttggccgtcatgttgtttctgccaggatttgtctataccgagacgcggttaaagcattatttgcaagcccatgatgcactgccttatgactacgtgtcaccagacgatgcaccgaaaccgcaacgcaaaaaaggctttaaagatctgtgaaatgaggggtacatcatgaaattattaatgatcgaagataacacgagtgtcgccgaaatgatggcgatgttctttcaaaaagagaaatgggaagtcgtcaacgcctatgatggtgaagaaggtcttgctaagtttaaggaagcgccggacagctttgatattattacgcttgacctcaatctgccaaagatggacggcatgcaggtcgcaaaagaaattcgtaaaatcagtcaaactgtgccgttgattatgctcacagcgcgcgatactgaaagtgatcaggtgttgggactggaactcggtgccgacgactatgttaccaagccattttcaccgattacgttgattgcacgtattaaggccctacatcgtcgggctgaggtaggcgccgaagtgggtgctgagcagacaacaagcgagccgcctgacggttttgatgttgaaaccgatcacttcaagctcagtaccaaaacacgtgaagcttatttggatggtaagcaaattgaaggcttaacaccaaaggaatttgatttactgcataccttgtcgaaaagtccgaagcaggttttctcacgtgaacaattactgcaattggtttgggattatgagtattacggtgatgaacgaactgtagatgcccatattaaaaaactacgccaaaaagtcgaaaaagtcggtccgcaaattattcaaactgtttggggcgtcggctacaagtttgatgattcggggcttgatcgatgaaaatgctctaccagcagctgattggctttttctcagtcattatggtgaccttagtgattgtctcgattctgtttattcggtctaccacgaacacggtttgggaaaatggctttaaacagttagagcaatacacggatgttttaaaaaataatgcggttgatgaaaatacttacgtcatcaatgccagatttattcaaaatgctgaagagattttaagcgatcaacacgtgcattttgttatttatgatgccaataacgttgctaaatatcctgtgtcccaaaaaggtcagatgccagcgatcaaggcaagctattggaaaaagctaaagcaaggggcggctgttgccgtcccggagatgatgacgaatccaatcagcggccatgcacaaagcatgacgatctattatcaaccggtttttctgagtgaaaaattactctttgtgattgccgcctttgcgccagttgagcaaattcaaagttcaattagcaaaactgagcataatttgcttatcgcgttcgtactgtcaacgcttgcggcgttcatcatcagttatttcattgcgtcctatcaggtgcggcggattaatcaattacggcgcgcaacgcatcaagtggcagaaggcaattatgatgttgaagtaaaaattaaaagccgcagtcatgatgaagttgcggaactggccgatgattttcgcgacatggtgacctcactaaaagctagtcagcaagaaattcaacggcaggaagatcggcgccggcagtttatggctgatgcggctcatgaaatgcggaccccgctgacaacaatcaatggcttacttgaaggcttggcctatgatgccatccctgaagaaagtaagggaaagagtatcgaattaatgcggaacgaaacgaaccgcttgattcggcttgtcaacgagaaccttgattatgaaaaaattcggaaaaatcaaattttgctcagcaaacagacgtttaacgcgcgcacggatcttgataacatcgcggaacagctggcgcagaaatccgaagaggctggtgataagatcacaattgatgccccagcagatctgccgacatatgctgatcatgatcggttcgttcagattcttttcaacattgttcaaaatgcggtccaattcactaaaaatggtcaaatcactataaaagcaaaagtggggtatcatcagactgaatttgccattagcgatactggtattggtatgtccaaggatcagatgaagaatatttgggagcggtattacaaggccgatccatcacgtaaaaacaccaaatatggtgagtccggtttgggcatggcgattgtgcatcagttaatgggacaacacggtggcaccattcatgttgactcgaccctaggcaaaggtacaacctttacgttgaccttcccagatgaagcgacagcgcctaagcaaaagcagccaggagccgatcagcagacctcatcatgaagaagagacaagttcaagcagcgtcaagatacaccagaaaaaggccattaggaccgttcgaaatgatcatcacgctcacgtgaattgcctgattttgttaagcaaaagttttgtcgcgtgtgatggctggcagggcttttacaatgcattagctgcttagccaaaattatataacaaatttggctactgggttgcgtccaaatcctcacaacgacggctttgcatggaaacgtgtataatagaattaataaactaaaaggagacgcatatgaccattcgacgaatacaacaaaatgattttgctgatgtagatgccttgttacatgcagcattcaatgccagcaatcgcggttataacggtgaggcagagctagttgccggactgcggcgtgatcctaattatgattcagcccttgaagttgtggcgatgatggacggtcatttggtcggctacgggctaatgaccgcggccagcattacgccagatgcccatatgcaaggggtggcgctggcaccgttagcagttgcccctgaatatcaaggcggtggcattggggtcgcgattgtgactgaactcgacatgcgagcaactgatttgcggcgtgattttgtcagtgttgtcggcgatcgacaattctttggccgacttggctttcaaaaagcagccaagtacaaactcgatccgcctttcccagtcgtcactgaagaccatttgattaaggaacttgtgcctggtgttttggcaagtgttcgcggcaaggtcaattatccagcaccttttttgactcaggtagcgaattaatcattgagaccaccacattaaaaaaaggagtcgcgttgttcaaaacgcgactccttttttaattatttttgtttttcctgatccttgtcgtgatgatgagccatgcggattgacccaatacacagaccgccagtgactaaagcacttcccatgagtgtattgtcgctaacatgcggccagcattcaatgaagacgacaaagccaacgatgaccgcgactaccacaaaatgccacgagaaatgatgtggatgatatgtatgctgtaccttcatgtgaaggcccccttataaatgcgttcgcaggcgcagaaacctgtccataaacatttgaaacccaactggtcaaagacccattcatttaagcttcaagtcacggatgttcaggtttctaaacgtgtccgcgcacgctttgtatgaattaactaatactccccgcaatgacagtcctagcctaccgcaaaaacgatcaagattaaaggcacttcacttaaacgctttcaggctcatcaaaatgtcatcatccatctggtcaaaaacgctgctatttttttaaaagaccgtaaaaacggtctttttgcttgactccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggtctcaaaatttttagcacaccaagacgcttctacaacgttgtcagccatgcagagatttcggccttcttttgggcgacattgtcacccgccataccaaatccttgtttgacttgcagttgcccagctgcctgtttaaacgcctgttcataggcgccgggtgtgccagcatcggtataaaaaggcctgaatacagctcgactaccttgcacctgttttagaaaactcaaaactggtgttgatggcgctgccgaccaaaccggaccaccaaccaagatcgtttcataaccggtcagatcaggaataaccgttgtcagatgcggtaaatttccggacgctacttggtgttttgcccgaccagaggtgtcatacatatctgacgaaaaagtttgctcaggaacacgtagagctaacaggtctgcatctgtcgcctgttgtaaatatttcgccaatgtagcagtatgccctgaccatgaataatacacaatcagtactttacttgccatgacagtctcctttaaccttcaaccacgattagtgacttaatggccttccgctgatccatcgcatcataagcgtcttgaatatgttcaagatcaaagcgttgcgtgaagactttgcctgggtgaatcccgccattcaagacggctttgagcagcaattgtttgtcatctgtcgtgaccgaagcgatccccccacgcagaccaatatttcgccagaacagattattcgtgttcatctctggcttttgaggtacgccgacacgacccacaactgcgcctggacgacctactttagtggcagtatccactgactgttcagtgccaacacattcaagcacagcatcagcacctgcgccgttcgtcattgctaagactttctgaaccgcttcatccccacgttcgggtacaatatcagttgcgccaaaagcaatcgccattttttgccggtcttcatgccgactcatcgcaatgatgcgcttagcaccgcgtaacttggcagcaatgacgccgcaaaggccaactgccccgtcgcccatgacaacaactgtatcgccttgtttaacctcggcgcttgcagcagcatgataacctgtcgccatgacatcagccagtgtgacaaatgaattcaacatctcatctgaataatcgctcggctgacccggaattttaaccaaggcccagtttgcattcgtgaaacgtaaatactgcccctgatagccaccattgccgcctgcttcctgattcatgcaatcaccatcaaaaccggcaaggcaagccgcacagtgaccgcaaccatgtgtaaacggcgcaatgacaaaatcaccgacatgaatatcatgaacttcagcaccaacttcttccacaatgccaatcgcctcatgaccaacaagactattagcgtctcgatgtgagatgccgcggaaccaccataagtctgatccgcacacactggctcgaacaatcttgatgattgcatcagttggcttttgacgctgcggttttggtacatcttgtgtttcgactttacctggtcctaaaaaaacagctgctttcatttgaaatacctcctaaatgtgagcacgagccagcacgattaccaaccggcgtgtaagtgaccttgggcgcgatggtcgcactttgaccattacaaccaaggtccttacacgcagattgctgcgctggcgagcgcgttatcgtgagcgcttttccccagttaataaaccggtcgatctgatccggccgtatcaggatcggaaatcccgacactgtcgtttttcaaataatcaggatccgcaatgatcttaagcaccacgtcggccacactcttgcgtgagcccgaaactccgacataagtttcatctctatgcgtcagttgatacttaacgtcacgatcatttagccaaggtaggcgtaaggttgtgtagtcgagacccgactgttcaagaagttgatctgacttcagagctgatggtaacccattgccgatagtcgccttgttccacttgccaaaggtgcctggaacttcgtcatagatcccgagaacattcgtataaatcacccgctgcacgtgaccagccttcatccccgcaatgacattttgggtttgttggctgcctttgctatgatcaaccacgccgacaaatacaagatcctggtcaaccattgcttttttgacatcatccaaccgatcaagactgccctcaaccagtgtgacacgcggatttttcgccaactgcgccaagcgtgattgatggcgtaagaacaaggttaaatgtacattggcgaattgatcatcgttgagaatttgattttcaatcagtcgtgaaatctggccgtttgcagccattatcaaaatattctttatcaaaacatcgcctccatgtagatgtgcatcgcttgcttgagttttccccgtaaactgatatcgcagtcatcactgctgaatcagctatagggggatcaccccagtcaagaaaaacgttatctgtatctaattcgtttatggctgaatcaataaagatgccatgatcgtggccaagttgcgttatctaaaccttacttcttacgaacaaaggctatattaaacctttgtgtgcactccaacgcaaccacaatcatcatcattgtttcgctaatgaatgtgttgttgtcgctcaatttacgcaaactcaatccagaggctaactttggcctgttgtatgccacacctaccgtaatcgtcgcccttgatttattgttcaagctagtcggtctccttatttctatgaccattttcccagccgcaatggggctgtcaatcttattggccagccttctattgattttctttccaaaatcagcatgaaacaacatggcactttatgaaaatttgcaaaaaaatagctgtgaacgaaatttcgttcacagctttcgactgcccaggctggattcgaaccagcgaccctttgattaacagtcaagcattctaccactgaactactgggcaatgagtatgtatagtatattctcatgtttcttagaaaaatgcaatatttttcgtctttcttttttgccatttccctttaaaaatttaaaaatagttttgacgtgcgcagtatgaccacaaaaacgctgacagtctttggttatcgcttgatgaacctgcatagtgcccgtgaaatggccgtacgctgacaagcagtttcatctataataaaggtgaaaggtcgtgaacctatggatgctccttacccgaatatgcaagatttgcctgatttgccgtctgaatccggcaacgatcaaccaatatggcaagcacttgccaaaaaaataccctcagttgctgatcgccgtgttctcgtcattcattgcggcgatggttggttttatcgtcatgccctcaacggcggtgccaccgcggttctcggtattgacaccgatgcggttgccattcaagatgctcgcgctgttgccagctccgatcgcttacgttatcgcatcatgccggataaatggctaaaactgttaactggaccatatgatctcatcgtcggctcatttgatcaatcaccagaggagctacgtgccatgactcatgttttaagtgcactgcttagtcctaaaggccaacttatcgccgctgttgcaccatcaaagcagcccattggcgatgatctcgcagttgatgaactgatcagctcacaacttgtgatcaatcgttggtaccaagtgacagataagcggctcacccaaacggaacaattatatctgttgcttagctcgcgggtttcgcactgacatctcaaggtgagcaacggtcattgaccactacaattaaaatgagcacaaaaaaagtcgaagcacttgctccgacttttttgatgcattcattaaattactgaagtacttcaacggttgcggacaagatccctgctgcaggaatctggccactcggcattgcaacatctaactgattaggattgcctgcagcaaaactaccagtatcattaactgtccgagtcaatgtttgaccattggacatggtgatacgtaatacggtgcctttagggaagacgctcaagttagcagcaacgccactgtagcccatgttgctacctagaacagccggatcatagaagctgatcttgaaggtgcctttgttagttgcactttgggttggttgtgacgtctgagttgtctgagcaactggttggctaaccgcctgctgttgtgcttgttgttgctgcttttgttgtgcagctgcctgctgagcctgttgctgttgaacttgttgctgttgaacttgttgctgttgtgcttgctgagcttgttgcgcctgttcagcagcctgttgtagtgcttgctggttagcagccgattcagcagcagcttgaactgacgcagctgattcagcggcagcactttgcgcggcagcactttcagcggcgctctgagcagcagcacttgatgctgcttgcgcattagctgacgcagttgcggcctgagcagcttgttcggctggtgacgttgtctgagtcggtgcggcagccgcatcagcctttttcgtcaatggtgccaactgctgcaaagtattaatactcagatagcgttctggaatccagccgtggtcttcagtttcataccaaatttctgcgaagacttttttactattcacaaatttaacgtgttcaccagttgtcacataacgcttaacttgttgacccgctgtcggtgaggtccaaacagtcgtagcaccaccgttgtaggtaacatcagcttcggttttgtcgctagctggtgcactgacggtcgcggtttcagtattcttcgtagcagcgctgacgtgacttggcttggacaatgccacggcagacagtgcaactgctgagaacaatactgtacttaaaagctttttcatgttcgtattcctcctgggtttgtgtggtgatttaactaactgagacttagtatagctatccagtgttacgaacatgtattctgtgtgttgcaattgggttaagttctatgacaaaagattacattagatgacatccttaacaaactgacactgcctttttgttaaaccaaactaaaacggcatctctgtcaaacagatgccgtttcacttctataggaagagtcgatccaatgttgccgccaaaacctgatgtccgtgatccagtatccccggattgacagggccttgcggtttgcctgctgccgcaccaatttcagcaatcatgtctggggtcacttccagatggaactggaagccaacgatatggtcatgataagcgaagccttgtagcgcatgctcattttcgtaaagtaatgtacttcctggtaagcggctcatcgcttccccatgccagtggaaaacattgagtaacgtgccatcggtaccgcgcacggtgccgatgccttcttctggttgcggcattcgataaacattggcaccaaatgctttggtaatctgctgggcacctagacaaatccccaacaccgggcggcccaatttattgaggctgcggatcaaaattcgttctgcggcgagccaatcaaagtcatcattgacgctcatgggtccacctagcaaaatcaacccatccatctctgctgggttcagttgtgcaattggatccccttgatcagggcggtaagtgactatgtcaacttgcttgtctgcggcccagtctttaatcgtgccaagatcctctgtatcagtatgctgcatgactgtcagcttcatgctgtcgtgctcctttcgtggccgcttaatcttggcctttcaacgctgctgcaaatagcttgattgtggtcattgcgggatcataaatcgcaaagtaaacccgcttaaacgccccttcaaattcgggcaataataacgcttttcgaaacaacttggcgactggtgcaactggattgccaaatacgccggttccaaacgcgcctaaaatgacctgatcgacatcatgcgccttaaacgcccgaagcgtctgcagaattttaaacgcgatatcgttcatggcagtgacatcatctagcgttgcatcaattcggcgattaggtgctgcgacggtgacaatgtcgacatatttgtctgttaatcgccgcccttgatcatcgaaaagctggcgaacatgttctgcatagatcaacttctgactaaaaagcccgcgatttggcttgcgacgattaagctcataataatctgccatgtgctgctcaaggcctggaaccaaataagtccccttggcaatggcttcttcctgcgcacgtgcgccaactgcaaccccgccgcctggatcgaccggacttgcaaaattcatgacgccgattttgcccgtcagttcactcatcaattggaaaacatcaacattacgcaaggcaatttgcggcggttctgtccctttcgctggcgtttgcggcaatggttcgctaatgacctgtgttttgggcatttctggtcgtgccttaaatgctgccattgtctcttggtacatcttgacttgttccattcctgccaccttcaattaaatattttcgattgacccaagcataacatagaagcaaagtgatggaattatcggtcatctttgtcattcaatgttaaaattaactttgtacgatacatgaaatgaggaatggaatacatggaaagtggccaaatcgtccccaatttattggtgatgctcgtcacctttttattcgcggcattttttgtcgcgtgtgaatttgctctggtgcaaagtcgtccaagtgccttggaagaaatgattgataatggtactggccgtaaagctaaagtcgagcgggctttacgaatggtgcataatctaaacgagtatctctcaacgacacaggttggtgtttcgctggctggcattatccttggttggatcggggaaacaaccgttgagtttttgttggttgatctttttggcttgacccacctgagcttgcctaatggtagtctgcacgcggttggcgcgattttaggcgtgattattttaacctatttagaagtcgtgttaaccgaaattgttccaaagaacatctcgattgattatccgatcaaaaccttaatgctggttgtaacaccgctacattatttccatattttgttctatccttttgtttggctgctgaatgtcagtgccaccgggattgtcaaaatgatggggatgaagcccgcagacgaaggcaacgaggccttttcgcaagctgagattctgagtctgagtaaaaatgccgtcacaactggtgacatggaacaaaatgatgttatctacatgcagcgggcatttgaactgaatgacaagaccgcgaaagacatcatggtggatcgaaccagcttgtttgtcattgatatcaccaccaccgtcaaagaagctttgcgggattacttaacgcaaggttacagccgattcccggttgttgcgaatggcgataaggataagattctcgggtatgtttacatctatgacttggtcaagcaaggtcaagtcgacccgtctgtgaaggtctctaagctgttacgttccatcattaatgtgcctgaagtaacaccgattcatagcattctggcacaaatgatcaagaaacagacgccaattgttgttgtcgttgacgaatatggtggtactagtgggattgtcaccgacaaggatatttacgaagaactatttggtaccgtcaaggatgaaattgatgatgtctctgatgaatacattcggcaaacggatgatccaaaggtcttccgagtcagtggcaaaacaaccttgtgggattttgaacgttacttccacaccaatattaaagcctttactgattcagaaatcatcaccattgctggctttatcatggaagatcatcccgatttgaaactgcacgataaggtcaagattgatcatttcaacttcaccgttgcagatttttcccgtggctttgctaactggtttgatgtcacacaagatccaaaaccagttaaacaaacggttgctgaagaggttaaagaagctaaaaacgacgataacaagcattaatcaggatcaagctaaactttcaaaaacgtggtactcgttgaggggatcacgtttttttatcgtaatctatttttgtgcaataccgctaggcgcaactaccagccgataaactaaaccctaatgacagcaacgatttcattatttacccaaagccgttgaggacgtgctagactggattataacgattttaagaaaggacacgatattgttgacaacaacagacgttaatggtcatccatataatcgcttgctgcttgtgattaccttgttgatcggtacttttacaacattcttgacgcaaacgattttgaccacggcttacccgacgctgatggcggattttcacatcagcgcgagtgcagtccaatggctgaccactggcttcatgctgattatgggtattatgatcccggtttccgcatggctgctggataaattcaatgttaagtatctctacttaacagctatgacaatctttttccttggttccttgatttgttggttagcaccagattttcaagttctgctggctggtcggctcacgcaggcaattggcgttggtatgtcaatgccgactttccaaacagtcatgttcacgattttcccacctggcaaacgtggtagtgccatgggcctagctgggattgttattggcctagctcctgccatcggcccgacgctttctggttggattctgcttaatcatacttggcgggctctatttgccgttattatgccaattgctgctggggtcgtgctgctggccatctatagcatgcgaaaagttttgccgacctcgaatccaaaaagtgatattccttccattattgcttctactttgggttttgggggcttgctttatggcttctccacagttggtgatgctggttggaccgattcccaagtactgattagcttagccatcggcattattttcgttgccttattctgcgtgcgccagttacgcctcgaaacgcctctgctagaactgcgcgttttcaaatcacgcacgtatacattgagcgtcattttaacagccttggcgtttatgtcgatggttggtgtagaaatggtcttgccaatgtacttccaaacgatccgtggtgaatctgcctttcactctgggatgatcctttttcccggagccatcatgatggggattatgagtccaattaccggccggattttcgacaaaattggggccaagcggctggctgttgccggtttgttcctgctagttgccggatcgctgccgctggtcaccttaactgctaacacgccgattatctatatcacgaccatttacacagtgcgcatgttcggcattaccatggtcacgatgccggtcaccaccgctggtatgaacgccttgccaacacacctgatcaatcacgggacggcggtcaataacacggttcggcaagtcgccgcctcaattggcaccgcaatactggtgtcagtattatcagtagtcactaaagatgcaacgccagccgctagtggtcgactgcttgacccgatccattacaccaacgctatgaacaatgcagtcattgccggttatcgcgcggcttttgccgtctcactagtcatggcagcgcttggtctcgttctcagcttatttttgaaaacagacgtcattgatcggagggacgcctcatgattatcttgttattgatcgtcggtgcgcttgcctttttctgggctgttgtgttaatgcaaccaagtcggcgccgtcaattaacgatctgggtaagcgcgggacttgtcttggcccccatcctattgttaagcgtgaatgacctttaccacgttggcttcactattgacgaaaccactgaactgcagccattagcaccgatggacgaccagttgcaaatttcgcggcggcccattggcaaggcaaaaaagcatttcagctatcgttaccttatcatttccgatgcaaccgttcataccgctacacctagtaccacggtctcaactcgcatcgaacacggcaccattccgcaagttgcagtgacaactcagaagctgacttatagcaatgcgctaaccgctattttgtttgctggatcaggcgaacaaggtaaagcaattggcaaaatttacaccttcacactgccagcaaattggcagattgttgatcagtaaacgccatcttgcactcgcagaaaccgattcacgttccgtcatcacgcactcgccagcacaaaaatttgaagctgagccatacacttatgatttgttagatctcaattgatctgagtaatgggtctggcaaaaagtttcttgccgtgacaaactccgcaatctccggccagctgaggtggcgacgcgaagctagagcggagacggcgcttcgagcccaaagaccggtctcgaagtcgcctaacaacatcagcgccaaagcccgtcgctgtgttgtttgcacggctgagccccatctggcctacgattgctacgctttggcactgaaatctttaaagtccaccctgcgctttctatcaaactacttagcgctaaaaaaagtctgacgttcagcgaaacacttcatctcgctgaggatcgtcagacttttttgattgcccgtatttattgcggttcggccaacagcatgcggtacaaggtgctgatgggcaggcccatgacattgtagaaatcaccgtgaattgacttgaccagtagtgctccggcatcctgaatgccataggcgcctgctttgtcttggtaggcgtcttccgccagatacgattcaacatccgcttcacttagcggccagaaggtaacatcagtcgtcacgacctgctgccgcacgctaccattgtccaagcgcacccacaaaccggtataaacctgatgtgtctgaccacctaatgccgtgatcatctgtttggcttcggcgcggtcatgtggtttgcctaataacttgccttgaaacgccaccatggtatcggcggcgataatcattgccccggggtaacttggtacaagtgattgtcccttagctgtcgccaagctctgaacatatactggcggatccaacactggcaaagcgcgttcattgatactggcaggatggctttcaaagtcaggcacaatccgctttaacaattcctgtcgccgtggtgaatgactggccaaaatgatcatgcttgcatttccccgctttcgtgactgtcttgaatccgtttgaacattttctcaagatcggtgtttgaaaagtgaaccaagaccggccgaccatgcgggcaattgaagggattctcacattccggcaacttctgcaataatgctcgcgcctgtctgtcgtccaaatggtgattggccttaatggcacgcttacagctcatcatgatagcagttttctcccgaaacgctgcgactgtcatgcgaccatcacgcaaaacccaatccaccatttctttaatggtatcttcttcctgcccagctttaaaccaagtcggatgatgttcaacaacaaagctgttttggccaaaatcttccagatatagtccaaccgactcaagcacgtcccgatgatcacgaatgctaatggcatcagccgcggaatagtctaacacaatcggtacgagtaaatgttgttggtcgttgctgacttcgccaatagcttgccgataatactcatagttcacccgttcttgtgcagcatgctggtccaaaatatataacccatcgcctgattccgctagcaaataagtgccgtggacttgcgccaagtacgtgagatttggaaaacgctcagctgattcgacatgcgaaatatcaggttccggttcatctgccaccaaagttgggaccacattcgaagctagccgctgataccgctgatcccatgcagccagacgttgcggttcgttaaaaatcggctgatcatccaaatcgccaatctcaagatctggtgaagttggtgccggtgtcggctcctcagcagccgcgtctgctaagttagtagttgtgttttcgcgcaactgctgcccttgctgcggctgaactgagggcatcgtcttgggactgatcttattcaatgtcagttccagttgatccagatcataccgttctctttttggcagattatcgagcgcatccggaatcaggttttccttcgccaatcgtgttcgaatcgcctcgctgagcaaatgactaagctgatcttccttgctcagacgcacctcggcttttgtcgggtgaacgttgacatcgaccaacgcagcatccatctcaatgttgatgacgcccattggataacgccccaccattaacttcgagccgtaaccggcaataaccgccttcgtcagttggaagttcttaatataacggccattgacaactaaactcaagtaattacgcgaagctcgggtcgtttcaggcaaacttgttaacccgctaacccgaaaatcaagatcttgtgctttgaaatcaaccattgagcgcgccacagacaagccataaattccggccagcgtctggcgcaaatcgccttgaccagctgtgcgcaccaccatattgccatcatgtgaaaccgtgaaggcaatatcaggatttgccatcgccaatcggctgacgatatccacaatttttcccagttcagtttgctgcgacttcatatacttcagccgcgccggtgtgttgaaaaacaaatcattcacttcaacatccgtaccgcgtcggtgagccgctgtcgactgcgcttcaacctcaccgcctttgacgtgaatctgggtgccaatccctgaatccgttgccgttgtcaactttacgtcggcaaccgcggcaatacttgccaacgcttcgccacggaagcccaatgaatgcacattaaataaatcacgcgtcgtcagaattttactggtggcgtgccgcaaaaacgctgttgcaacgtcatccggggcaatcccgatgccgttatcgctaacccgaatctcctgcaaaccagccgcggaaatcaggacgtcaatttgcgttgcttgtgcatcgatactattttcaaccagttctttgacaacactggcagggcgttcaatgacctccccagcagcgatctggttgcttaatgttgccgatagttggtgaatctttggcatgaaatcacttcttctttaaatgcttctgcaggtcaaatatgaaattcatcgcgtccatcggtgtggccgccatcaagtcaaatttcgcaagtttcttcagaatcggactattctttggtgtcggttttggttcttcaaacaacgacaattgttgctcttcaacttgcggcgctggtgctggcgccgttttattgggtgcatcggcttcaagctgtttcaaaatcgtatcagcacgcgctaacaagtctgccggtaaaccggcgagcttggcgacgtgaatcccataactcttatcggcagggccaggcatcattttgtgcaagaaaaccagattgccatgctcctcaacggcaccaacatggacattctttaacttcgccaaggagtctgacaaactagttagctcatgataatgcgttgagaacagcgttttggcgtggacatgatcatgcaagaactcaataattgcctgtgccagcgccatcccatcatacgttgccgtgccgcggccgatctcatcaaaaagaatcaggctggaagccgtcgcgtggcttaatgcagcgttggcttccagcatttcaaccatgaaagtactttcgccattggcaagatcatcagccgctccgattcgggtaaagatctgatcaaaaatcggtaagtcagctacatctgccgggacaaacgaacccgcttgcgccatgataacaatcaaggctaattggcgcatgtaggtacttttccctgacatgttaggcccggtgatcagcaacatatcggtgtcgtgattcatgatgacatcgttaggaatataactgtctcggccaagtacatgttccacgactggatggcgaccacccttaacattgatatcatgggttccggcatgcatcgttggtcggacataatgactgttttcagccactgttgcaaagctttgcaacacgtccaaagatgaaatttgggcggctaaagcttgtagtcgtttgatctgggctttgaccttgtcgcgaatgtcttggaaaagatcatactcgagcgctgttgagctttcctgcgcttcaagaatcaaggtctccttttctttcagctctggggtgataaaccgctcagcgtttgtcagtgtctgtttgcgttcatagcgcccttccggtattttgtccaaattggacttagtcacttcgataaagtaaccaaaaaccttgttgtaacgaattttaagtgtgtgaatgccagttgctttgcgttccgatgcttctagttcagcgatccattgtttggaattcttcatggcatcacgatagctgtccagtttttgattgtaccctcggaggatcaagccaccgtctgtcactgaaatcggcggttcgggttcaatcgcacggcgaatcaatccagcgacatcgctgactgggtccattttactgcgaagtgccttaaaactgccatcatcaagcttacccagcacatcctgaatagccgggatctgatccaaagaggtttgcaactgaattaaatcacgaccattaacggtaccaaaagcaactcggccagctaaccgctcaagatcatagactttagttagtcgttcctgcaactcactgcgttcaaaaaagtgatccaataaatcctgaacctgattttgccgcacactgatcacatcaatatccagtaatggtcgatccagccattgtttcaataagcggccacccatcgctgttttggtcgaatcaagcaacgacaacaaagtgtcacctttgcgtcccgttctgctgttttgcaaaatgtcgaggttactacgggcgtcctgatccatttccagataggcggaaggttgataagcaaccgctttttgaatatgggccaagctgcgtttctgcgtgttcaataaataggccattagcatctgcacaacggcagcctctgcaggatcagttagctcctgtgacacataactgccttcacttgtcggctcggcatcaggctggactgacagaagccgttccccttgcttgagcattcccgcgtcgtcatcggtcaattcctcaggcacaacgatttctttggtggccagcgcactcagttcgttttgcagagcaaatttgctttttagatccgtcactttgagctcaccggtcgatacatcggcatacgcaaacgcataacctgctgcatgcggcatcacagcggtaatatagttattcgacttggctgcaccggctttgatgtcaacatttgtccctggcgttaccaactgaatgacggctcgtttaaccatcccgacagcttttttagggtcctccatctgttcacagatcgcaactttgtaaccgtggtcaattaaaatatcaacgtaactttggacagcatggtgcgggacaccagccattgggataggatcgtcagcactcttgtttcgtgcagttaatgttagttcgagcaactgagcacctttgatggcatcatcattgaataattcataaaaatctccgatgcggtaaaacaaaaacgcatccggatattgcgccttgatttcgttgtactgctgcatcataggcgtttcactggttttttgcggcacgaaattcacccttcgtcctttgactttctttgacgttctatatgacccattttaacaggtgcgtcaactttgagcgaccccctggcaagtgcaaagagtgagttgtcgcggttagaaatcgaagcatcggtaaacttgaagttaaatggctggttttgagccatttagcttcaagtttcttatgtacagatttccgcggctacgtatacgttcaaaccaaaaaacgatcagatcatcatgatctaaccgttttgcaagtagtctccctacttcttcaaatgataactgtaagtggcaatgatgacattctcgcgacttgcaaaggcggcgcgcaggcggaagttggtttggttgtgaagaatattctgccattttttacgtggtacgaactgcggaatgagtaccgtggttgtaaagttccgtttggcggcgttgcgcgcgacgatgtcaacgaagcgaatagttggggcttcgatggaacggtatgatgagtggatatcaacaaatcgcacctctggaaaatccgcgcggaattcgctttgggtttctttttccttattgggattctcgtccatcgaaacgtgcatagcaatgacatagtcgccaattgactgagcataatttaaggccgcgcgcgtaacccgagtgacattaccgaccaaaacaatgacggtgctgccatcgtaatcatgttgtgccacttcgaccggcaagcgtaattgctcagcaactttgtcataatgatcgcgaattttataaaacatgaaaatggcgagtggcatcacaataaagaatggccagatatcaagcaatcggtaagcaaacaggatgacgagaattgcaaaggaaatcaacgcgccagagaagttagcaatcgttttgccaatccaaccttttccgcgatgacggaaccaatggataatcatcccactttgcgacaaggtaaatggaatgaacacaccaaccgcgtacaacggaatcagccgttcagttgatccctggaaaatcgtaatcagcgccgcggctcctaacgccagcgtcaaaatcccgttagagtaacccaagcgatcgccacgatccagatacatatgcggcataaacttatctttggccaagttaaaagccaaaactggaaaagctgaaaatccggtattggctgccacagccaagatcaaggcggtcgcaaattgaacaacgtagtacatgatacctgctccgccaaaggtctctttggccacttgcgaaagcaccgtcactttggccaccggcacaataccgtaccaatagttcaaaaatgtaataccagcaaagaagaagccaaggatggcagccatgatggccaacgttttagccgcattcttttctttaggcattttaaagaacggcaccgcattactaattgcttcaaccccagtcagtgaactggacccactggaaaatgcccggaagatcaaggccatcgagactcccggaatcgctgcaccgacaaaggaagttgccttgtacggaatagcgcctgttgccacttggtaaagtccccagatgatcatgcccgtcatgacgacaacgaataagtaaaccgggaccatcaaaaaattggccgattcactcatgccacgtaaattcatgctcatcaagatgaaaatgatgatcagtgaaatgaccacctgcttgccataaagcgcaggaattgcactggtaatcgcttcagcacccgcggaaactgagactgaaaccgttagcatataatcaatcagtaatgaagcgcctgcggttagaccggcatttttacctagattttcgctagcgacaacatacgcgccgccgccactaggataggcgtgaataatctggcgataggatagtgtcaatgaaatcaagagcactaaaacaaaggcagcgatcggcaatgagtaccaaatcgcagccgctgacaatgtcgtcagaactaagacaatttgttcagtcccgtaagccacacttgaaagcgcatctgacgataacatcgccagtgccttgaaaatgttaagcttttgaccgccttcctcagaagatttcagtggtcgcccaataaacaggcgctttaaatgcatcattttcattactcctatatgaaccgaatgtatcgggaaaatttaaccaaaacacaaacaatcatcagtgtaacctaaatagacgctcaagcctaccttatctaacgcaacatgacaacttggtgagattccctgacgaaaagccccaacaatatcgtcctaactagcatgatgtgcaaaaaagcaaaaacggccaccttctcggtgatgcccgagaaagtggtcgttttcgttacgccttttcgataatcacaacatcatggaccttcaacttgcgatgaacctcgtgctcgatctcgcttttagcagcgtggtcaattttaaggtcagctttaggcgtatcaggcaacagtttttccaagacaaaatcaatctcagcatctttaatggtgcgtttgtcgtgggtcaagacgacatcgacttggtcaaatccttcaacgtaataaacatgaacagatcctaacgtatataattcaaaaaacttaaccggctttcgattataaagataccgcattgtgttcggtaacattttgtgcaagctggcgttaagccgaatgggattttgaatcagcttcatcaaatcgcccctttttttgtgtgagcgtgagccagcgcgcttagcgaccggagtgtaagcgggcctgaacgtgatggtcgggttgtgaccattgcgttcaaggtccttacacgcaggtcgctgcgctggcgaacgcgttatgactgagcgtgagccagcgcggtagaaaccggagtgtaagcggccttgaacgtgatggtcgggttgtgaccattgcgttcaaggtccttacacgcaggttgctgcgctggcgaacgcgttatgaccgcgacatcgctttgatgtccacggctgatgatcttactaattaaccatcatacaacatgaaactatctttattttaccaatgaatgccccttagtgactaatgattaggcacagaaatgttaaataacttcataaagtgaccttgaaaacttgaaaagcacactatgtaaacaacaaaagcaccggcgcataagccagtgcttttgttgaacgaataggcagaaattacatcataccgcccatgcctgctgctgggttagcaccagcggcagcattattatttgcatttggatctggcttgtcagcaacaacggcttcagtcgtcagcatcaaagcagcaacggaagcggcgttttgcaatgcagaacgggtcactttggttgggtcaataatacctgacttagccatatcttcccattcatcagtagcggcattgtaaccaacgccttgcttttccttcttcagctgttcaacgatgacagaaccttctttgccggcgttctcagcaatctggcgaacaggttcctcaagagcacgtagcacgatgttgatcccggtttgaacgtcgccttcttctttcaaagcagcaactgcaggcaaaacatctaccagagctgtaccgccgccagcaacgtaaccttcttcaaccgcggcacgggtcgcattcaaagcatcttcgatccgatacttgcgttccttcaattcagtttcagtagcggcaccaaccttgacaaccgcaacaccgccagctaacttagccaaacgctcttgcaacttttcacggtcgaagtcactggtcgtgtcatcaatttgcttcttgatgatattaacccgttcagcaatggcatccttagagccagcgccatcaacaatcgtggtgttgtccttggtaaccgttaccttgccggcacgacccaattgttcaagcttggtgtctttaagatccaaaccaaggtcagaactgatcacggtaccaccagtcaaggtagcaatatcttcaagttgagccttacgccgatcaccaaagccaggggccttaaccgcaacaacattgaaggtaccacgaatcttgttcagaactaaggttggcaatgcttcaccagcaacgtcgtcagcaatgatcaacagtgccttaccttgttgaacgatttcttgtaacagcggcaaaatgtcctgaatattggaaatctttttgtcggtgatcaagatataaggatcgtcaaggtcagcttccatcttatcattatcggtaaccatgtattggctcagatagccgcgatcaaactgcatcccttcaacaacagagagttcagtgtcaatccctttgctttcttcaatggtaatcacaccatcgtggccaactttttccatggcgtcagcaatcagactaccaacttctgtatttgaggaagaaacggacgcaacctgcgcgatttctttcttaccattaactttgtggctaatcttgtgcaattcgtcaacggcagccttagttgccttttcaatccctgtgcgaatgccaacaggattagcaccggctgtaacgttcttcatgccttcgcggataatactttgtgccaaaaccgttgcggttgtggtaccatcaccagcaatgtcatttgtcttggaagcaacttcggcaaccaacttggcgcccatgttttcgtagtgatcttccaagtcaatggacttcgcaattgtgacaccgtcattggtaatttccggtgagccatagctcttgtccaaaacaacgttgcggccttttggtcctaaggttgtcttaactgtgtttgccaactgatcaacgccgcgcagcattgcagcacgtgcgtcttcagagaatttaatttcttttgccattgtttttattcacctcaaaattgatcgattatttagttacgcaattgccatgatgtctttttcatgcaatacaaggtagtcttgaccttcatacttcacttcagagccggcgtatttgtcgtataatacagtatcgccaactttgacggccattggcaaacgcttgccttctggtgtcaaagcgccttcacctactgcaacaactttgccggtttgcggcttttgttttgcgttgttggctaaaacgatgccgccaactgtctgctcctcttcttcaacgacctcgacaatcacgcgatctcctaatggttttaacaaggcaatccctccacattacattttttgatttagcactcgttatgtctaagtgctaactacagaagtaactataacgagttttgcggttgaatgcaaccccaaaccgtggaatgttatacttattccagacatttttttaaaggagctctttatgtcactacaaaaacatggactttccattattggtgcctatttagtggcgctgattggtaacttgctgattttccaaatcttacccgttggccgactcagcttaggtcttgctactgtgaccagtgtgctggcgatgattgccgctggtttcagtgagcggcagttagtcattgccaacgccatcgaagaacctggggttgccgccccacaacaacgggttttctggggactaatcggtatcgttggcgttttggtcgctcagcttgtgggttcatggctagaaacatttttattcaaaataccgcaaaccagcagcctgattcatcagcagctgtccagtatggcaactaatccgtggtatttcctagtgatcggattggctattcctgtgttggaagagctaacctatcgcaaagttctattcggtaatcttgtgaatgtcaccggtatctttgggggtgccttgatcactagtctcctgtttgctttaacgcaaccgggtggacactggttaagcgccacattggttggacttgttcttgcatatgattatcgacacactggcgcagtcagcacggctattatcgcccgccttggatctttgtgggtggtttggctttactatctcgcccacaccctataatcgtaatcgaatattaaccttgacccctgctttcatcccttataatagaaataatgattttgtgaaggagcagttcaaacatggagacacgttctaatcgccgccaacaacaacagaagccgaggcgttttcgctggggcaaattgatcggcctaatcgttgtggttggtctgttcacaacaggtgcgtatgccttgcggttatacagtcaggcaaaatatgccatcaataatacatatcatgcgaccaaacatgtcagtaccgacattgctaacaagaagccgttcgccgttttgctactaggcgttgatactggtgctgatggtcggattgaaaaaggcaactctgataccatgattgttgctgtcgttaatcctaaaaccaagaaaacaaccatggtcagtatcccgcgtgacaccgctgcagagttaattggcacaaaggaattcaacatgcagaagatcaatgccgcgtacaacgttggcggttcggacatggcgatcaacactgtttccaagctggtcaatgtcccgatttcttactacctaacaatcaacatgggggcgcttgaaaaagtcgtcaatgctgtcggcggtattgatgtcgtcgtaccgttttcctttcaggatccatacactggcaaccagaagttcacgaaaggccccatgcatctcaatggcaatatggcgctggcatattcacggatgcgtcactctgacccagagggcgattatggccgacagaagcggcagcaacaagtcatcaaggccattctcaaaaaagcaatttctgttggatcacttggcaattttaccaagctcatggacactatctcaaaaaatattgccacgaatatgagttttgatgatatgcaaagtattttcttgaattaccgtgacgccgccaaaacagtttcgactgatcatctgcaaggtgtcaacgcatgggtcggcgatggtgcttaccagattgcttccgacgctgagatgcaacgaatctccaacaaacttcggacagcgctggggctgcaaaccgaaaccatcagcaatgaagagacaaaacaaaatgcgaagaacacgcagttcgactttaaggcaaccacggaccaaaactacattatctttgccccgtatgattgatcattcaaaaacacccgcagatttcactgtctgcgggtgtttttgcgcttaaattcaagcctcaagcaagtttcttctggggtcgttcccgataccaccaccagaaaccaagagcaagaatggctatgattgaaacggtataagaaagcagctcattgtttaacagccactgaccaagcccgtatggtatgacagccaatgcatatatcatgaccacccagcgtaattttggcagtaagagaacattgcccgcattttccagcgaaatgtggtcaaataaccacctcgtcgcaaaatagccgataatactgataaccatagcggcaataaagtaggcaaaaaataagttgttgcctgataaccggactggattcgaacgcatcgttgaatagatcagtcgatctgctgcagttgccccaaaccacgtaccgaacagcccgaagacccccatccaaaacggtgacgcgaaaatcgtaccaatggcggtgccgattgtatacatgaaactaacaaccgctatattcatgagcaaaacacctaaaagattcatcccactcaatccgacatacatagcaggaatggcaacataataacctatgatggtgatccctgagccaagcatcatcacaccaagaagactcagaaaaccataccaataacgtgttgcaaatacccttcttcggcgaaacccactactgaaaatggctgcattaaaaccactcgcttggtcaatactggctattgctaaaccgactattagcggaatcaaatacgagacaaccgtgaaaaagcgaccactaataaggtcagacaaaagttgccctttttgatttggaataaaaagatgacgctggtcttcccgatactcttcataacttttattgttataaaaagtaaggtgatttttcttggcctcttgtttactttcttcaaactgcgctaagtccatgacgtatttttgctcgttatgatagttttgtatgctttgacccaaattcaccgctgacagcaacagtgcaaagactaccatcatccgcaacaaaactttatgtcgcgatcttaccagtttcaataaacgatcttcacccatttatttcacctccgcgtttttggcgcgaaactcaactttaaataaatcagatagcgataacggcaagctctcattcagcacgggttcttcggcggcaatcgcggccttgacttcaggtgtgaaatgcgggaaaaccgcttcgatcacgcgtccacgaatggtcagaatccgaccttgttccctgatcacatcaggaatcgccttggttttgaaaactaactgcagcttgatcgcctgctgtctgacgtcctctagcgtcaagtcctgactgatgcgaccggctttaacgaacaaaacgcgatccgacaagccgtccaattcgactagattatgtgaggcgatgagaaaggttcgtttaccatcagcaacagcatctaccaccaaattgacaatccgctcgcgaatcagcaaatccaacccatcaaatggttcatccagaaaaacatacggtgccccgctcgccagcgccaacgtcaccatcaccaatgcctggtaaccttttgaaagactctgaaaacgttgtgatccttgcaggccgaacttttcgatcagcgccataaaccgcgcttgatcaaacgtcgcatagagcaattgataatcgccggcgattttatccagccggtatttacggaagaagagatgttgattatcaaggtaaaaaagattttcgcgttgttccggatggtcggtcaagtcctgttcatccaactcaatggtgcccccgtccgcacgatattgatgcgtcactgttcggaagatggtcgttttcccaataccgttaggcccgacaagcccgaccacctgccctagtgataaggaaaatgtgatgttattcagtacagcctgatcggcaatctttttttgcaattttgtgatcgttaaactcatgcttgtccctccttctcattgagccatgcctgcagaatgggaatgctgatccccaaactctgcgcttcaaccactaaggcatcaaatttaggccgaaatgccgcaatatcttttgtattggcctgccttaacggttcggcaatgaacgagccgcgtcctggctcaacatagatcacgccatctgcttcaagctgcttataggcctttgcaatcgtgttgggattgagctgctcttgttttgccatctctcgcaccgatggcaatttgtcacctggcagcagcacgccttgcaccacttgtgctttaatttgcaacacaaggcgctcgtagtaagccaaatgggcatacggatcagttgccatgaccacgccccctttcgtattatgtgtactattatacgtagtacacttaaaaaggcaagcgaaaagagcaagtcttatcgaacgacttgctctcacgttttttccaaacaaaaaacgccgactagcggcattttcgacaaattatgcttctggttcttttaaagtcggcccgtaatgttccaagaaataaatgagcgtctgtaattctgttgctaggtcaacgttttgcacgcgaacataacttggtacagagatgcgaatcggggtgaagttcatgatgcccttgatccctgctttaaccaaatcatccgtaatgtgttgcgcagcatcaatcggcaccgtcaaaatcacaatttcgatttgctgatccttgatctgtttgatcatttcatccatgggatagattgggacaccgctttggatggtaccagctaattcgggattaatatcaaagccagcactaatccgaatgttgtttgcctgccgaaagttgtaattcaacagcgcgtgaccaagattgccgacaccgactaacccgacattggttaaccgatcctgattcagaatctttttaaaaaaattaagtagatcgacgacatcatagccgtaaccgcgtttacccaatgcaccaaagtatgaaaaatcacgccgaatagttgccgaatcaacctttactgcgtccgacaattcagtcgaactgatcttggttgttccggaattggctagaaaattcagataacggtagtacacgggcaggcgttttgccgttgctttggggatgattgtttccgccatataagcaagcctcctgtagaagtattcccacgcagaacatgtgaactgtccaacatagtatctcttgcttatattagctggtttatagtgtgaaggcaagcggatacatcttcacaagcaaattttttattatccagggaccatcggggaacgcgcgccgatgaacgaaactatggtatattaggttctaacgattattgtgaaagaaggtatccctgtgatcattttgcaggcgcaacaagttggccgcagttttaacggcaatgaattatttgctaacgtcaacttagaaattcaaaacggcgcgcgcattggcttagtcgggcccaacggcattggcaagacgaccctgctggagatcctgactggtattgccccacccgatgctggtcaggtcacaaccatgaagaacctgtcaattggttatttagcacagaattcaggacttgattctgacaaaacgatttttaaagaaatgctgacggtctttgcaccattacaagcgatggctcggcaaatacatgacttagaagttaaactcggtgatccgcaactcatcgccgacaaagaagcttttgcggcaacgatgaaacaatacgatcaattgcaacatgactttaacgaacaaaatggttatggctatgaagccgaaattcgttccgttttacatggttttcagttcggcgaaacgacttatgacaagccggttggcactttatctggcggtgagcggtctcgattggcgctggcgaagctgctactcgaaaaacacgacttgatcatccttgacgaacccaccaaccatcttgacattgaaaccttgagttggcttgaagggtacttaaaaacctatccgggcgctattttaactgtcagtcatgaccaatatttcctcgatcacgtggtcactgagatctatgaattagatcatcaccacgcgacacattacaaaactaactatagcggctatctcaagcaaaaagctgatcgtcaagctcaagcttggaaggcttacaataagcagcaggaagaaattgccaaactgcaggattttgtcgacaagaatattgtccgcgctagtaccaccaaacaggctcaagctcgacgtaaacaattagaaaaaatggatgtgcttgaaaaacctgctggcgataataaaacggtgcattttaactttaccccaacgcgaccaagcggtaatgaagttttaaaagtcgagcaggcgacagttggttatgagccggacaaacccatggctggcccgattgactttcaagtgaataagtttgaccgaattgcgatcatcggaccaaatggtgtcggtaaatctactttactgaaaagtgttttgggaaaaattccttttcttaaaggagatgccaagtttggcgccaatgtcgacgtaggctattacgatcaggaaattcaacagcttaaccctaaaaacactgtcattgacgaaatctgggacgatcacccgatgatgcctgaaaaggatgtccggtccgtgctcgcggccttcctttttttggcggacgacattcaaaaaccggtcagtgccttatctggcggccaaaaagcgcggctggaactcactaaattagcgttgaaacacgataatttcttagtgcttgatgaaccgaccaaccatttggacatcaacagcaaagaagtcctagaacaggccttaaaagacttcagcgggactgtcttatttgtttcgcatgaccggtacttcatcaacgagttggcaacaaatgtggtcgctattgccccgaccggcagcactacttatctgggcaactgggattactatcaagaaaaactcaccgaaactcaggcagaagcagccgccgcagccgctgctcagccaacggcaaaaactgaaactgctggtgcgacctcttaccagcagtccaaagaagacgcccgcgctgaacgcaaacttcagcgggaagtggatgatttagagcagcaacttcaagatcttagccaacaagaggccaaaattcaaaaagcgatgactgcaccagacgtcctcagtgattatgtcaaaatgcaaacattgcagacagaactcgaaacagttcaaaaacaaacagctaaagttgaagacgcttgggaagaaaagtgcattcaactggaagatatgcatgctgataacaattaaaactgctgttctttaaattcaaaataggcacggccaaagatggtccttggtcgtgccaaactccgcaatctccggccagatggggtggcgacgcatagctagagctgtgacggcgctttgagcccaaagaccggtctcgaagtcgcctaacaacatcagcgacaaaacccggtcgctgtgttgtttgcacagttgagcccatctggcctacgattgctccgccttggcactggtatctttgagccttaaaaaatatctccgagaaaacaataggcgaatgattttccttttacggaaaaatcattcgcctattgttaactgtcaatgatggtccaacaccatttttgttgtctacttactcgaagccttctcatcaatcaacgccaaggcttgccgcaaaaccttttcaccgtccatcatcccataggctcgcatgtcgataacggccataggaatattagtaccagcaactttagcggcaaactgactttccataaagcgtacttgcggtccgagcatcaggacagatacgggttcagatgcaagtttattatcagcatctgctgctgccgttgcgaaaacatcaacatcaaggccatctgcctccgctgcttttttcatccgttgtaccagcattgaggttgacataccagcggaacagaccaacataatcgttttttcagccatgggaatcatcctttcgttaacaaacttatctataagataagtctaaccaaaacagttaggcggcgtcaacgaaatcgctgtcggccttgcatttattatgaagcgtgggtaaagctcaatcctggatcagcattcaagctttctgaagcaagatgctgcttcgcccattcaatatgagcagctgcgccaatcattgcgccattatcacccgtcaagcgaagtggcggcacaatcacatcgacatctggaaaattcacagccaaagtttcgttcatggcttctttaagcccttgattggctgcaacaccaccggccacaatgagttgtttaaccggatactgatgcagtgccttttgcgttttgtgaaccaaaacatcgacaaccgccgcttgaaaactcgcggctagatcttctcgactgagctcttggcctaactgatgggcgtgatgaaccgtgttgataacagccgatttcaagccactgaagctaaagtcaagattgtcttctttatccatcgcccgtggaaaatggaaagtgtcttgaccaagatgtgccaaccgatcaacttctttaccggccggatatggaatgcccagaatccgaccaactttatcgtaagcctcaccggcggcatcatcacgtgtatcgccgatgatttcgaattccccagctgatcgcatataaaccaactcagtatgaccgcctgaaaccgccagtgccagtaatggatacgcaagcggcttcacaaaacgggcggcataaatgtggcctgccatgtgattaaccggaattaatggtaaatgatgagcgtaggcaatggttttggcagccgtcaccccaattaacaatgcgcctaccagccctgggccgtatgtgactgccaccgcggtcaaatcatcataagtgacgcccgcttctttcaacgctgcatctgtaaccaacgtaatttgttccacatgatgacgactggctacctccggaacaacaccgccaaatcgttgatgacttttgatttgtgtggcgatgatgttcgataagattgtgtcaccattttcaacgacagccacactggtttcgtcgcagctgctttcaaacgctaaaattaattcccttgctgccacattgttctcctctacaacgacgataatgatcgattacggcaatggccgatacatatcgagtgcatcatcgtgattgctgacataataaccttttttaattttcccgtcctgaaaaccgagcgaccgatacagatgcttagcaatgtcgttattcgtccgcacttcaagcgtcattttttgactgccataatcaatcgcccggccaatcatgaactgcatcaaaaaacgtcccagacccatgtgctggtatgctgggtcaaccgcgatgttggtcacatgggcctcacttaaggtaaaccaggtgccaattaatgcgactaactgaccggcatcttcaacagccaaatacaacgaatgccgaactttacgcaactcagagaaaaaagagtaacgatcccacggtgtatcatgataaatccgtcgctcaatcgctaatgctgcatcgacatcgtcttctgtcatacgccgcagtaaatactctttattgcgaaccgtgatcgtttgtggcttaaagctcaattcatcaggtgtcgtgcgatcgaaccacgatttaaactttctcaacataaacatcatgtcctctgccggggtgtgcttccaaccagttgtgttccgcctcggtcagccgcagataacgcggcacaaaatcataaacagacacaggcggcagatctttccctaattgtcccaaacgtaatgcttgtggcaagtttagccaactcggtgcaaattgcgctaatccgcccaaggtctcaataatctgagcccgaaacatagccgcatcactgccgacaaagatcaccggctggtgcaaagtggctaattcagtgagcagcagttttaatggcacgtgccgatctgtaaccacattgatcagccggcccttgttccattggtagacacctgtaaacacattgttgcggcgcgcattcataatcggcacaatcatcgcttttgtatctgtgatgttggcggcaagcaccgccagactggaaacgcctgctagggcaatgttcaatgtgtaagctaatgttttccctgtcgtcacggcaattcgaatgccagtataggatcccggtccatctgcgacaataatcttatccaagtcctccggctgcaggccactagcagccactaaatcatcaatcgctggcagtagttgctcactatgcgtccgttttcgattaatcgtcgtctgcgccaacaacttatcattatctaacacagcaactgacatcgcttcgtttgaagtatcaagcgctaataatcgcatcaatagaccctcccttctcatggcataatcatggcaatattctatcacaaataagagcagagcgtgagctggcgcgtttagaaacctccgagctgaacgataactgtttttccttcactccctgagttacttacacacaagcctctgagcctctggtaccaattctattctacgctttggggtttccggtactccgagttggctccgcggcgattcggggtggcgaccgcgaagctagagtggtgggcacagctttgaacccgcaaaatgcgcggtttcaaagtctggccttggtctaagcggagaaaaccactccgctaagaccaatctcaccactgagcccatcaccgctccgccaactctctgttttctagcggaaagcaaaaaccagaaagaccattatcatttatgattcaattatttaaacctatattattcgggaattcccgtacaaacagcttcaaacctttttatgctcaaatcctaaaaccaagcctctcccggattcggtagcatgcctgtcattgctgcaatgagcaggagcacactgccaacaacgagtaaaccttgcagtgcgatttttaaccataaccgttgatgaatgatctcatctggtgtccagtagagatcggtggcgctttgaacaccagttgttttatttgccgccagcaaggcatcatggagccacttggctagccatgaccaagcaacacctgcaatcatggtagccacggccagcacccatagtgcatgatcacgttcagttaaatagtcagtcggaaagacgtagaagttgccgatgatgggtaattgaccaaattcgctataaaactgattgccaatggcatatgcaagcgccaagccaccaacaatactgcctatcagtcccaatcgccgcacccattttgcaattgtattctcacggtacaaattacgaatgtaagtcttgcgtccgctgcgcacctggttcggaaacatcatcttgtgtgttgctaattgcatcgtcacgattttccgttccagttgcagtgcccaaattcctgtccctaccaacgccaacacaaccacaatgattaatccagcaaacatagcagccagcccttctgttttttttttgagttttcttattctatcagttaggtttcatgttgaccactttggggcacatactcgatatggcagattgccaacaattaaaaaccccagacaagccgaccatcgtgaaagcattcagaaggtcaatctgtctggggctatttttaatgtaaaaatacgatctatgactggcttgttcaaagcgcttgcttttatagcaaatcaatcaaaggtggggacgaattcgctcaatggcttttaacgttccataagacagtgccgtttggattggcaacatgaccacgttcttgatcgttcgcggccagataatgccttgccatggcgtacccatgatgtttaaccatagtgttgtcaaaatgatattgctaatcaacaaaaccatgccgacagcgagcaacgtccgaagaaccgttaccttcttaccgtggaaaaacatgccgtaaagcattgccgcaatggctgcactgatggtaaaacccgggaagttggctcccggactgaagatcataattgacaactgatcgttcagcgcagcagcgccggccgccaaccatgggccaaaataatatcccatgaggatcgtggcaaagaacgctgggctaatcttgagccaaggggttccgaacgagaaacggcccagaacgatttgcatcgccatcaacatggccatatacaccatgttccgggtggaaagcttgggactactaaacgataatacttgcataagctgcaatctccttttttcggagacgcctaaatatcaggcgaatgcggcacctgcaccgcgacacttgtcttcgtctgccgttcacattccgttccggcagcacttaacgcgcaggttcctactcctagattttgtcacgagacatatcgtacaccgaaaattgtggaaagggaacccccgaaatgttcgcattcacattttttgtgatcacacgtgaaaattgacgtgaaaaatatctcacgattttctcggtattttcttggtttttaccaagttagctgccagattgattcgctaaaatagattctcgtaatcatatctttctggttgctcatactccctgaaaagggattccctcaacacttcattttagaagtgtttttttacacctaattatgggtgttcgcgtcattgactttagctgttcgcggctgcataaagagccgtataatgaaatgcgacaacgtttgaaaggaagatatgaccgtgactaaacatattctcgttttgcatacgggtggtaccatttcgatgactgaaaatagcgaaggtgacattatgcccagccaacataacccgttacttggtgctgacagttttgtccctgctgacgtcgaactcaccactgaagaaattttcaacctcccatccccgcacatgaccccagaacggatgctagaactcgttaaacgcatccgccaagcggaaaaagaaggcagcgatggcgtcgtgatcactcacgggacggatacgctggaagaaaccgcctattttcttgatctgacccttgattcggcgatgccagtggtcgtgacaggcgctatgcgctctagtaacgaaatcggcagcgatggtctggagaatcttcaaagcgccattaaaacggctgccagcgacgactcacgcaataagggaacgctcgttgtcatgaatgacgaaattcataccgctcggttcgtgaccaagacgcacacgaccaacgtggctactttccgaacaccaacattcggtccagtcggtttggtcaccaaagatggcgtccgattctttcaagaactgattaatcaagaaatctgtgcgattgatcacctcgtcgacaaggtcttcctcatcaaagcatatgctggcatggatggtaccttgttcgatgcactgcctgaagatacccacggcttgacgattgaagcgctcggtgccggcaatctaccgccgaccaccttacctgccattcaacggctgctggatcgcaacatcccgattgttctcgtttcccgctgttttaatggtgttgcgcaagccgtttacaattacgaaggcggtggtgtgcaacttaagaaaatgggcatcattttctgtcaaggcttgaatggccaaaaggcacgaatcaagttgcaagtcggcctcagtgacggcaaacaggggcaggatctagccgacttcgtggataatgctgttagctgacaattaacaaatagctgggactatcctcgatttcgaagaccgcaacgcaaaaacggcactaagcaaaaaagagacttttgcttagtgccgttttactatgctttaaaatcctgccaaatcatctgcgcttctgcgttgacctgttcgccggttacgacgcggtgcaaggttttggtgggatcatccggatcatgctgatattgggcaacaggcgtcgtgccatacgcgacttcacgttcataccgaatatccgccccgcgtaacgtatgggtactcaaaaaatcatagccaagactattttccatccattccaagtaatgagcattgttgacgtgtccgttactgtcaatatcaaaatagcggacatgaaaatcttcttgaccatctggggtggtgatctttttaagccgcggaaatcgcttgattttgcgatcactgaccgcgccgacacgctccaccagttccggaatcacgtccacaattttgcgggtgcgcagatccatgatgacccagttgctattcactgttaccaagcgctgcccttgcgcatcgtcaatccaataatcccggtaagtaaagaatttattgtaagtcgtcgcctcggtccccacgcgcaatggttcctcaattcgcggcatccgctgaatatccatatgatactgcgtgatcacccaaccagactgaaattcattaattgcatccatcccggcatgcaacgtctctaactggcgctccgaaatttctaacatgacattcatcatatttgccaatccggcgcgaccataccgatcacccgcaaaaccgggaatccggtaatcatcttcgtagacctttcccattaggatgactcctccttaaatcacacttgctggcacagaatccggttggcttcgcataagcctgtttctaaacgcaccagatctcacgctttgcttattttcccaactcatgataagcatcatacaccacttgcttcgctaagccattttgtttggcgactaatttaatcgctgcatttggtttggcaccagtggccacaattgcctcaacttgcatttttaaaggcaccgtcacatcaactgctggcttatcagccgcaccttctaccataatcacaaactcgccttttaggtcaccagcggcataagtttgtaatgccgacaatgaaccgcgaatgaaggtttcgaattttttcgtcaactcacgggccaaagccgcctgtcgatcaccaaaagcagtctgcattgctgccagcgttttgccaacccgatgtgggctttcataaaaaagcaaggtggctgattcatgggctaacttctccaattcgcgatttttctccccagctttacgcggtaaaaagccgtagaacaaaaacggctgcggcggcaagccggaagcaatcagcgcagttgtcgcggcgttggctcctggcaatggcaccactggcacaccggcatcaatggctgcgcgtaccaattccttgcctggatcagaaatcgacggcatcccggcatcgctgacttgagcaattgtctcgccgtttgccaacttagccaacagctcaggaatgcgcatctgtgtgttatgttcatgaaacgaaatcgttttagttttaatctcaaaatgatttagtaacatttgcgtgtgccgcgtgtcttctgctgcaatcaaatcgactgttttcagaatttcaatcgcacgaattgtcatatcgcccaagttgccaatcggcgttggcaccagataaagtgtgcctgttgtatgtgaaccgaagcttcgttgttgctccaagtcaattctccccgtaaataatctcagtacaaaaagcgcatggctcatcattgacccggcgctggccatagaacatcgggcaaacatggaagccttcattatacagactttcaaggttttgcttcgacttagacaattcaaccccaccatcactggttttattgtcatctttttctaattctgccaaatgttgacgcaaatgcttgttttcgatctcaagttcagcattgcgttcaagcgtttctgccatatcgtccttcatagcggcgatttctctgagcatctgctgggcatgtttttcaagggtcaagaagccatcatataattctttcttttccacaagatcacccttctaatagtttaagcattaactgttctgttgcggattgaaacgtaacattctggctcaatcgcacctgcgccgttaaaatagcctgcagcgccgtggttagttgctcacttgatcgctgagccaagacgccgatcgccggcaagtccagttgttgcattgatgttacctgaaaatgttgattcaatgcatcagcataggccaagccgatcagcgccaacacttgacgctgactatcagcatctttagcaatcggcagcagttgcgtctgcacccgaacaaaactttccggatcgtgatccgccaaacgctccagtaactggaaaaccttcgtcacccggtcttgaaatgttgcagacgccaacaaggcctgcgcatcagccacattgccagtcaatcggcctgcgactcgtgccatttgcgaggttgctccgccttcttctagctttgcaatcacggcagagcgatcagggctttggaatgtaataacctgcgcccgcgacaaaatggtcggtaaaagttgatttttcgaggttgcagtcaaaatcacggtcatcccaggcactggttcctcaaaaaatttcaataaggagtttgccgcacctgctgtcattttatcagcatcttcaacaacaaacacacgttgattgccttcgaccccggttttgctcatttcttgcttcaacccgcgaatatcgtcaaccttgatgctttgcgtttctgttttgatcaccatcacatctgggtggttatgattcaaaattcgctcgcactcagaacactggccacatggcgcaccatcctgcacattttggcaaaataggcgcaaggcgatccactcagccaaggccagcttgccagccccttttggccccacaaacaaatacgactgtgccaattgcttgcggtcaatgattcgcgcaaactgagccacgagtttaggctgaagcgaatcaattaaaaatttggtcatcagaagcgatgaaaggcttcgatcggtaggacaaagacggtggcaccgccgacttgaacctcaaccggataggccatcgaactgtcagacgtggcgtcaagattgactggcggtgtcatgaattgttggcgggtttgcgaagtctctttgataatcttcagaacttcatcgacccgatcgtcagcaatcccgataatgaaggttgtattaccggctttcaaaaagccaccagtcgttgataatttagttgcctggatattagcatcaataaattgactgctaagcaagttgctatctttatcttgaacaattgcgagaattaatttcatgcgtgccctccttgaccgcgatgacggttatcacttagttaaatagttccggaaaacgacgagtaatggtctgaaaacaagcggcaacaaccttttccagtggctcagttgcatcaatcgacacgattcgctgaggattatccactatcagtgtcatgtatgcatcatgaacgcgttcatgaaaagccagactttcctgatcaagtcgatcatattgacgctcgttttgatgggacttgatacggtcaagtcccacctgaactggcacatctagatacaatgtcaaagccggctccagtcctgcagtggcaaattggttcattttcaaaacggcatctggcccaatttctcgaccaccaccttgataggcaactgaactgtcgacaaatcgatcacagacaacaatgtcgccttgtgctaacgctggttgaatcacttcaaccaagtgctgtcgacgcgacgccgcgtataaaagtgcttcagtccgcgcatccatagcagtgttggcagggtcgagaatgacctcgcgaatggtctcggaaatctttgcgccacctggttctctggtcaaatgcaatggcacccgcacgtgctgttcgagttgcgggatcaacgtcttcaaaacgctggtcttgcctgcaccgtctggaccttcgaatgtgataaatgtgcctgtcactatatgccgctccttctctaaacgcgatctctggtgcagaagcctacacataaggaccttggtcgcaatgaccaaagtgcggccatcacgcgcaagcctgcttatgttccggtttctaaccgcaccagttcacgctctttttggaattaagtccattttacttgatatgtttcacaattaaaaacttatctgcaaattcacgagactaataagtcgttatacataggcaaaaaagcggcaaatgtcatgatcctgaaatggcagtcatgggcatttgccgcttgagtgaatgttgattggtatcgggtagctgcacgatgccctaatggtgaatgagttatgcttggcattgaggtttttgcatgcctcctaggaaggcgaaaaaagatgccactcggcgtagcaaatgattggcgcgttgaacgttctcttgttggtacgtggaaaagctctgttaccccttcacgactttctgaaccgcgcaaaaaaagcgcagaaacctccgtgtaaggactttgagccaaaaaagccaacgcccagcccttttggttcaaggccacttacattccggtttctaaccgcgcttttttgcgctctataaatctctatactccgcaatttgctccgcagccactcgggccacaagttcgcccttgatttggcgggtgcgcgcttcgcggtagagaaagtcgaataggcctgtctgtaaggctacttgcgctttggtttgctcgtcgacttcgcgaaaagtagcaacgagcttgcgttgtgccgccatctggtcgcggacgcgatagacgagcatcattagttcttcgtctttttcttccttgacctttacctgtttgcgtccaaacattacagctcagtccttccttcaaccgccttcatcaaggtcatttcatcagcatactcaatatcactgccgaccgacagcccatgggctaagcgagtgaccttaataccagctggtttaatcagccgagctaggtattgggcggtggcttcaccttcaggcgtggcattagtggcgataatgacttctttgactgccttatttgccttaagccgttttaacaaactctcaatattcagatcttcaggaccgcggccttcgattggtgataaaacgccatgtaatacatgatacaagccatgataatcctgagcccgatcaatgctcatgacgtctttaggttgttcaacaaccaatatcgtgctttggtcgcgacttttatcgcgacaaatagcacacggatcctcatcggtaatgttgccacaaatggaacaataatgcagatcctcttttgccgcgacaagacttttagcgaacgccgtcacatcgtccttattcatatcaatggtgtaaaaagccagccgtgttgcggttttttccccgatacccgggaggcgcatataactgtcgatcaatttactgatcggttctggatattgcatagtgtcccctcttgttgtgaaaacgtactgagtgatgatcttgctgtcatgagaacagctttggtttcaaaatgatgcttatctgcttatattgctgaaactttgggtggcgaacttgggttcttgtaaaagttcggtttatgcggtgaagacttcttgatgatacttgtggtccattgtcgttctccgaaacgcgcaaaaaggcgcagaaacctccatgtaaggaccttgaaccaaaagggccaaagccaagcccttttggttcaaggccgcttacactccggtttctaaccgcgcctttttgcgctctgttgttacattggcaatccgcgtgtatacttgcccatcttatcttgagtttccttatcaatggttcccatggcttgattaaccgcttcgataatcaggtcttggagcatgtccggatcgtctggatcgatggcttctggtttgatttgaatgtctttcatgatcttttcaccggtaaacttaacggtgaccatatcggaagctgacttgccttcaaattccgttgcatacagttccttttgtgctgcctgcatttccttttgcattttctgcatctgcttcatcatgccctgcatattacccattccacgcatgtttcatcatccttttctagtcatttttgattgttacgttaggtgcatctttaccaaatagttctgttaatttgctaacaactggcggtatctgcggtttagtgtcagctttctgttccttgttttcaggggccttcaattcttgaatataatcttgtcgaatggttggccagacatcactttgaaccaaaacaatttttggctgcttgccggttaatttttgcagaccactttccaattccgtcatcagcgcggcatcattcatggcgcgttcaacgtagatatcataatcgaaactcacgatcacaccgttaggactggcagcaaccggttcactgactttcatcatggcgcgtttcgtgatactaagcagacccagcagattcggccaaacatcctttaaattggtcaggtcctgtttggttgcggcacctaaaatcggataaatagctttacgattgacatggttggctttggccttcacatgtttccgggttctggttggtggcggaatggtgccgccgttcgcctcgacccgtttcagttgatcactcagctgtttgacttttgccgtcaatttttcaaattgcggattttctgcctgtgttggtgctgccgtaacctgtggcgttgtcgtttcgcttaatcgaaccgttgccacttctagataaatttccggatgattggtcatccgcagttgttgctgcgtgctattcaacacgtcaatcatgtggtagatctgctctggcttgaagttctcgctcagaattttgaattgatcatcaagtaagcttttttctaaatcacccaagagtgtcggtgcttgttgattaaccaacagatcccgcaagtattcaatcagatcttcgattaaccgcccagcatctttacctgacgctaacaaatcctcgatcattttcaatgcctgcgcatgatccttggcgaggaccgcggctaaatacttgcccaaaacagcagtggtcacaccgcctgtgacatcaagcgcatcttccgttgtgacgtgattatcgccaaaactcaacacttgatcaagaatcgataaggcatcccgcatgccgccttcagctgctttggcaatcactttcaacgcagcatcgtcgtatgtgatttgcttatcatccaaaataaaacgcattcgcttaacgatatcttccggcgtgatccggcgaaaatcaaatcgttgtgttcgcgaaataatcgttgctgggattttatgtggctccgtcgtggctaaaataaacaccacatgcgccggcggttcttctagcgttttcagcagagcattgaaggccccgctcgataacatatgcacttcatcgatgatatacactttgacgcgagcttgtgttggcgcatattttgccttgtcccgaatgtcacgaatctcatccacgccgttgttagaagcggcatcaatttcgataacatcggtcaaactgccattattaatagcctgacaaatttcacaagtattatctggctcaccatcctccaagtgtagacagttcagtgccttggccagaatcttggcgaccgatgttttgccggtgccgcgggggccggtaaaaagataggcgtggcttgtctggccagtaatcagcgcatttttcagcgtcttggtgatggcttcttggccaatcacatctttaaattgctgcgggcgccacacccgatataacgcttgataactcaccgtgccgcctcctttaaacacgtttgctggcgcagtcacctgctcataagggcctcaggtgcaatggccaaaaaccagccatcacccctgagcccgcttatgctccggtgactaaacgcgcccgttcacgctcttctttaaacgcgcttaccggcgcagtcacctgctcataaggacctcaggtgcaatggccaaaaaccagccatcacccctgagcccgcttatgctccggtgactaaatgcgcccgttcacgctcttcttagtgaaatattcgctgtgttctagtttaccatagctgcctcatgagtagacagaatctgcgacaacaaaaacggccgctccaattacaagcgaccggtcaatttctcaataacaaaaggcacatgacgaacctaccttagtgctgcttccttccggacctgacacgattcggaaagccatcattgccttaaggcccttcggcagttttcattataactgattctcactggtttgaccagcccgcttggcggcttttcttttggcccggatcgttcggaaaaacgtttgcagcaacgtggcgctttcatcggccttgatgccgctgaccacagcaacttgatgattaaagcgggtgtccgccaataaattataaaaagtgccagcaacgcctgctttaggatcagtggcaccaaagtaacacgtcgccacgcgtgcattgatcatagcgccagcacacattggacatggttctaacgtgacaaataagctgcaatcttccagccgccatgtaccaagcgttttgcatgcggcctgaatcgccagcatctcggcatgatgcgtcgcatcttgagttgtttcacgcagattataaccacggccgataatctcgccttgatggacgatcactgcgccaatcggcacttcgccgattgcagcggcttttttggcctcgattagagccgcatccataaattgattgatgtcgtgttcgtccatgattgccaagcactccttgttttatcattctgatgccaataaatagccgtccatcaggaaaatcctcatggacggctattttgatcacgcagccagtttatttacctgacgtgtgatagccacatgtcgctaaactaacggctagtgactcagtgctgcctttaagcgatcaatggctgccatgccttggtcgcgagccgatccggcatattcgctagcactgtcttttagactgcgcagcttgtcgctaacccggagcagactggcaacatcatcatcgctcaatttatctaaaacggtttgaacccgatcactgtcgccaaaaatcttcttcacgaagccttcaacctgacgccgttggtgctgccgttcaaaatattcagtcaaacttttggcacacacaaatgcccctgctgcgattgcggcagcggccactgcaccacctaatgcgagatatttcgattttgtcatgtcatattgctcctttctgtcctgacctgagtgtaccacgcctagtataaaaacacttattttgtcgctttaagaatatagtacccgtgttccttttttacaatgctggcatctggataaattgttttcatcagtttcaatgcagatggcgcaccttgtttcttttgaatcaccgcatataactgaccatgcggcaacaaatgctcggcagcgccggcaagaataccggaaacgatggttttaccagcacgaatcggcggattcgtcacaatcacgccaaattggccatctatctgatcatacatggaactttcgacaatcgtgacgttgctgatagcgttatccgttgcattgcgctgtgccaaagcaagtgcacgttcattcacatcactcatcgttacttggcgatcaggaaagtgcttcgccaaagcaagcccaatcggcccgtaacccgttccaacatcaagtatcggtcccgttggcaattcttctgccagtaaggttgcgatcaaaacccgactgccaaaatccaccgtgtgtttcgaaaacacgccattatcgctggtaaagcggagcgaatgcccacctagctcaaagtcaaagctgtgctcatcatgggccaaatcaggatcattcgtataatagtgattcaatattggtgcctccttgttttgcgcagcgctaaaaattatctgctagccctcagccatgaaaaaggactgtcaaagaccatactctaataacacctaacatccggttatttgtcaatgccttgaccgagtcggctcacccaggctaaccgctttggccaccacttgttcggcgttgcaaaagtgaccttctgattcacgaccatcatgatctgcagcaacgtgaatagcaatgacgtccgtttacgataagcaacgtacttcggtacccactcagtcacatatttatttttatacgagcgcaatccttggaatccataaaaccgatagccgtattcatacacaaggtgagcaatcttttcttcaataaaagaataactagacgtaccgacattcgccagcggggccatccccatattgaaatacttaaagccgcgatccttggccaattcaaacagatgaataaacacttcatccataataccagaaggcgcatcggcactggaacgcatcaaatcaatgctagtgacttcattattacccgtcggcatatcggtcgcaaacgccacaatcttgccatccggcgctcgcacaaccgcaatcggtgcctgattcaggtaatggcgatcaaagaaccccaagctgaaccctttctcactgcgcccgtccaaccatgaatcagacacggtttgaaggtcgtctagcaaagcatcatcaaacggcggcttgagcagctcgacactgtagccttcacgctcaaacttgtgcataagcgcccgctcaccttttcgcttcgtgccagccaatgtaaaggttgtcacatccacataaccttcttcaccaaacttcatgaagtcaaagccaaattcatgcaacttcatcgtcaggctttcattaatttcataaaagactaacgacatatcctgatcgtctgcctgtttcataaagtcagcaatcgcggctggaatttgggtctcatctccaaccggttcacccatgacaatgagtttatcggccttctttttaaacaggaagaacacgcgatcttcaccgtccacttgataaaaatgcagcgatttatcacgcatcagtcccagatggctcacttcattcccgccaaatttagccacaaccgccttcaaacgcgcctcatcgtaaggatcggccagcgattttgtcggcgccgacaaatatcggaagatgagatacaccgtcagcgcggccagcatgaccccgatcaaggtggtgaagaacatccgctcagacgggaaaaggaaaacatctggcacatgccggtgatgaatggcaggcgcattatagaacacagcaaatgcataaaagataaacgtcaagccaaagacagccccgtcaatcagcttgttgccccacgacagcgccaaccggtctctggtcaattcacgacgcgtcaagataagcgcaatgacgaccaaaataaggaacacgataaagcgcagatgattatcctcgcgcaatgacgccaccatcgccacaatcaacacaatcacagtcggccagtaagcgcgcttcacgcggctggcaatgccacggccaaagccaagaattaagaaagccacaatgacatttgtgacccgatcaaggaataggaaggtgtagggataaaggcgctgatacaaggtgttttgaaaagcaagatcaggcgcaacaccgcgcaagagcaacataatcccagaaaaatacaggaaaaccactagaaagccgaatgctgctttgcgaatcaactgcactggtaagccttcaaggtaagcattcaatcgcttgccggcatcttgcgcaaacaaaccggcaccaatcaggaacggaatgacatagtagaaaagccgatagaaaagcaaccaaacaacggcggcactactgtccagacccaactggccgagttcaacaatcattaacacatcaaaagaacccaagccgccgggcaccattgaaataaccccgatgacattcgccaccatgaacaacggcaagacagacgatagcggaatgggcgcctcaagaaaataaccaatcaaaagaaagaaagcagcacaaccgccccattcaagaaatgatcccagcgtcaggcgcaactggcgtttgagtggcatatcggcaaaaaattcactatcacgcacatgggagatgatcatgagcaatgggaaataagccgcaccgcccacaagccagacccaatagttagcaaactccgccccaataccaaaaacaaaaatgacgacaatcccgatcatggaccaaagcgacaacccagccaacaaaaacatcgcgatttttgaaatcgcaaatagcacctgcttttgagacgctttttcatggtaaaagtttgcccgcaaactagcacccagtaacccaccaaagccggcaatattggtgaaggtgttgacaatccagcctgatttaatgacataagccggtttgtagtgccctggtaacaattcagtaatcacaaaatcataagttagcatcggtgtaacggcgatcagccccacaactaacaaaatcaagagcgaaacagggctttgcgtggcgaggctcgcccgcatttgttccccattcaagtcttggctgatccggccaacctcaaaaatcacaaacactaggactgctagcacaaacagtactttaagtgtgatgagatgtttctttaaaaacgatccggtttctcggaatagttttttcattgctgcgtcctccgtgtctatattcctattcattataggaaatctacaagcctctcgcaccctttctgacctttttgtaaggtgatgtaagtttgcgagatgattgaaaaaattttttaacttttttagttgaaaacgcttgacctgaaacgcgttacagaaattacactcagtctagagtcaagagcgtgagcaagaccgtttagaaaccggagtgtaagtggcctcaagcctaaatggctgggtcttgtccatttaggcttgaggttcttatgtgcaggtttctgcgactgtgaacgcgtttccgccaaagcgtgatccgacgcgcttagaaaccacatttaggcaatgatctcaatcaagtcagcagttattttcaatcaactcataggaggtaaacatcatgttaatgcaaacacatctttatcaggaacttcctgtttatcaggatacgcaaattggcgccttgaaggccatcgctctaaagttgaccaatgatttcaattttgactatcaagaggttctaagttccttgttagccagcgcgggtgagcaaacgcaaaccatcaacgatcaggcaatcttaacgtatggtcatgtcaccagtttgacagaacctgttgttattggctttgattttggcaaggctttaccttgggccgctggtcaccaaatcagtcaggcgattgtcttgttagtccctgtcgacacagctgaggcaaccattcaggatcggcttcagacaatctccgcggcaattgcacaagatcaggatttgaaaacaatgacccaaacggcaacagctgcaatcgcttagtcatgctcacaatgagctactgcattaagatcaacgtttatgtcacaaaagtcggcatatcagggtctaaaacaaaatgaccactgacacgtcggctttttgtacgcttggctttaactgcttgttatactggaactggaggtgcttttatggcgaatattcatgacattgctcgactatccggtttctcaacggcaacggtttcgcgcgtcatcaatcagcaacattatgtagcgccttcaacccgcgcagcgattcaagcagtgatcgatcaacttgattacgtaccaagcacaatggcacaaaaccttagcgcaggcaaaacgcggacaatcggggtcatcttgccgcacactgatcatccctattttgaacagcttgtgaccggcattttgaatgcagcaatggccggcaattatcatgcggtgatcctgccatctcgctatgatcagtcactcgaacaagactatttagaagacttacgccgtcatgcatatgatggcttgatcttcacgtctcatggtcttggcctgcgcacaattgctaagtatcaaaaatatggccctattgtggtttgcgaaaatccgggaaaaatcaaactcgccgccgcttacgccgaccgaacacctgcttatcaagaggcattccagtggatgggtaaccaaggctacagcaaaatcgccttgctgctaagtcggccctatgcccaaagtgcgactagtaaacttaccatcaacagctatgtggatgtgttcggtaaacgtcctgctgacgaaatgattgtctatcacatgcgaaccttcgaagatggctatcaagctggtgcgcggttagtcaatgagcatccagactttatcctcggcaatggggacgatatcacggccggtcttcgccagtatttcgtcgaccatcacctgcccatccctcctttaatgggtcaagagaatcagctttccagtcgattactgcaaatgagtacgatcgatcatcatgttacagccatcggtgcagcagcgttaaaactggccttgcgcgatgacattgctcagacggtgattcaatccgatttgattttacggtaagtatatgacaataaaaaagcagcaacctgccatggcttcaaagccatgataggttgctgctttactttttgtcgatacgctgctgccctaaacgcaacgcatggacaggctattcttcacgttgtttccgtttcaatcctaatacccccatcagactgaccacaatgacacccaagaagccaaacgctggccgctcagttgtctctgctgtcttgggtaatgctcccttaccggatgtatgttgaccattacgatcagtcgtatcatccgtgctcgttgacgtcgttgtggctggctttgttgggatattaccgccagaactaggctggctgccctcatcgcctttgttcttacctgtgtcgcctggagcgggcgacggggtaccttgaccgccgcctttgtcgctagtaccgcttgtatcgtcgcctttaccagctgtcttggccgcttcaacggcagctgccaccttcgttttcagactttgcaaagcttgtaaatgtgcaagcttgtcagacgcatcagcactggcttgaccagacgtcaatgtgtcagcaatgtcggcataccaagttttgccagttgcagcatctttagcattgccaacctcagccggtgttgccgctttaataccctccgcaagttttgctaatactgcatcaagtaccttggcaagagtcgcttgaagctggtcggccgtttgcgtgcctgcttgagcttgtgccactaggtcgtctaacgctgccgtaaatgttttgccagtgcttggatcagtttgattgcccaagtccgttcccagcgcagccttcacagattgcaactggttaagcagcgaattcttcttatctgcaggtaatttggcagctaattgattgattgcagtttgcaggtctcgattggcaccagtaagtgaatcaactgaggcgtccgtctgatcaagcgccgtttgtgccttctgcgttgctgctgctaaagcagtcgttgtggcatcatcatacttaccgctggcacttagcgttttggcggaagcaatcagattagtcagtgcctgcttagctgcctgcaattgtgcaggatcatcagtcttaatattggtcacaacatagtcgacggctggtgattcattaccgtataaatcagtcgacttaaacttgaaggtaccatttgccgtgaccgtgacaccggctgccggcacatcctgatatgtcttgccaccatcagcactatactgaaccgtttcacccgttgcggcagcgtttgccgtcagagtcaccgttttggctggttcagtggtacttggcgtcacagttggtgctgccagtgttttctttggttcgtagtaaactgtgatcttcttggtcgtggtgttgttttcgctatctgtaacagcaacagtcagcacgtttttgccttcgagcaatttaacgggttggtcaatagccatatgacctggtttgccgctattgatgttgatgtctgcgtattggctggcgacattactgccgttaattgacagactcagatattgcgcattgtcagtggccgttccggtaatctggaagttcggatcgttggtataaaccggtgcatctgtcgagctgtccaatgacaatgttggcgccactgcatccaaaatgaaggtcaacgcttcttggaaggtcttgttttgagtggtgtcacccacaacaaccccaaacggtttttgtccaagagtacctaaatctaaagtgaaactgaaagtcagatcatccttgattggaatttgcttaccatcaacctgcaacgttgtcgttgggtgcttgaccttaccagtaatcgtcgcaatcccggtcttagggtcatagaacttagccgaggtggcattgaattcattggcaccaaatgtcacaccttgatcgaacgtcacagcattcttcaacacatcaggatcataagacgaggtaatcgtcttttgctccgtcgtggtgttgccgtcttcgtcggtggcggtcaccttgatggtattgtcaccataattaaccggtacatcaacactaaagtgatgttgtgcatcaagtgctgctacggtgtcgccaacattaactgtcttggtgtcagcactaaccgtccctgtaaccttgatggtcgcttcggaggtctgatccgagccattgttgaatttcaaatcagtaaaggttggcgccgtcagccgaactttggtgtcaaaatgtttaagcaactgggtgtgcgccttatcggcatatagatccacttgcgcggcgtaatcagcattcgtgaccgccattgaggcagtgaaactgttagtcgcagcatcgtaggttgtgttcaaatcatgtttctttccttgtgcatcagtgtaagtaccgtcaaccgctgctggatacgttccactaaacgtatacgtcccgccaccttgagtattggcttcgtagccagttgtggtacttgagatcttgtctgggataccgccgccgttcacaattaaatcaaacgatgtagaccccggcttctgaacgctggcatcttgatcagtggcattggatgcattatcagtcaagtacagctcagccgaattgtcgccattgccaagtgcttgggcctgttcatcagataatggcgtttcaattttggtgtacccatcagccgttgtcccagcatcggtaaaggtagcatcaagattcgtcacttcattaattgcagttttaacgctcttggtggcatcaagaccactcaaatcatccttggcttcagctgtcaaataatactgggttttcccattttccgttttggctgacaaagcgacatgacgaactgtcggcgccttagagtcgagcttgaaaggcacatcaaacacttgacgtttgtcgccgccttccggtacaccggaaatacgataagtataactgccatcatcagccgtcttgatgttgccatcacgttgatcataataggtgccatcccacgctggagcattgtagtagatgtacttctgcgaacgagcatcataataggtcttcgtctgattggtggaactgctgagagtcgtaactttattgccctgaccatcaagaatatcaacttggacgttgctgatattgcgcaatagataatactgcatgctgatgtcattatataaggcattcttgtcactcgaaaaagcaatcgcctgatcgtcaactgtctgtttgccatcagcgtctgtgaccatgccgccataatattgatggcctgtatttttgttcgtcaatagtggcacggtgccataattaccaccagcaggactataagtgatcccattgagactatcgacaatcttaccgtcattccagtcaccaaaaaagcccatgtatggcaagttcaagcgcgacccatcactccccttaaagttcagaaaaccttcaacaaattgctgttggtcaaaagacttcggcaaagatagtgtgaattcaatctgcgccgttttcccagcaggcacagttatgtcactgccggctttaatggctgctccatcaatcttcttgtcatacaaaaccccagaattagggtcagtcgctgatgtataaacggcattagtatccgtattactgtccatttgataggttagttcatgggtcgtgcggttcgtgaaggtcagtttaaaggtcttgtccgtactcgtgaagtctttcaattcaactgccgggtagccgttttcggcgacaaccgttgacggattcttttctaatgcatcaatggctgccttcacatcaaccagaccggcaccttgccgccgcggcgatacgataacattgttgtagttaatatcgttgattggctgggcagtattcatctcaactgtcttaagaaaatcggtgagcgctgtccctttaagttgtttgtagtcagcataaaatgggttgtttttgttattcaacgcttgtttcaacaatgcttgtgaaccggcaataaatggcgaggccattgacgtaccagacatatttgtgtagccattgttgttttgcgttgaccagatgttgccgcctggtgcggtaatatctggtttgaaggaaagattggaaactggcccataggatgtgaagtcagacatcttgtcttcagtatatttctgatttggtaacagcgtcagggcaatcttgacaccgagactatcatccgggtgtgctgtgacccagtcaaccagcttttgaccggttttactggagagcccaaatgttgggaaggtggtggttaacgtaatagaagtcaacggtgttgctgtgccatcgttgttgacaatgatcaagccagcagcaccagcggcttgggcgtatttttgtttgtcagcaaaggtaagttcgccacgtttaacgatggcaattttgcctttagcgtcagcagtatagtcggctgctgcccctttgctgaggtcgccactagcatctttgacaacataaaacttcttttggtcaaagctaccagtgaaatcgttgcttgaaagctgcatggcttccggtccaagccctaactctttaccatctgtaatggtcactgcctgacccatgacatccgtgttctcagcggaagcaactgtggtccctcctcgtgatgtccctggcgttcccaccatttcattgtcttgcaaaccgtaataatctttgttgacgccttgagttgctgaaccggatgttcctgcgttcccagcagaaatgacggcggctgttcctgattcgttagcattttgcaccgcagcaatttctggatcctccaaggtttggttgcctgcatcagatcctaaggacatgttgaggacatcggcaccgatttttgccgagtcttcaatggcagaaaccaaggtagctgacccggttgttgcagaagtatcagagttggtgaaaactttcattgccagtagctgtgcttctggcgcaactccgacaacagacttggttggatcgtcacctgtcccgttagcaccgatgatcccagcaacatgcatgccgtgttgttcgtcaaccgtatcatctgtaatggtgtcgttattatcagcgtaattaaacccatatggcacttttgaagtaaaatagcggccatgcttggcggtatcagtgaatttttcaacatcggatttggttagtttaacgtctttatcatcgcttagccgcatgtctttatgtgttggatcaatgccagtgtcaataaccgagaccactgtgccttcacctttatatttgtaattggaccatacggcttgcacattcgccatcgagttagccttagcatcagtcggataataaactttcgccaatgtgactgttttaactccggcaatttgtttcagtttagggatatcaacaaccctaactttagttgaaaagccgttaacgacatagccataactttcaccggcagtttgttgggtgacttgttcaacagctgccttaacgcttgcctgagccgcgatcactttattggtctcctgctgaatctccgccgtgctggagtaatcagttcttaaagtgccgttttcagaggcaggcgctgcgctcatttgaacaatgacgtcaacataaatatcttgctgctgaactttattcagcttattgtaatcaatacctttagccgccaactgtgtagcaatcgcttgattcgttgtcgctgcggttgtgtcagtggccgcttgcttagcagtcgcggccttaaccgtatttgcgagtgatgatcccttagtttgctgcgagatagccgcctttgcttggatttcgccgactggcaagacagccagcgcccctaaagcgactgtaccggctaacaagatcgatagccctttctttttcctttgcatccaataccctccacttcccaaaagtttcagaaccaaatcaaagcctacgcttgatgtagttaagattatatactctcgaagaacagattcaacgaaaactttaatcttttattaattttcctatctgtaaattagcttttagtgttattatttagccgtttacagactatagatgttttgaaatttttggcattattagaaaatgagtatttgcattgaaattctcaattgccaacgctagaataaatacacaacgtttactgtaagcatttcagaggagaccgagtcgatgaagaaaaaaatgcgccttaaagtattattggcaagtaccgcaactgctttactgctgctaagcggttgtcagtcaaatcaggccgaccaaacagttgcgacctattcaggcggcaaggtgactgaaagtaacttctacaaggaactcaaacagtcaccaacgacaaagaccaagcttgctaacatgctcatttatcgtgcattgaatcatgcctatggaaaatcggttagcactaaaacagttaatgacgcctatgatagctacaaacaacaatacggcgaaaatttcgatgctttcttaagtcaaaacggtttcagtcgcagtagcttcaaggaaagcctacgaaccaactttttaagtgaagttgcactgaaaaagttaaaaaaggtttctgaaagccagctcaaggccgcttggaagacctatcagcccaaagtgactgtccaacatattctaactagcgacgaggacactgctaagcaagttatcagtgatttagcagctggcaaggattttgccacgcttgcgaaaactgattccattgatactgcgactaaagataacggcgggaagattagttttgaatcaaacaataaaacgctcgatgccacatttaaggatgctgcctacaaattaaaaaatggtgactacacgcagacaccagtcaaagtgacaaacgggtatgaagttattaaaatgattaaccatcccgccaaaggcacctttactagcagcaaaaaggcgctaaccgccagcgtttacgctaaatggtctcgcgattcaagcatcatgcaacgcgttatcagtcaggtattgaagaaccagcatgtgacgattaaagacaaggatcttgcggatgcgctagatagttataagaagcttgcgacaacgaattaaggcttaaccgagtaagatgaaataacagccagttcttttagaaattggacatcaacgccccaaaagtcatagcaacatgactttcggggcgttttatgtataaaaaaaacatctcgcctttcgcggtatcaccacgattgagcgagatgcttttatttgaagatggggctaggttatttgagggtagtaacatcaccctttgatatgcaaggaatattaaatgaatgtaccatctttgtaccggaaatccatgaaaactacgctttcaacgcaaaaaagtcctccacccgcgttagcgagcagagggcctatttgcaatgtgcttaaaatggactgatcgagctaataccgatttgcaaacgatcaagcggttctccaaacatgccggcgtatgtgtctgtgtactgtggcaaactcgtgccatcatcacacacaacgccgagccagccagcccgttgtgtcgtctgactgcggtaatacgcttgctggtacggctcaccagcaggagtaagaaagatgatctggactccatcaatcgcttcaccagcaataccggcacaaccattaactagatcgttgcgatcgccttttgtgacccaatctagccaaccactttgaactgtgtggacgcgatacttaacgctaccatgatcaactttgatgtacagcagatcatgctgataattaggcataccagcaaaaccgttgtcaccagatccgaagttggtcacctcatcaagccaacggacaccgagcaagtgcagaccgtagctaacgttcacctttggagcgctaacgctagctttagacgcaggcacaggttgtgaatttgttgtcccagtataacgatagacataaaagtaaggctgatcattcatggcccaacgggcgtcgtgattctgaatcgtttctccgaggtcacgccatgccgtacactcaagccaattctgaccatcaatacagataccggtatgaccaccagcaccagcgctgtaccctttacggccccagataacgatgtcgcctttttgcatttgccactcagtgttttcagcgatcagttggcaaccgttatcaatcagccatgcatgcaaggtttcggtgctaggaatatatgacattggagcaaatccaccttgtacaaggccggtatagacagcccctgaacagtcgcaagtgccgtcactgaaattacgcgacccatacattgaataggtgacatggccaattttgctctttaggaacgcaattgttttatcaatatcaaaagacattactttgcctcctcactagctactggagcaacagatgccggagctgactccgccggtgctgcagaagacgtctctggaaccacttcactagcagcagttacctggtcagcctctttatccgcttgcagtgccttaatctggtcctctaaggacttgatcttagctgccttggtggtaatgagtgccgggtaagctaacgcctgttggctgtcgctgacgccctctgtggttgggtcaacggctaccccgacaatggtcaataatgcaaatactgcattgaccactgcagtgagttctttacccaaactagcaaagtcccagttgtaaccgaagactgccgccaccgtttgaatcaccaacaaagaagctggcacaatggccagccagaatttgacgcttaatactcgtactttccaattaatcttcatggttatcttctcctttaatgcctacatggtcttccaatcgagtaatcctaaccgagtgactgccgagctcgtcatcatgtgtcctcagatgttgtcccaagtctgccaacgactgttcgtgcagctcgagctgacgattaatcgtatctgacaacatttgaatgtctgaacgcaacggatctagggcaatctttttgaacagccagctgcccgcacttacacccacccctatgattgatataacctctgcccagtcaccaatcgtgtatccaaaaaatgtcactttctcacttccattccacaaaaatagccgctagcttttgctggcgacatagtcattgcctgtaatctgtttatactcgtcagacgtgattgctccagattctacatagccctctatctggcaaccccacgcgtacatctgttttacaaagtcccgcatcagctctcgccccctaacttttcggtgagcgtggtgacttttgccgccaattgcgcgttttgcaagcccagtacgttgatcatctgttgctcaggagtgggaatcaccttgttagcttcggcttcgagttctgcctgcttagaagtatccaacacaaattgaccatctataagcttggttgcccccatgacgattgtgtcaatgtcgcccggagccacttccaccgcgtccgtggtatcgaatggtgtctgccattctttgccgtcccaaaattcctgctggtagccagtgatatagccatcttcatcagtgctaaaaattgcttttactttgtcagcttccataacaacctcctaaactgcgtatacctcagtcataaccgcttgtgcaagcgatccgcccttgttttcatcagccccaataatgtgtgtatcgtcataccatataactttgaagatggtcccaacgtttttcatcgtgaaggtaactcgtaaatagttagcaccagtcgtgttgtagatcaatgcggccttgggcaacagcgtgaacgcatagttgttatacgttggcgatccgttttgataatagctccatgcaattaaccatccagataaagtctttgaaagtggcgtcgatattgttgcagtatcagcctgagctggatagaaagcgccatgccaaacaagcaagttattatttgttaattgcaagactcttaaggcatctaagctactggtgatccactccaacggcttgttactggcagtttgatagttgccgcttagtgttaacatgcccaacgatagttgcgcactatccatcagcgtgcctttgttataaatttgacttagcaagccaaattggctgagttcggtatgcgtcacctgactgttgtcagtatccgaatacgtatctgtgacaatcttgccatcggccattgtggttgtcccgtggacggtatagtcagcaacgccatcgggtttgatacctttaaatgaagaaatgaacttagacccggtaaatgtaaccccgttgaatgtcatgccgttaaatgtttctgccgaaagaatcttagcatcgattttataggggttccatttagtcccatcataggtgtaatatcccgttacaacaccgctgctatcagtcagccaatgcatatccccctttttaggacctgatggatacgcggcaccaacagtaatgactggcacattatcgctaccgtctttgccgtcacgaccatcagtacctttgaacaatgcccatgagtattttgttggatcggtactatccgcttgggtctggtcaacatactggccaaaataggactttccattaccatccgttgttgaaaatccttgacttccatcaatgctgttagcataggctgtatgaaagtagctagttttgccatcggctcccttagggcccgggataccaacaccagtatcaccttttggcccctgcactagttgccaactataaacagctggatttgtactgtcagcctgcgtgaagtctgtataactaccaatgtactttctagaacccggagtatccaatgaaaagttcgttttaccgtcactgctatcggcataggcaatatggaagtacggcgttttaccatcagctccagatgggcctttgatgccttggtcacccttttcacccatcttagccaccgagtagccagactcactggttccatcggtataactccatgtcgtttttgtccagagaaaactaccagctgcaacactaggaacagtggttaaccaaccgcttgttggcttgttggttccgctagtcgacccgacatattcaacctttgtagcagaaattcccacaccatccttaccagcaagaccatcgttaccattattcccatctttaccaatgtaagtcgtagaataaccagactctgatgtgttatctgtatataaccacacagttttcgtccaaagatatttgcctttgatgagtgatggaacgctggtagtccaaccagtcgtcggtgtagctgtgccggagtcacctagtgcataagtgattgcggttgattttatgccaataccatctttaccagctacaccatctttacctgtatcgcctttatcacctttgattaatgcccatttataagctgacacgctattgctatctgattgagtgaaatcggtgtactggccaatatacgcgcctacagtttcgccggaattagttgtaaaagtttggccaccatcatttgagtaacgtatatgcaagtagctggtctttccgtcagcacctttttcaccagcaataccatctttaccagctactaattgccatttgtaagcactagccaaagttggtgctatggctgtctgagtggtggcataaccaacgtatttggcacctgttggatcactagtcatttcggtaccatcggcgtttttgctgtaccttatccataaataacttgacttgccgtcttgaccatctttaccgtcaaagtaatcagtacctttgatcggcgtgtaaccgtctttgccatcagctcctttaaaaagcgcccaattgtaatcactcggattggtgctgtcggcctgtgtgaagtcgctataggtgccaatatattttttgccatcaccaccggataccgtgaacccactttgaccgcttacatcgtctgcccaagcggtgtgaaaatagcttgtacggccatcagcgccttttgcaccgggaacaccatcagcaccatcggcacctttaatcagtgcccactttccggcgtaatcagccggattgtcacttggaacggatgacttgacattggtaacaaaagccatgtacttcttgccacttgggaaggcactcatgttggtgcccttgtcatcgtcggcatatcgaacccatgtatagtattgaaccgttttaggcaaatttttaattttttcagcaagttgccgatattgggctgctacctgatcatgctcaatgaggtagtctcccaatgttgctgtgtgtgtatccatagaatagcttgatttgagttctagcaagcgagccgacaagtacaattgctcattctcgtcagctaaatggatcgtatcaccaatgttgatatttttaggcagcacagcaatgtcggtctcgtaattgactgcttcatgattgtgagccttaagatcagagagtgcagattgaagcaaactcgcttgcgaagtcgccgtataagtgacaacacgattgatatacgctgcattgacactcggtgcaccacccttagctaaaagtctgctccatgtttggttggctaccgggtcaagcaaaacaccttctttcgttaacacgtaacgaccatcgggatctgtccattgatagccctcaagtgtgattggatgctgatcaacggtctcgccatctttgctttcaggtgtgccacctgtcggtgtaacggccgtataaagatcataaatactgcctgatgtcacaattttattgatgtctttatccacatacagcgtgatgtttctgtcagcgccgatacgctgatgaatgttgattaagcggcgcacaaccgttgtccctgacacatcgaaactaaagtccagttcagcattatcaaactgagtcgcaacagatagaatacgatttaaagtggtgtcagactcgccagtccattcaagcgttcgcttcaaattagggatctcgttaagaccgatttcaaaacctgaatcattcgtgaataggctaatatagtcggcgatgcccattgcttgtggagctttataggggccaacggtctcgttaatcaaatcaataccagcatcttcagcagtgaatgtgtcctcaccagcaagcggatcatgacttgattccataattgtcataaagactgccttatttcgctcatccatatacagaatgtaattgccacgcgctgccattgcttgaaccttggacgatagttcaggagtgaaccgaatagtacccgaataggtgcgagcacctgctgagataagctgatcatcagtatcatcgacaatgtggatttttccaccaccgccagcagttgcaataccgagcaagtgccatgatgatctatccacaaaataaaaatctttcatagccatgcctcctgccaagatacttcagccttacactgctttgcccaacttgatgtgagcaattcgatggtgttattgcctggctgaatcttgaagccgccccaatcattgccgattgtttgcagtgtccgatcttctgcaccattgacaagaacacgtcgattggcaacatcaatttgcacaacgtccccgtctttgaagcggttaggaatatcgtcccagtaatcaacgttaatccactcaaagtagctgtcttgccagttaattgaccaaccgcgttgatcggagaatccggggaaccaagctgtccagccatcaattggcacactagagaagcctgatactgtccgtgtctcaatgccaccatcgcccaaatcaatgcgatccaaacggaaggttaactgatcacccatttttgtgataacagcattgtagttgccgtcacgatagtaattgcgtgggagtaagtcaaagaagagcatctgtgcttggctgccatcatagactgtaccagagaaaacccattggtcattagaggcactatcgtcaaacagcgcaagagaagcgacaatcttgcctttatacgttaaattgaactcgaaacggcctacttctgcggcattcgtcccaacgttgacacgattgacaaactgaaaattagccgtgttagagcccttcgaatttttaggaatggtgccgctcattgaaggcccattccaataattggagtgcgttctttgtgtggacggataagcaataccatttgcatatccaaacggtcccgactgtacgttggcatcattgccatgctcatagtaaggaaaagccgtaactccattattgagcgtgacccctgtcggtgtctgattgaaatcgagatgataaacgcgttcagacttttgcttcacaaagccatcagtctcatcgggagagccgaactgtagcacactgccctgatcattaatagcagttaacacgccgtcatcaccgttgatagtagccgtaataaccggttcagatggataagtcccagcattaggcaccgtgatggtgttggtatagtattcaggatcagctgggttaggcgaccatggagaaacggtggtaccagcattaagcttttcttcttgccagtaaactgttgtttttgcattaggaactagtttcacaagtgttgcaccattggcaacaatgctatcaactcccgaaggaatcgtgaacgtaacagatgaatagccagaagtgccggccttaatgatattgccaatatagttcagtttccaatcaggccctgagaacgtggcaacaacggcattcaagtcaacggtattatcatttgttatgaaaatttgatatgcaaacttttgaccaggagttactgaaatatttgggtgtttgtttggggcgttccaactattgatgtcaactgttccacttgtctcctgatcacttgttcctgtcaacaggttcaccggcacgtccttgtatggcatgttgtcagccgtctgcgtggctaccgagtgcgcaatgccatcggggacaaacaaagtaaatgaggaagtgatcgcattccggcctttaggaacatcgtcaatatcagaaaaagtagcaatccaatattttgatgggtcatcgttgaaagaaacctgatgactatcgccatgaaggatgctgttgagcttatagaatgcttgccggaacgaaagattgtccgatgctgccagcctgtagccgacaacaatctcacgagaagggttacgagcatactggatgaaatcaccatctgacttgccaatcgtttgtttttcgattgactggcttagtagttctcggccactgacttgcagcgtgctataacccggaatcaagtcttcaatgtactggccatctattagcattgcctctgctgggtgttgattaccatcagaacccgtgaagggcgttgtttctctgaaatcatacaaaattaaaatagcccctttcgtcgattgctaattcgtgtcatgcgactgagctctgtttgcattgggtttgcggttgcacgagcaacctctcggccgtcaatgtacagaggaacctcaatcgtttgcttgcgagtgtagttgacatcaagatttgaagacaaggttgcaccttgaacgctgttattgagcgactgcaatgatgcatcaaagggagaagtattcactgccggcatcgtaacagcagcgctatcagcaatagcttgtgccatgctagaaacattactttggacgtctgagaacttgtcagtaagccctgcattcaagccgctcatgatggcgttaccggccggtatgagcaatttggcatcgtaactgattgggcctttatgcttgcgaatccaagaagctattccgccaacaaaatcggtgaccttcccccaagctgctttgaggccattgaataagctatccatgatggcgcggccagcgtcagccaagctaaaattacgaagggcattgaatgatcctttgatgccattaactattccacttaccatgccagtaaaaccagaccatacagccttagcaccattaaaaataccagtagcagctccaatcacaatagacttgatgttattccatgcagatgagaagaatgatgtaatcccgttccacaatccggaaaagaacccgggaagtgcgttccaaattcccacggccgtgctgactgttccgctccatagtccggataagaatgaaacaacactgttccatacaccttcagtggtagacacgatgccgctccataatccgctgaaaaacgaggaaagcgcactccaaatagcggaagcggcagatactgcaccattccaaagcccctctaaagttgaaaccaaagtattccaaacagtcattgcataggtttgaataaggctccaaataccggagaaatacgtaacaaggccattccagatctgaccagcggcggaaacaatgctgttccagataagctgaagatcagcacttaactgtgtccaatttccagtaagcaaatcaatgacaataagaatgggacccataataactgctttaagcatgttccaaacaccggtagcaacttggacaatcccattccaaattgtcgtcagggaaccgccaaaggttgaccatacagcagtggctactgcaactattccattccacagagtcgtgaagaatgtggatagcgcgttccaaactgccgttgctgcagtaacagcaccttgccagatagctgatagagtagttgtgaatgctgtccaagcagctgatgccgttgtcgtaatcccagtccatagattgctgaagaaactagtaacgccgctccaagctgtctgaatgccgctaattgcagatgtaaacgcacccgatatagcattccaaacagtttgtgcaactcctacaagtccttgccaagctccttgcaaccacgaaacaaatcccgaccaaagtttttgaccagtttttgtttgagtgaaaaagtacaccagaccagaaaccaccgctgcaattccagcaatcaaaagtacccacggattcatgcctaagatcaatccaaacgctttccatacaccaccagccgtttttacgatagttccaaagttagtgataacggatataacgcctctaatagggccaataattttagaaaaaacaccgagaacgcttgaaaagccgccaatggctaatccaattactttgaaagcaccgacagctccaaagatcgccgcagcaaatgatttaacgatgtcgttagcaaacgctgctttaacaatagctgcgaatggcttcaaaacagctaccactccgcttagagcgaccttaacaccgtcaaaaattgctttccacggtaaattagcaataaagttcccaacggtagtcatcgcttccattgctaccactccgaaatctgtaacagcttgtttgattccgttaaatagtcccgacatttgcccattaccgaatgccgaattaaaagcatctccgaccttttgtgcaatactaattagattgacaaatgcaacattgactaagctaccaactaggctccaaatggtttgtaaaacggatcctactcctttgaaaacggaactgagtccgctcatcgagtcgcccttccccaagctgcttagttgtgtcttgatgttcaaaatcaatgccgaaaacggagaaaagaaattaccgattgatgatataacagaatcaaaattaattgcgccaattttatcaatgattccgctgatagctccgacagcgactttagacattgcttgccaagcaggctgaagcttgtttgccagtgtttcctgaaggccgtccattgcctcgccgactgtcttgtaactcgtggccatcttctggaaagccttgctgttgcctgccttttcgataccatcaaagaactgctgcgtgcttattttgccgttttgaacattctgaaccagttctttggtgctcatgcccattgctttagcaacggctgccatgcctgctggagtctgttcaagcattagacggaaatcagcccactgcaccattggctttgcggccatttgtgtgccttgttccatcaaggtcttcattgcctgcttaggatcgtctgtggcagcagctaggccgcccataccttttacaaggttgccaactccttttacacctactgacgcaaactgtgcataggcagaagccatgtcagaagaactgtagatggtctcttgtgcgtaactctgcaaggacttttcaattgttgagatttctgcgggcgtttttccgaggaacttcatgttgctctcgaacgtttgccacgccttgctggaagcatcaagttcaccagccatgctttttatgcctacgccaattgcacccacaaccttgactagaccaatcgcaccagcaatcttgctcacagttgatacaaaagtacccgctggctttgtcgacttttcaaagctatcgccgacctttgatgcagaactcgcgatattattaaaagtccccgaaaagttgcggtcaacggcggataaaattgcttcaacactaaaactgtcagccatgtgctccctcctttctttcagataacggaataattttgccttcgcacttcaaccgctcaaattcggccatccgttttgcgaacacttgtgctctagtctgtttgagttcagttgtgctcatctgtgatacttcataattgggctcatactttgatcgtacgttatcaatagccgctttcttatcaaagaagtcatcaaatgtcttgaacttcggcttaggattcttgctcccagttgttgcctgcacttgctggttcatccatgcttgctgtgcaatctcattctgcctatcgacttgcttaagctgataggcttccatgcgcagttcgtattcaacaagcgtcatgcgttcgattttccgaatatcagaaaagcctagataggcaaatgcgtttaacaaaatttcgtgatacgtttcttcactactcttttgaacgctttcgtcctcatctaggctttcatgttttttgctactgcttttactgcgttagcactgttcatttcatttgcaacttgcttaaatagagagtctaagtctgtgttgctgtcaataaagtcatcgacttcattagctgacgggcgtttcttagatgctacggtggctgaataaatggtgtctgctaaaacagcagcatcgtatgcattcagaccagccagtgcctttgcaacacccatgccaaagttaatgccatgcatgacggcacccatattcttatccatttcgcgaacaaagcggacaccaaagctaagctcatattctttaccgttaatggttaattgcatgatttgaaatcctttcttttaaagccgcccgggtttcacccgtactgtgactttcttaggcgacttgcatcaattaattaaacgtgcgaagtggttgtggtggtggtagtagttgtttcgctcgtacctgggtctttatcagaatcccacttgacaccaccgccggtactatcaaggctagtaaccttgccgactccaaggaatacgtaatcgacctgttcctgagtttcgtcttctagcgttgtccagccacgctttggtgtgccgttaactgagaatgtgacatcgcgagtagagtgatcatcgggatcattgtcgctgctgtcttcttgaacggtaacttgcatgtaccaagcaaaatacttgccagcggaattcttacgcttgcggtagagaatccaaaagtctagtaattcaccgtcaaacagtgagtcatacattacgtctgcaattgcggccgtgttgttcaggaactcaacttcaagatcggtacttgcagaactacgagttgctacattgccgtccttggtaacagtggaatcactgtcaacagacggatcaaaggacagcgaagtctgccaagggataatttggccgccaacctttgcttgatcgctatgtttgcgagccaaggcaacaacgtccatgccttctagcacttttaattcatttgccatgttatggcctcctataaaatattgagattgagtatcagcgtggctcggttgagaaccgtgtcagggacactttggtcttgtgtgaactcttttgactgatcttctacacgtccatagaatcggtagtcatcggttagcacttgtccaatcgcggcacgaaaaaagcgctctgccatatcagatacggtgaaacgctgttttttgtcgccccagatgtcgatggtgattagcacattaccattgagtgacgtctttgttgcagtaggaacaacttgaatatcgccaacaatgacgaagggatacggggcgttctcctgctgcatgggcaaatggtcgtaagttttgtacccagatgattgcgaaaacgcatagaagtagtcgtagagctcttgctctggtgatgtgatttgaatcacctactttgctgcttgtttaagctgattaataaactgcactttctgataaaggaatgcaggcttcaatacaggacgcgcccgcatgaatcgagttccattttcggtgtatgggttgtattccattgacatgccaactatgcccgttaggccgccagcttcaagtgataacatgatgccatgctttgtagcaccagtaggatgagcatacacggtgccggtcatttgcttagaacgagcctgaagctgtgccgtctgctgtttgacaatttgcttgacaacgtccatcttcgctcgcttcagcaggccagcaaccaacttgtccatgccttttatctgcatattgtagctaatgccggatttgctcatttcgtctcacccacaatcaaagtggcgttttgaagcgggacacgatcagtattaagggcataatgagtcgcttcatcatcaatcgttaaatagctccaattgaaggtgaatggctcaactagtcggatcacctttgctttttgagcatagttgccgaatagctgaacgctcttgtctgttcccatgtcagtgacactggcaactgcagttgccacctttttaacatcaccgtatcggtgtgtttgcggatcatattcttcatcatcaagccagaatgtaacctcatgatctaaccgcatataatcaccactttgaatagccgggaatgaagacaacggcaccgagagactcagtattcttcccgttggcttctttccagttattgatgtcgttagcaaaatcatcgaagtcattagatttgaacgtgaacgactggccttcttgtgcgtatgacgtcatgccttcgttcttacgcctgttgtagcgtctgacacatacttctaggccaatgtaggtcaactcactaggaaatgcctcatccgttcgcaaaccaagcttaaatcgtaaggcttgcatagtattttggatgatgagattaagcacgccatcttgtgcgtcagttttgatttccatcatcgtcttcaaatcttcaagttttattggatcgctttctgccatcatttcaccgcctttactacttgcgcgtatttgtatgagcacttcgacttgtcaacgaaactcaagtcatcttcaaatggcgtgtgattaacgtacttgcctttgaagaacaaccgtttgtcttcagctgtggcaccagcattgtgcatgatcttggtttcattccatcgtttcacggggtcagtagcccaacaaaaatcgagctcatcactgatgacgggcccgatgttgaagtacatcatattccataactgcgaccacatttctgctgtccatttctggatattgctgtcgaccgtttgcaggtattgccacagtcggttgctgtcggcatacaccttccgccagtattctgctgacgggtgactgatgagccactgagcaccaccagaattgtgattgatcgtttcaagcgaagctaccgtaacgccgacaatatcagccatgcgtttcaggatttcttctccatgttcgcactgcttgatatagtcaacgctgatatagctaagcgtgttactacacagccagcgatcaggctttgctttcagcttgcgaaagtctggccgtttacggaagatcacatcactgtcgaagtagaaatagtcctctttttcgcgttcggggtcttcagctagatactgccaccaaagccaaggcttcacagacgggatatattgcttgtctgagcgcttgtcggtatacgtgtgtacttctactccgtatttgctggcaagcgtttctggcaccttataatcatgcacagtgaagagcaaaacgacatctttcatgtcaaacccgacactttgcagattggttaggcagacttctaattcccattcgaatctctgaatagcgggttgacacaaaataagcttcattctgtcctccaatcagccgcccggtttcccgtactgtcctatttcgataggcgacttgtatcaattaattaagcgtgcgaggtggtagtcgtagtagtaattggttttacattggtagtcgtggtagttgttgacgtcccggcagtgaagattgcctgaaggttgtcatcgctgatccactggcctgccttgccggcaccttgcaaagcaacgcccgcaaagttctcggattgaatcgtccgaacaacgttaataccagtgaatgcacggccgatattatcgggtgcgaagatgatagatttaccatccatgtaacgagtaggcgtcttggtgataacaatgtcacggaaacgaacgatgccgttttcatcgatgttcacagcagaacccttggcagtggttaccaactggtggtcgatgattgcgttgtaaacttcggcagtcacgtatgcacgaactgggacaacgacttcaaggtcggtgtagcgttcggaagcttcctcaaacaccttgtttacatcatcaactgcgccaagatcagccgcagcgctatcaaccaagtaagcgcccagcttgccgttgaaaagccgtgtcttagcctgtgcttgcaagttcaggcggtcagcaacagcggaatctaagtcggtgttgacagtcaactgatcgatgccttcattgaagctccagccgaaggaatacggtacatcaatatcactgtagatgatctctttcattggcccgaagcgatttgaattgctggtgccagtgccaaacgcaacgttaggatcggtgttgtagttgccaacagcaacaggcacatcatttgccttaacactgaatgcgatcgcgttgttttgaatgccatcgagtgcttgcaaaccaccaaacgttggggtgaatgtgctttgcacgccgaagacggtttgcatcaagccaataaactgcttttggtacgtacgtactggtaaattgttgttttctgtagccatgattagctacctcctatttctttttgtattgtgccatgattttattgaatggatcgtcagcaccatcaagggcagaagcaccattcttaggtgggtcggtttgcagcttagattcaacctgcttgttgaccgtctcttgaatagacttgccgagtgtttcaacagccgacttgatcttgtctgcatcacccaaagcaaccagcgaatcggccagttcaccgggcaatcccttatcgaccaacagtgacttggtacttgcggataattcacgctgattcagttcagcctcacgcttgtccaaggccgcttgacgttgtttttccagttcttgtgccttctcatcggccgacatcttagccagccgtgcgccttcgctcttggcatcttcgagcgccttagcctgttctgcttcccacttggccttggctgtttcaagcgccttagctgcgcgcttatcggcctcactgtctagctgatcctgcgtatatgtggttggtgcctgcgttgtctcttcggttgtctcgacttcttcttgagcttgtgtttcttctgccatgatggttcctcctgtttagcccaaaacgaatagacgtgctaaatgaccccagccacgccataaggcccagccacgatcacacgtctatcacttcacgctattatttttgagcagtttagggacttgctcgggtcacgagattagaaaccgtattcttgcttgatgtcgtctagcccatgtacttttgctacgagcttcacatcaacccttgtaaaatcgtcaacttttgagtcaatcttcatgtcggtaatcccgtcaatgcgcgctccgttcaaataaggaccatcttctttgaactcaattaacgcagcacgaggcacttttggaagttctacaccgatgatgcgtttatctaattctttgtgcacgttgtatgcgtcaaggatagccgcacctagctcatattctttgatgtggttggcttcagcagccaagccaagcagccgtctcataatgtcttcacgttttttaaagtcttcattactcatttcgtttcctcctaatcatcgtcaacttcatcaccagaatcatatgcagcccatgcgcaaaggcagttggggtgagcaggtatcataccctcagcttgcttcatcgtgtatacttctccgctgtgttgcttgcatatgtcacatgctcccgagttaatcacccaaataacctttttgtatccagcctcacgagcgttcacaatgctttggtgtgccatgacgcggtcactttcggttctaatgatgcggtctgactgatacttcatgacgtcaaacttcttgcgaagcgccgggctttgtgtaattgggttgctgtgcgtcagcagcgcattcttcatcatctttttgagatcactacgcaaggcatcttgatttgaccaaatgcggtcactccatgtggctccgtcaaacatcttattgattaccgacaagtccgccttgatatgctttccgtaaattgatgatcccagcttggcagtctgcttgactaaatctccaagattggtgccgatgtaatcggcaaccttaatggctaatgccgtagcgtaaacataggccgcatatgacagcaactcatcgttattggcaactgatttctgcttaactccggcctcttgtgcgtctctgtcaacttgatctttcagttctggatcgtagtaccgcgaatcgtcagcatgcgtgtagtcttcgtgtttctcgttgaatgcataccagaatgccatgaacgcggatgtgtacttagcaacatcacttgctatctggcggtgctgcttgtcctgcttgtccgcgaacgctttgatccgttccttcggtgtctttgtcattgttcgtcagatcctcactgtagtcgctgtctgctcgttgcttggcaatcatatcagtaatctcttgtggatcagtgacgcctggtgcaaatctgtacaagtattcttgtggcagtgtcgcaccagcggcaacaagatcagtaatttgtgtgatgtcgtcggttggcaagttgtcccggaaggtgaactgaatcgtgttaggatccgtcttcatgccgcctgaaacgctttgatccaatgcatagatgattgaatatcgccgatacaatgacttctcaaacattctccgcttgattgccgccagttccacagtgccaagcaatttgtatttcattgcaacgcccgacacattagatgcaaagttgctgtcggtcaggtctggtgtgtggctaaacttgtgaatatcgtctgcaacacgcttcttgtatgcttcggtcccgctgacgtcatattctttattgataaattttgcatcaacgttagtctgttgaccgttgggggttattcgagactttagcagcaacatgttggcagatttttgttccttggcaatttccagcttgtcctgtgcgagctttttcattgcctcgggatcgttggggtcaacaccgcttagaatcgaactgccgttgaatagcgcgtcaatatcgccactgataaccagcagcgcatcgttgaggtctgtcatgtagttggccgtgtctgactgtgctgaatcgtacaggtcaatcagtgagatcacatgctcaaagtcaccggttcggaaccggttgttgtcatactcgacaacgggaaatacacgaatgatctcactgtgatccaagtacattgcgccaccaaccgtggtcggcttgtaaacatcatgctctgtagctgtccatgtttcgggcatgatgtcaataattgtcttgttgttatcatcaaccaactccaccgagtgatagcggacagccatgattggttgcggatcaacatcaagcgagtagatgacgaacgtgtcaagcggatctaaacggacacagtgctcgattgagtcactaccgtagtaaacatattcgtaagcacgcccatagcgtgtcatgtcaaggaacagatcatagttgagcgcgtcaaggtcgttcactcgtgtaatctgatcaagccgctggtcatcttcgtcaagcttcacattcactggattaccgactgaataggcagtctggaaatcagcaatgtacttgccgaatgaatgaacggctcgatgatctgacttgccagtctcaatgcgccgtgactgtggctgtagaatgccttcgttctggcccttgtaatatcgatcaagtttttttagccgtggaagctgatattcgtgatggtggaaaatgaacttcatgatccgatccggagtgaggttcgtaatgtcttcttgatacagtaagtttgattcttcaaatggatccatcatgtcaccccaatcctagatttttgattgtctgaatgcgttcttggttgctcatgtaatggccggcggttctgaacatgaacggctccatcgcataccgcaatgcgtcaatcgcgtggttattggcatcgactggcgtgttcgtccagttgtcgaacttgtcttttgaataaacgtacgtgttgaattcttccagcagtcccttgacacggggatgaaccacaaaatggtatgactgcatatactgaataccctgtgagacgctgtctttgcccttgccagcacctatgatgtttggcacaccatatacaccggacagctctgatatgagcctctgctcggcgctatcagccgttatctgcaagccgtagcctttgtgttgtccaatagcctcagcaatctgctgtgtcaacattccctgttggtagaactcatcgtagatatacacgacacggttctgctgatcgattgccatgaactcgcctgctgtcgggtcgtgtttgaaaccgaagtcaaggccaacggcttttggtagtgcggctatgtcgtcgtagttgaaatcgcgttgctcaaatagcccgtcgaacacaagcccttctgcaatgccccagtcaccatatacggcaacgcgggcacggttaggattgcgcttgatcatatcttttagacttgcaatatagtcatcgtccagatacgggttgtccttgtatgtggtagtgaacgacttcgagcgtgggttctttgtgtcttcatcaaaaaactcacgcttaagccaatgctgatcactccacgggttgaacgtgataatcgactggtaatacccatcaggatcactgatctcaccacgcatagtttcttcaacggtcttgaatgcgtccagagacttaagttcgtatgcttcttcccaccatgcacgagcgagcacgccagttgttggttgcaatgaagtaaccgctaagggcttgtccatgccacgaaaaaacaccttctggccagttggcttaaaggtgatttctagcggtgacagtgtgaacttgaataggtcgtaaactcccagcctgaatgctgcttgttggatagttgagtatgtcgaatctttgttcgtatatgcgtattggcgaagcacaatccaattgacgtaagggtgcaagatgatttgcatgatcacatcttcagcaacagagaatgacttgcgcgacccacgactgcctttgtacgtcaggtagcgtgttctgtcattgtaaagcggtgcataagcctttgggacgattgaatccagatcgatattaatctgcactgtcatcgcctccgtcttgatgaattggcttgatgttgattgtgatgttgctcgtgtcttcgctagtctcacgtttagccttaacttccatgatgtcagcctcagctttggacttgcgaacatcggccttagttttctcaatatcagtaataatcttcgttagctgagcattgagcagctcatcattaccagggtaacgctttaacaattcgcgtcctgctgccatgcggtctttgatacttggatcgttttcaacagcatctgcaccgtctggagtgctaactataattgtctcctttgcctctccacgaagcactgtggtgaagtattgaagcacctcagcagccttggcaatcttgtcagattctaggcgtttcatgcgttcgtcgatggcagctttaatgttaggttttgttaggttttctgcaccggcaaacctagccgttcttttgctgtatcctgcttctagtgccgctttggtggcattgctatcagcaatataagagtcaacgaacttcttctgttttgctgtcagtcgcattacatatcaccacaccttccttccattaaaaaagcggtagctagttagctatcgctggttataattcattaagctgttgttactcctggattttctttactaggctgtttcttcttatcagccttggtcttgtcccgctgttttttcaacttgtccttgaggttcttatagacgtcttttggtgacggcaagtggaatgccacagtatccaccccctttttgacaagcataccttactttcaggatgtgcgtatccgcctcgcgtcttaacttgattagagcgtgaacggacaatttctctgtcaatcttgccgatggtccacgcttcaactttcggcatgtaaacgccgtattttgttgtaatcatttgagccatgaaatcacctcacacatagtaaatggcacgggtatcatgatcgctgtattcgacaagctcaaacgttttgtgagcaaccacgccaatatcatcagtccacttgtcagttggcttgcgtgtcgatacttgacgctgaacgaacccgcctaggtctttgctcatctctgaatggaggtggccagtgaacagttcgcgattctgtgctgtgcctaacatgaagccgaactcatctaggtattttgcaaggtagttgttcttgcccttgtctccgtgagtggcaccaatgaagttgtggcctaacattgcacctttgtaatgcttaagcgatatatcccatgtgatgtttgtttggttgctgtaggcacgtttcaataaccgggcaaacatatagccaactgacggatcatgatttccggcgcaatacatgacctcacactcattggcgttcttaatgattgcttcaatcagtgtctcgaagtattgctccatttcgttcacagtctcgcctaggtcggttgtttcgagctgtgtgccctttgctgtggtcgagttgatattgtccacgtgagctagatcaccgcccagaatgagcaatattttggcgtagtggccgcgttgaatgatttctagctgacgcttaagagattcagcatagatgtcgaacgtgtggccgttgaaatgtgtatcaaatgcaggaatgaccaaatagcgatctgattccacaaaaataggagccttagcttgatacggctccttgtgtgtgatgatgtcattcatcagtgattcatattgttctgcttcaactaacggcctgatttgtatcttgctctggaagagtgttgcttcaggcgtctgcttccaaaaattgcttgtggcacgtacaagctcccacttggtgtaatcgtacccgtgagcttccaaaacctctctaggcgtcattttgtgacccctgacgactttcacgatagtatcactggattgtgtgccgtctgaatcgtattcatccttcagcggcttttggaactcgatgccaagccgtcttgcttttccctgcaacgcatcatagctaatcccgagtttgtcggccgtctctcgtctggtaaagccttcagaggcgagcttcctaatgccaccgatctgttcatctgtccattgcatctactcgcctcatacttaagaattgtgtcctttagttgtttcctattctgaaatggtcaacgcatatcgcttcaccatgtacgccttaacatattcaggtggctcgtagccgtacttggaatggatcatcttgggcatgaaaccacctccatcacaaaacaaaaagacgccgtagcgtcttaattttctgttactccttgaattttactagtcccgatttactggccccgatatgcctttcgtcgctgtaattggttcatcaatagaaattttaccgttgttgatattgctaataacccacggttgaagaatatatggaaatgtcggatcgtttggatcgtcccatatatagagtaccttttgggtcgctgcttttccaataactgcgttggtctcaagctcctttacttgctctgcctgcatccgcaactcgatgacatggtctggcttgttgtaaagctttctgatgatcagcattttatcttctgtcaaactgttaacgtactggattctatgttttatggcattccgtgctgcttgcctattccaaaaataaaggaaaatatcaactatcaaaaatgaccacgccaaaacggtaacaaaaaacacccatagtccatacttatgatacaatgcctcccccctgtagtacctctctgcaattggttgagtaagtaaaatagatgttccagcgattactattacaacccatatttttgctggtaatttcaagaattcaaccatctttcccattaataatcacctcacaaaaatggtacccgatttagcaaccagataccatagcgaggtgactcatttttttagcccacgaccgagttcaggcggtcttcgcttcctttcgaaagtttggtgagctatgcaactggcaggagtcgaacctggccgccggaacgtcttccgggttcccaccaaccggagcttcagttgctgctcgctctcccagtgtcagatggggtcatcgcaagctgtgtccggtcgctaaactggacaaagaactgtgccacgacctgccgtggctggtcccgctcaaccgggcagctcagcctctaaggaggcatataatttcaccctgctaactcatcgtcatggtaggcgtatcgggacgtagtgacggtagctactccgtcacagaccttcacgggtgaaatgtggcatgcgggaatcgaacccacctgactatcgcagtcagtcctcattgccacgccttgccacagctttatcatcactgaggctcggagaaaaaacgcggtgtctcaggtttctcacctttggcaccactgcgtccactccttatggtatgatttggttgggtttgtaggataagcgtgccttcgtggtgcgcttttgttatactgtttgtgaagatggtggcttaagttccattattcaaaagccatgtattgcataaaagtccctgtcttccacccgtcgctaatccggcggttttttgttatactgtctttggaggcccactccaaaatgactattaccctggtgcaattcacacactggcctccagagcgcgccctttatccggcgcgctttttatttacctgaactggaaggcagcaagccattgttcaatcgtggcagcggccgccttgaagactggataaagtgcttttgcgaattcgtccattgttcgctcatgtttcctgcgttcatacctaatgcgcgctcgcatgactgctcgatgccgatcattcatttattttcctcttttccagttagcccaaatccacattgcaacacatgagattagcagcatgacggcaatcattgctttgcttccagtagctctgggttctccctgaacttaatctctcgtttcatttctccgcctctattcttttagtaaccacttgaccagcttttcacttgccgaaataattaaccacattactgttgctaatccaacgaataatgttaagaaaataagtgacttaactatcccaatctcgatgaaaggcttaacaaggaaatcccaaagcacattggtaaatccgtaaatgatgaaacccgtccaaaccgctaaaataatataggcaatggcatgcttgatctttttcttcatttctagatctcatcgcccttctcgttgacctcaatcacgtcccactcatatggcaattcatcaagcaaattgttgccaaagttgaactgaccattttcagccgatagatcgtaaaaccgcgctgctttaccataccccggtgtgtcttccagcaaatatgcagggtagattttgtctttaaggtaaatgcgaccttctgccttgaaattgccagttgccttaaagtatctagtcttaggaaagttcatttctccgcctccactttcacgatttcgcctgtttcctcaacgcgccagacacctagcagccacgcacgggcgaaggtgttctgattagccattatccatgccaatgtctcgctaatcttatatccgtttttggccgtgtctaagacgcccagcaaatcagtttgcccgtgtgctgatcgcaatatatctcccaccgctttcggtatcaccggcagatcatctggaaaagcagcatcataacgagcatcataattgagcaattctttcgttgggtgtaacgccccaggcacagcaatcgcgtcatcatatgcttctaaaagatcatcgaacacgtcccgcttcgtctcattgctcatcgtcagtcacctcatggccattaattaatggtgaaaatgccatggcagcataatctattccgccttcatgataaatagtcggctcaagtttcccagattcacctgtgagcatgatctttggattcatggcctttagaataagaccacgatctttttcactgataggtacgtctggagcgttaacaaacctgatgaagccgtcatgttcattaatcatccacaaccgttcaatataatccgtgtttacatagtcaccgctgtccagcttattcagcatcgtcagtcacccccagaaaagcaaaatcatgtgtaagagctggtagtgctttttcaatttccttctgaccgtgggcgtctaaaagatagctaactttatttacgccgtctgttttttgatcgattgccatcaatagcaagtcaatatcaatatcattgctacattgaagcacaattgtttggtgactcattttattcgccatcgtcaatcactcctcgttgcgtatttgaaaggctgtttttgctttcaatgtccctaaatactctcgttagtgctttcctaagttcactgttttttggcaaattgtccaagtcttgacagccaccacatcgaaattctgctttggtttgcttttcttcgctcatttttcgtcctctctcccgtaaatattcttaacaagtgccacagctttcagattggcatattcgtttacgttaccgtccacataatcgcccatagaaagcagcttttctgcacgttttagtgcttcttcgtaattcatctttttttgctttggttctacgggcactagcttgtagtccacaccttcgtacatgacgcctacaaccttgccagtctttttgctgacgtagatgtcatcgaacgtgtcgtctcctgttttcattggtcggcctcctactgtgcgtttgctgacttcacagcctgatcggaatagtccttgatgctctgtacgtctttgattgcctgtgataagtcattgtttgcctgtttggcggcttctaactgtgatgtaaggtcattgatggtctgctgctttgcatcgacctcagcctgtttctgggcgacagctcgctggccttcaacgattttttgctgaatctgggtatctttgcttgccatgtcgttgtcgtattgccgttttagggccgcatactgtgcctgcgcgtcagacaactgatgtttcaaatcggacaagctagattgtgaatcgttgatcttcgctgtcagcttgtcgatattatttttggtctcaacgatgttctggtgaccttgccaaacgttgtcggcaatggtggttgcaccggccccaaacataagccctgctaaaacagttactgtaaatgtcaattttttattcatgatttttttctccttagtttgttataaccatggcgtatcaaagttgtatgtcacaattgcacttggaaatggtgctgaatctccggcgctcccgttgtgttcgaatttcaatctcccacgtaaaaaatcaatatgtgctttgtagaaaatgtattcatgccaatagctagtgtctgttctcgccggtatgagcaagactatggggtctttgcatttgattgaggagatataagctttcttcacccacaggcctagctgtcgtccataaggcgggtttagccattttgggccattcaccttcgaccagtctttgctcaaagcatcgtcttcgagtgtgtaatagtttttgcactttgcattttttgaggtcgctgctaaatcaatgacgaagtggtatctgtcattaagtttctcaaacagcttctgcggtgtttcccagtcatccttgtcacttgagaaaagccctttattaagcatattttttctccttaatcgatttcttcgacttcaactctcgggttagctttgtcaataaagaaccgatctcgcagttctacaatgtgatcccaattatcgttttctaagaattcagccttttgcatgccgtcgaagataaacttgtgctgaaacgcgatgttgtccgggtccgttcgcttgtcataccagtaccagtcgaagcttagaggtttcccccattgaaatttcacgccctgattcatcgcttttctcacagccaacattaccgtttccgttgcttgtttcttgacttttgctccgccgaacatgttgcctcgttcaaccttgatgtactggttaagagtcatgaggggcaaaggaataataatcctgttcacgatggcttcacgtccttcagatagtattgacgttgcttaccgtcaaccatctcaaccgttgtgattagctctttaggtgccttgacatcaaaagcaactggcttgttgatgtcttgatgttcacctctggcgttgtatttctcgattctgatgattcgtgccacaccaccgagatcacgcacgcccatgaatactcgatcaggaaccacaaccagttcaccgaccatcatttttgttttaattgcttgcatttagaatgcctcctgtttaatgctcggtttcattgaaaaatctagtgttgcgaaatgcttagctagccacaataaacgcagcaagctccccgatacgccaccgtcagcacagatactctctgacgcttcgcaaatcatgcgcgtatcagcgtgaataacagcgcctaaaagtacgataatgtcttgccactgtgcttcagtaacgtttaggcaaccactgtcataatcgcgttcaacgtccgctatcgtttgattcaaggacgcttcgtaggcccgcaaatgcttgtccaaatgctgcaaagctctattcgtcatttcttcggctgtcacgatcttttcccccttacgtccgttaacttttcaaaattcaatgtgcaatcttttgattttggaataattcggctgattagtttgctgttgtacatgtgctcaagctcgctcatctcgttgttcgttgtgatgattgttgatagacgaggcatgttgctctcaaaatcaaggcgggcatttgcaacgcgatacatcagctcttgcatgtcacgtctcactggcttgatgtcgagtttcataccgccttctgtcccgaagtcgtccaacaaaagcacgtcagcctctttcattgcgcgctcaatgcccactaaacgcaggcgaacgtctggtgcatcatattgcaagctcattaggttactcagctctgctgttgaaataaacagccctgactggccttcatctcgtatgctcgtcagcatcgccaaggcaagtgatgtctttcctgttccacgagggccaaataaaatcacgttttcaggcgtttcttgcatttgttttgccaacttgtatgccctatttcccagatctcttgatttctgcaaatccgtctgcatttcaggctgccatttatcgaacgtaaacttagccggaacgtttccggggaagactgagtagcgataaatggcacgtgcctttttacggttcaatgcggccatagagcgttcgtagaagcggtgttcgatttcggcctgagttggcagcgtattaacgtcaattccacgcttctcaatgattctttgcacgtctgcatgtgtgaataggcctttagtcgactccatatccccagttctcctttttcggttcggtgtgcggcgttcggtttgactggcgttcactatcgtttgcatcgacagcagcaaccgtgagaagacgcttgctttcccagtttttcaagatgccgttgacatacttgtagtttctaacattgctttcaactgcagtccgtagcgcatttagaactagcttctcaggttcaggcgatcctgcttttcgcatgtcgtcaacccaatcaacaaggctttctctggtgaacggtgatagttgtccaaacccgtttccttcccagaaattgcaaatatcaaaaattgatgatgacgacgatgacggttcttcagtaggcctctctgctgcctttactggagcagtagtctgttgtcgtttagttttatttactttactttcctttactttactttgtgtattaatgtcatcattaaccccacttgaactggagttattgtctgcattaatccaatacaatgttggtttttgcgattttcgtcttttggtggcatcagtgaacgtttcttggatgcgctgactggtcaaaacgttgtccgacaggaacaggtctttattgaaagtcccatactcagtcagacgtttgaccactagccccaccaactcaccagtcgcaccactgacacgattgacaagctggtttttagctagctcggtccactcgaggtaatagcctttgcggtagatcgccgcgagcagataaatgaaaatcaaaacaccctttggtccaaattcaccggtaattgcctctgtcttttcgttcgttgcaaaatcaacatcgaatggaaagtaatcaagtccttcttttactggtcttgccaagcgatcacctccttagtcgattaactcgtccatgctgatgatcgtggcaactttcttggtagcgcgacagtagtcacacttatcacatcgatgtggccgcacctgaccggatttaaccgcctcaacgtgttcggtgctgtcatggatctcttccagcgcctcatccatacggtactgtggcacttcgatgacggcatggtcgggtacatcctccttggtcacggcaatgatgaatgctcgtggtcgcgttccgtaattttggtaaatcagctcctgataaaccgccatctgaagctgatagttataggcatcaatgaaactggttggttgacgttctcccggtttccaatacttcttgtgaagcgactgtgtagtcttcagatccaaaaagaatgactttgtggagtcgaagcagtccagcttgcccatccactcgaccccaaacagatcaccggtcaggatctcttctttttcgccctgataaagtcgttgaacattctcatcagcttcaagcgtggcaatcatcgcatcagcttgtttatacggggctttcagttgtccttttgatgatccacgagttgagaacatctctaggtgtcctttgataaaagactcatgagcttgcttggattcaaaatagctgtgtagatagtttccaaccagcaaggcagtcggatcacctcttggtgtccatttaccttgcaactcggccatcgcttctgcttcgcatgtcagaaacttcttaaaccaggtagcagactgatatttgaaactggtatccagcgagtaataattatccttgttgactgtcaaagatttctggttgttttcctgcatttgggtcgtgggtaatgtctggcttaagagcatctggcttcacctccgattttgtgacgggttcagcgggagcgttaagtgcatcctcgatcgagttaggatcttcgggggtaacatccttcagttctggatcagcttcgactggtttttcatcggcactgaccgcgctttgcatgtcggttgtcattggaccccacttagtcagcagcgatttgattaccgtcttcagggccatagcttcgtagttgtctttccaaacgcccttgggctccgcgccaccaccagatttgctgaaacgcttgcgatgatcatcgacttgctgatatgtccaatagaccatcttttcaaaaccgttagtcagtttgaacgatgcggcatagccaaccggtttttcgcttgcttcgcgatcgtggaagttcggcgtgtactcaagttcctctgttagtgggttccagctcttgaactcatcttcataaattggtaaagcagtcagtcgctgataccgtcctgatcgttgagctaattggatatagcctttataaccaatctgtggctgcgcctggttcttgtatggaacgatgtagacaaaacccagactcgggttaaccggaagatcgagtgttgctgctaccatggccgagttgataacacttaactggtcaactctggctaagcttggattaaggcttaccgcgctggcaatcgatgacagaaactgtggtgcccgtttgtccagaagcgctgcaaacttattcttaatggcatctgtttcaattaatttcttgactggcatcttagccagatcgtattgattgctcatttgtactcctcctgttttcttggccattgtttgaatccacgttcttttagaaattcgacgactgaaattggatcttcttttccgaacaatgtgttgacaatcgcttggtcactgaaataatcagatggatcgcgcaagacccgatggtagaaccagccaattccgtgctccgcaacttgatcgctcaaataggagaactcttttccttcattaaatgcgccatcaagtggagaggcataccgggactggtaaaaccaaggcttcgtacgatcaacattccagtcatcagccattgacaaaaactcctccgcctgctccgtatccattccttttggtaaggcggcaccgtgataggactcccaatcagcgatggctttatcttcaagtgcttctcgtcgttgatactcgttcagaaccgctgtgttgtaatcaagcatggtcatcaaccgccttccgtgataaacttaagttataatttaatgtgctaagtttttgacttcccgtagttggcgctacgggatttttttgtgcgcatttgttgagcatccgttggctaagttcgaacatccaaagccaaccgctatctccgtggctcttgtaaatcacgttctcggcttgatcatgaatgtcttgccaatatgccttcgtatcacgcatagttctttctcctaacgtgtccattgtttccaacctcctactgctgtggcgccgatcatgatgccagccagagctacaagaagatatttccaaaaggctgatgttgggtcgaacagcactgacatgattgcttctagcattgttagtcctccgtgtatgtttccatgaacttgtcaactgcctttgagtaccaacggtcacgagacttgtcgctcttcttgtgaccatcattgccagattcgtatcgtggcatgcctgattgatatgcaatacgttcaaaggcgtcagtaccaagtgacagcttcagctttgcacttaactcgcccttgttcattccgtgtccaggcaaagcatcttcaacagctttgtttaccatcgcctgaaccactggcttaagattgtctgcaagatgaaccgcaatgagttctgcaagcttgtcgtcctcattaactttcaccgctacatccatgctttcaccttctctactggtctgatttgggactttagtgatccgattagactttccagactttcaactagtgattcacctgaatcgatgtatgatctgatcttgctcacgtcggttggtgtgaagtgatcacgccctttagacattgatggttctgctcgttctctagcctcttcaaatttcttttgggccattttttcgtggagataaacaacgtatggatcgtcagtatcaagatcatcagcgaatactcttaatccagtctgatattcgatcgctgcgttcaaaaagcgatcattgccaattgcaagtgccatgggaatcagcttatcgtctggtatgcctcttgcttcccaattgctgacagcggcttgcgtaacgtgcattttcgcagccaagttcttacgagttaggccctcttcttgaaggcctcttgaaaattcctgaaagatgttaattgccataaccacacctcctttaaatgtgtaccgccgatatagtagtttcacggcgatatatgcgatgattaagctgtagcaaggtaatcaatcatttcgttccttgcacgttccctttcagcactgattgccatttcgagcatgtcatcgtccatggtttcccaaaaagctttgggcttatcatcgcggtagctcatcagcgcttcgatcatttgctgtcggttcatttgactgcctcctctcgctgggcgggaatgcgttcactaaatgtgagcgaaatcttcaaaaaaaagagaatcaacactttctccaaaaaaatcagccattcgtttcattgtcttctgggacgctccacgatttccgttctcgatcttcgcgtacatagagtagctaatgccaatggatttggcggcctcctcttgagtcatttttttcttcattcgagcttttctgatgggattcatttgatcgcctccttcactctatgtgaatataatacagtcactaaatgtgattgtcaacacttaatgtgagtttttttgaaattaaacttgcatcactaatagtgatggtaaaatcaatatacacaggtggtgaaaactaatgaatacgggtcaacgaatatctttacttcgagaaaaaaataaccagagtcaagcggagttagccaaaactctcggcattgccgctagtacagttggaatgtgggaaacgaataagagaaagccatcatctaaaatgcttaaaaagctgtccacgctctacgatgtgtcgatagactatttacttggtaatgacccaacaaccgataaaatcccttcagaggttgatattgccgaccccaaaaacgacaccatcatgacattcgaaggccgccccattccgccggaagatcttgagataatcaagagacttcttcgaggtggcaaacatgatgactgattttaccagcgacatgctgagagaggttttaaactacggctttgaccgcggagtcggggctgagctgacatataagctgaaaccatatactccgtcagtttctaatcctgaaacacgttggattgcggttaatatgaactggcataagccgaaacaattgccttatcaggctgcacacgaaatcatgcatgttctacatcaagatccagcttgcttatacttttattcggcttcaaagaacagcattgagggtgaagctaatatagcaggaattcatatgcttgttcctttatattttgctgatattgataaagaagatgctaacctgaatcggtttatggaagcttttgacattcctgcaccaatggaagacacttccttggaagcaataaaagaattttacatgtaactaattactagttcggatatgggaaacagtatgagctataccttttggaggattacaaatggagcacgaaacgcgaagatctcatcaagagattaaaaaacctttttggaaaagctggaagttttggacagtatttatcgtcattgttctactggtcgccggcatttcaagctgtgtcaacgagttcaaaaaagaattagcttctccatccacaagaatatataagctgaacagtaacaaatcggtaaaggcgatgctgaagcactatgaacctgatttgaaagttacggaagtcgggggcgtttatgctgatcccaaatcaaaaaccgttcttgtaaccattaaagaagacagtagcgtggacgacaaatatgcagtcaaaacgatgcatgctgacatcgcgtcagtttggaaggcattcaagaaatcaaaaggcaatgattttgcaaatatagctgtcatagtgacttatccattcgatgacgcaggaggtaatacacatcagctaaaggccatgacagccgatctagacgggtcaagactgaatgatttgaatttggaaggattctctgatagcaatgtttcagcgtttgctacggaatactggcagcgaaatgacatgccttctattaaataaaattagtccaaatactgacgactataaaagctgaatattttggaggaaaacaaaatggcaaaaaaggtaatgggtgctgacggtaaggaatataaggtaaagaagcctttttacaagcgcgtttggttttgggtattagttattattgtggtagcagcgattggcggcggcctcaataataagggaaaatcaagcagcgaatccacggaaaaaacggcagttagcaaaacgcataaatcatcttcaagtacatcctcatcttcggaaccggaagataaagtgtataaagttggtgaagttgcaagctataaaggctatgaaattaaggtaaataatgtcaaattcgaccaaggcgatgacattaacactccggattcaggtaagcaatatgtaatcgcaaatatcacaatcacaaacaacaccgacaagtcacaagattataaccccttctttttcaaattaaatgccgatggtaacaaaaccgatttcggcgagattaccacaaatgttgaagatactcttcattcaggctctttagataaaggtgctacagttacgggtaatcttgtaggacaagcaaaaacagatgctaagtcattacagcttcaatatcagccatcattttggaatgacaagtcaatcaagatagatctgaaatagtgtttatttccccgagcaattggtagaagccaaacggcttggggattttattttaatggcaaaacgaacatacgtttgaattttaaccaaaaaaatacacatgaaaggatatgaacgctttgcgtaaatggaaagaagttcctcaccaccctaatgtttataggtatgaaacacgacgcgggactcgatatggtattcgtcgtggatttaaaaatagtgtaggaaagcgcgatgaatacactagatcgggatttacaaattggcacgatgcagaaggcgaattaaaacgatttgaagcatctttagtaacaggtggcattaatcctctaactcaccgtggtgttaccctgaatgcttattttgctgccttggtgaagaaccgtgaggagctcggtgtttggaggccagctacagttattcaaaaaaagacatattatagaaagcacctacaagaaagattcgggaaccgcccaatgagcaaaatatcaagatcagaatatcagcagtttattgatgagaagatcaaatcaggtttggctcaaaccacaatgcgtacgcttaactcagtcatgcagatcatcatgaacgatgctgagcacaacgatattatccgtaagaacatgctaagaggcatcctcattaatggtgccaagccacctaaagatgtttccattaccgatgaagactatgcgaaattcatggccacagcccagaagctcttgaataagtatcagcttacaatgctgtaccttttgactcttggtgagcggcgtgaagaactcgctggcctccaatttcgttcatttaaacgaggaacaaccgaaggcaaaacatactatgaaatcacttattacgttggcagaacgcctcagcagccattaggcggtcccttaaaaactcctagcagctatcgcacaaattatgttacgggtccaattattgagtacattgactattcacttcagtattcaaagaacattttgacacgtactcatcgtgagattgggcccgagacattcatatatctgaatgagaaaactgggatgccggttcatccgagcaacatcaaccgaaatctgtttcagcgtgttaaagatgcaactggaattgagcttcgtccgcatatgttgcgtcactattttgcaacccaagcacttcaagacggtttgcctcaaatgtccgtcatgcactggttaggtcacaaaaacatcgacatgacaaacgactataccagaccaacacgagaaggcagtctgaaagtcattaacggcatgggcccgatattgtttaaaaacggtaccgcgggccctgacggtacaaaatgattttgtaccgccgcttgtaccgtcatattgtctcaaacgatctgaacatatccaaaacgaaatcaaaaaagcaccccgtccttcacgcaaaaaccgtgatagaacgagatgctttcgtttcattagcagcaaagtctatttgagggtaaccgttgcgccaacgccttcaagttgttccttaagcttgttagcgtcgtcttcggaaaggccttccttgataaccttaggtgcggcgtcaaccatacccttagcatccttcaagccaagaccagtgatttcacgaacagccttgataaccttaactttttcttggccagcttcggtcaattcaacgtcgtaggtatccttagcagctgcagcgtctgcaccagcagcggcgccagcagcaacaggggcagctgccttaacaccgaattcatcttcgatcgacttaactaagtcgttcagttccaaaatggaagcatctttaagttgtgcaatgatgccatctacatctaaagccatgtttgtttcctccgtttattaggtagtttgtaacgtatcattatgcagcaggttcttcgtctttggcttctgcaacggccttgacaaccaatgcaaaatcgcggacaggtgcctgcagaacagaagcaagttgcgacaacagaccttcgcgatctggcattttggacatttccataatggtatccaaagaagcaaccttgttttcgatgatgccgcccttaatcttcaaagcatcaaattggtcagcatacttggccatgatgcgagctggggcaacaggatcgtcattggagaaggcaacggctgtagggcccttgaaaacatcgtccaatgcttcataaccgttagcgtcagcggcacgacgcaggtaagtgttcttcaggacttccatcttaacaccggcctcacgcaattccttacgcagtgcggttacttgttcaaccgttaagcccagatagtcgacaacgacagcactggtagcactcttgaattgttcagaaatgcttttaacgatttcagctttttttgcgatagcttgttcactcatgtttttttcacctccattagtttggttgaagtttttaaatataaaaaaactccatgtctaccaagacatagaggtatctagtgtttccgataccacctcggcaggataattaaggcttacgccccctgagtcttaggcagagtgaatgatcacaaagagtagaataccatggtcaccgacctgtgtcaaaatgttttgagaaaaagaaactttgcaggccggccaatcccatgcaaggtcttaaacgctcgcaaaacagagcgtgtttttttagataacagacgccattgtagattgcactttgttattcgtccaaatttgttatccatttctgactaataggctccttgctatcgaattgtaagccccctctgattgaggtatattaattaggtaactattttctgaaaggaagctggcgctcttgccaagtaaacttaaaagcctcgatccatggcagcaaaatctggctgtgttatggctcggaaccttcattgccggcatgggcttcagtgaagtttcgccatttatttcattatatgttgatcaacttggcgattttaccaaggggcaactgagtatttactcagggatcacgtttggggtcaccttcatggtcgttgcgatcgtgagtccgctctggggccgactcgctgatcgccgcggtcgaaaattgatgttgctgcgttccagtttcggaatggccatcatcatcggagcgtgtggctttgtccacaatgtctacgccttaattgccttacgttttctgcaagggctggcagcaggttacattccaaacgccagtgccttgattgcaaccgaaacaccaaaggcaaaaagcggcactgcgattgggattctcacaaccggctacgtttccggtaacttgataggtccaattctcggcggctttcttgcccagaccttttcaatccggctgactttcatcatcaccggcgttttgctgctgattgtgtttgtcttgagcctaacgatggtccatgagcattacacaccggatccacgcttgctcaacaaggaaaaacgcccgagtttattgtctcaagtcaataatccaaaagctatcatggtgctattagtctccaccgcggtgattcagctaggtaatatgtccatttatccaattatcagtctttatgtcaaagagttgatgcacaatgttggtccaattaccgttgttgcaggcgtcattgcagctttgccagggatttccaacctcatcgcggctccgcgcctaggccagcttggtgatcgcatcggctcaggcaagattctggtcagtggcttgattttcgcggttattatgtatattcctcaaggcattgtcggcagcatttgggcgctcggtttcttgcgtctcatgatcggcgtttcggatggcgcgctgtttccaacaattcaaacgcttctgtctaagttgacaccggtgagctataccggcaccgtcttcagttggaatcaaagtgcccaagcctttggttccatggctggctcgctagctggcggcttcatctcaaatatttttaattataatggtgtttttattttcacagccctctgtttagcgcttaacctagtgatggtgctcgtctttattccacacatctggtcaagccgaccaaaacaacaagcataacgcatcaaaagaaccgacctgcgtgggcagatcggtttttttattgtctaaattaaatcactgcatccgcgtagcatcaagcaatagctgccaactgatcaatggttttgggtctgggagagctaactgttgatacacagtccacgcatgaatatctgtatcatcaaattcaccattcaccactgaatagcgcgcctgaacttgaaacaatgccgtttgcaataagcgacgaatgtcagcaaactgttggccgcctaaccatgcactggttaatgctcccggttcatcttcaaaccaaaagacatatgcctgcacttgctggttttcgactaagaaacttggttgagtgtcctcagcttcagccaattgttgttcaaaggttgcatggttaaaggtcaccggattatctgcatgagcagcaacatagtttgcaaaactcatttgcactacgtcatgccactgtgccgacgtcaactgggaccgtgaccgaacatcggcctctgggatagcgacaactttccgatagtcactcattgccgtacgacgaaaggccctgaaatgcttcgcctgcagttgcgtgataactgctgattgggcagcataactgctgtactgtagccgatcatgatgatcggccaattgccgcaaatcttcaaataattgcggcaaccacgcaacatcacccaccacatcaaaatacagcgcattggcatgaaatgaattctcccatactgctgcagcaaacgtcacagcaccgctttgcggatatcttagtaaaatcgcatgacgattagcaaaatgttgctgtgtgaatgcatccgctgatgccaagaaaggttgaagcatcgtcagtgtcaccttctgaccagtaagcgctttgccctcacgcatccttcttggagtccttcttgtcttgccatgtgccatgcagtcgggttaacgaataagcataacgactggcaccgtagacgatcgggaaaatgaatccgatccataaatgattggcaaaataatattgcggtaatggattcatatccatggccgcttcgtaagccatctcaaaagcaaaaataaacacgcccattaacaccgctgagagcacaccacgcaccaccgccagccattcataccggcgatattcctccggcttatctgcttcaatcacatgcagtcgataatgccgcagcgtgatttcattcatcaggttaatcacgatcgtcacaattaacaaaatccatgtcccggcactaatcattttaagactattagcgtcaataaaaatagcgattatcgttgcaatcagcaacatcaattcagcggtcagcatattgcgccccatgatagcgtcataggtgcgttgtttaaatcgatcttcgagtgaaatgccataataccattctgtgattttcttcataggaaccctcttctatttattaattaaacaatgttccaatcttaacacggatcgccaatgcctttttcatgaatcacgcgcctttaaaaaatttttccgtgacaataaactacgattcatcaaggaaaaatctctgtatctgttccagttgtcaaaatattgaaattttcattgacatcacggtttgtttttggtgaaatagtaaacaagcctagagtgtcaagacaccctaggcttcattaaaggaggagcgaaaatgtcaaaaaaaccgtccggccatacgcggctgatcgttggcatcggcgttgcatggctgtttgatgccatggatgttggcatgttaagtttcgtcattgcagccttacatagcgaatggcaattaagaacggtgcaaatgggctggattggcagtgtcagttcaattgggatggccgttggtgccattttattcgggatgatggctgaccgttttggccgtaaagcgatcttgattcttactttgctagttttttcaattggcagcggcatttctgccttcgccacaagttacggcatttttcttggtttgcgattcatcatcggtgcaggcctcggtggcgagctgccagtggcatcaaccttggtttcagaaagtgtgccagttgaaaaacgtggtcgtagtgttgtcctgttggaaagtttctgggctgccggttggctgttagcagccattatttcttacttcattatgccaatctggggctggcgcgtggccgtctttgccactggtttagccggactctatgcgttttattttcgtgaaggcatcaacgaatcgcatgtctttaaaaaagtggcgcggcccggcttgctcaaaaccctcagaaccctttggcgcccgccttatgttcgcgcaaccttgatgctgtggatcgtctggttcatggtagtcttctcttactatggcatgtttctttggctgccaagtgtcatggtactcaaaggatttagtctgattaatagttttggttacgtcttaatcatgacgcttgcgcagttgcctggctatttcgttgctgcttggttaattgaaaaatggggacgtaaaatggtgctgagtctgtttctgctaggcacagccgccagtgcattaggctttggcctagccaccggtttgccaatgctactgactgccggcatgttgctctccttcttcaatctcggagcttggggcgcgttatacgcgtattctcctgaacaatacccaactgttgtccgcagcagtggttccggtatggccgccggtatcggccgcatcggtggtgtggttggaccgttgttagtcggtcatcttttgggatcacactggtcagttggcggcatctttagcattttcaccgctgccatcctcatagcagtcctagcaattatcttcctcggccaagaaaccatgggcgtgaaacttgccgacacgcttgaatagtctcaacagacaacaaaaaaaccttgtaatttgcgggaattcccgcagactgcaaggcttttttactgaagttaacgccgtaatgcgcgagtaaccgtttgttcattaacaaacgtgaataacccgagatcgccaagttcacgtccatagccggagttcttcacaccgccgaatggcaattcagcattatagttttggctttgattggcaccaaccatgccggtttcaatccgagctgcgacttctgcagcgtgattagtgtcacccgcaaagactgcgccccccaagccataaggcacatcattggccagttcaacggcttcatcttcactgtgaaccttgtaaacgcaggcaactggtccaaacaattcggtacgataagccggattgtcctgatcaatgtcagtcaaaatagttggctggaagaaagcgcctggcaaatcaaccggggtattgccataaaccactttagcaccgtgagcaatagcttcgtcaacttgcttctgcaacttgtccttcgccttttggctggtcatcgggccaacattaactgtgggatcactcggatcgccaattttaagattctcaaagcctttcttcaaaccggccacaaaatcatcgtaatatttatctaaaacaatgaaccgtttcgaactggtgcagacttggccgcaattcattaaccgcgtcttgatagcttcaggaatcacattatcaagatcggccccgtcaagtaccaagaaggcatccattccgccaagttccagcaacgacttcttcagatatttgccagcaagtgctgccacttgcgaacctgctcgctctgaaccagtcaggcagaccccagcaacccgcggatctttaatgaaggtttcactatccgcatggccaatcaaggcaatttgaaaggcgcctttatcagcaccgccacccagtacagccttttcaaattcaagcccactagctggcacattgctcgatggtttgatgatgactgcattaccaaccataaagttcggtgcaaacacgcgcatcaattgataataagggaaattccatggttcaaccccaaaaacaatcccgcttgcaagatggttaatcacaacagcaccagcagtactattgatcggttgcggctgcaacaaagccggcgcccgatcagcatacatgtccgcaatctcagcacagagttccacttcaaaaagtgcttcttccgtgcgcttacccatttctcgcgtaataatcgctgccatttcgtcagcgttattgcggaaataggcagcaactgcatgtaatgttgctgcacgcgttgctggattgacattccgctcctgcttgtaaaaagcgtgcccagttgccaacatctcgctaatttgcgtcggtgtggtatttgagtaagttttttctaaggtattcgtgttcggatcaatggtctgataagccataattgaaaacgctcccttcatatacttacttaatcatagcttattcacgcctcatatgccaactttagcaaattaatttactggcttttaataacgtccacacagtaattggtctatatcttttgatacatcggatcaaaaaaagacccgcagcgagtgcggatcttcatgtcgtgctagattcagattagaagtctgaagggttgaccttgatgccgggtgccatggtagcagtcagcgccaagctcttgatgtaaatccccttcgtgcttgctggacgagccttcaagacaatatcattcattgctttgaagttctcaagcagcttgtcagcatcgaagctcttcttaccgattggggcatggatgataccagccttgtcaacacggtaagcaacctgcccagccttgatgtccttaactgctttagcagtgtccatcgtaactgtgccagtcttagggtttggcattaagccttttggtccaaggacacggcctaaacgaccaacttgagccatcattggcggtgttgcaacggcaacatcaaagtccaaccagccgtcttggatcttctgaactaagtcttcagcaccaacgatgtcagcgcctgcgtcttcagcagccttggcttggtcgccttgtgcaaaaacgatcaccttagcagttttaccagttccgtttggcagcacaacggcgccacgaatctgctgatcagcctgctttggatcaacgttcaagcgataagcaacttcaacggtttcatcgaacttagcaaagtcgattttcttaagcaagtccaccgcttcttcaggggtgtactgcttggtcgggtcaacggccttagcagcctctaaatattttttaccttttttagccattctgggttttcctccttgcaaatgtggtcactgggagataagtttttctcccttccacctgattcgctcagctttcactgagaatccgaacagtgcgtcttagccttcgacttcgaagcccatggaacgagctgttccttcaaccatgcgcatagccgcttcaacatcggcagcgttaaggtcttgcatctttgtttcggcgatttccttgacctgatccttggttaccttagcaacctttttggtgtttggttcgccggaaccgtgttcaacaccagcagccttcttcaacagaacagcagccggtggggtcttggtgacgaaatcgaatgaacgatcttcgtacacagtgatcacaactgggataatcatgccggcctgatcagccgtacgtgcattgaaatccttagtgaaccccataatattgataccggcttgcccaagagcagggccaaccggaggagctggagttgctttcccagcaggaatttggagtttgacaatgtttgctacttttttagccacgagacatacctccttaagtccgtgatgtggttatgatggccagaagttttggcctcccacgcgtatgctgaaaacatacttgaatagattatcatttcacggggtaaaacacaagttaaactcgtaaaagcacgtgaaccagtaggactcacattccaacgataacaaacacattcttgttaatgatcctattttatgcggtttgtttccgacattccgagcggccacatagcgtcgggggctggcgaccgcgaagctagagctgtaggcacagttttgaactcgcgtacgttcacagccatggccgtccacgtttgaggtaacccgcttttgcccattcgaccatccccagatagactaagacaatgatgacggcgcctggccagtaagctgctgggaggatgccgaagtcgaaggctttgtggagcggggataggatcaggaagaggccgactaatagcgccatcatagtggagagaatcacgatagctgaggctggggcgcgccagaatggtactttacgggtacgcaggacatgaatgaccaatgattgtgtgcagagtccaaccacaaaccaacctgcctgaaacatgtgttctgcaggtaaactcgcggcatgtgcgccaacgcccagtccgaaccataagaacaggaaggtggtaatatcgaaaaccgagcttagtggtccaaacgtcagggcatagcgcagtagaccatcggcccgccatggtgtcggcttcgcgagcgtgtcatcatcgacattgtcccaaggaatggtcatttgcgaggtgtcataaatcaggttttgaagcaacagttggatggacagcataggcaaaaatggcaagaaaatgctggcaataagtacggaaaacgcgttcccaaagttagaggcgatcgtcattttaatgtacttcatggcattagcataaacgcgacgaccctcaacaataccgtcttccaacaccagcagactcttttcaagcaaaataatgccactgacatccttggtaatatccgccgcggtatcgacgctgataccgacatcggcttcacgcaaagcggcggtgtcattgatgccgtcacccatataccctaccgtatgcccagccccttgagttgtcttgatgatgcgggctttctgcatcggactcagtttcacgaaaagatcagtggtttcaacagcttcgagcaaatcattatcggtcatggcgtccacttcattgccgctgatcactgcttgctcaggaatcccgacttcttcggctacgtgttgggtgatgatcgcattgtcacctgtcagcactttcacacgaacgccatgagcatgcagcaagctgaccgcttctttggcgtctggcttggcgggatcgagaaagcccaaaaagcctgccatgaccatatgttgctcatcatcagtcgtgtaaatgcgttgttcatggacatccgtgcgataggcaaccacaatcatgcgcatgccttgcccactcatcatggcattggtttgctcaagctgacgtttgcgttcgtcagtcaacggtaggatctcaccatgaagctgaacctgatcacagaccgccaacatttcttcaaaggcaccttttgtgatcatccattggtggtcgtgattggctaccaccactgtcagtcgccggcgttcaaaatcaaacggaatttcatcaattttttctaatcccgctggcaagtccacaatttcgtcgtgatgttctttcacataatcaaccacggctgtatccatgagattgtgccaaccggtttgataattagcattcatataagccaaccgcagcactgctggatcggttttgccggtggcatccacataccgcatcaccacaacccggtcctcagtgatcgtgccagttttatcggtaaaaagcgtatcaatggcgcccaaattttgaatggcatgtagtcgtttaacgattactttccgcttcgacatcgccaaggcgccttttgctaagttgctgttgacaatcattggcaacatttccggcgtgagtccaacggccactgctattgcgaagaagaaagcttgtgaccaatcctgcttcgtcacgccattgatgacaaatacgactggtacgagcacgagcatcattccgatcaacaaccgactgatggctcgcataccgcgctcaaaactggtcggatccgttttgccgctaatctgactggccatatcgccaaagtacgtcgcatccccagtcttcaaaataaccgcagtcccagaaccggaaataacgtctgtgcccataaaaactaaattaggatagtcaaagacactaatatcagcatcctgttcgtagacttcagcgcgcttttccactggcttcgcttcgccggtgaacgaagactggttaataaatagatcgtgggtggccactaaataggcatcggccggaatcatatccccagtggcaagctggacgacatcccctggcacgacgtcatccatcggccgttcctgcgtctgaccatcacgcgtcaccgctgttgtgttcgcaatcaaggcagccaaggcatggctagctttttgagagcggtattcttgccaaaaatgaatcgtcaccgacagcacaatcatcagactcatcatcatcgcaccatcatagtcagctgtcgcagtcgatactgccaccaaaaagaccaacacccagacaaacggttcattaaaagccgaaagtaaaatcaaataccatgggcgcggatgttgggtcacaacagtattcgcgccgactgcttccaagcgttccgcagcttcggtactgctcaaaccacctggattggttttcaatgcttggtagactgcttgatcgctcatttgactgtagcgcgtcaatgctgccgttttttcttgggtcgaggcgccatgccccgacatcgtcttctttagcatgcttattctcctataagatacgctggcaggccaagaaaccgccaccatgaggacaatagaaaaatgagcttgatacacccattctttccgtgatcatgtatgctgaggttgttgaacgtgctagcatatgcgcttaagtatcccccaaacgtgtaggcgtgcgggcaattaaccttaacaaaaggttaccgtgaatgtaagatagttgtcaaagataaccatagtaaggaaagcctaaaaatttttaaaggggaggttcatgatgcaaaaatctgcacttgatcaagccgctgctattcgtgccggggtgctgtctccagaagaattgattgatagtactcgtgagaaaatgacggcattaaacccagcgctcaatgccattacctggacccgttttgaagcagccaagcaggacgccaatcaactggaagatcacggtcaaccttttttcggcgtgccgttgatccttaaaggcttgggtcaagactttgctggcgctccagcaacttttggcagtcgcttcttcgccaaagccaagtccgaacacaccaataactttgttaaggccttgcaaaggctaggcttcatcatcgttggtcaaagtaatgtaccggaatttggttttaaaaacatcacagatgcagaactttatggccccgcccgtaatccgtggaaccgcgactattcgccaggtggctcttccggtggcgcagcagcagttgtggcttcaggtattagtccgctggcaaccggttctgatggtggcggttcgatccgcattcccgcttctttttccggcttgatcggtttgaagccaacccgtggccgcgtgccaaccggacctggtgagtggcgtggctggcaaggagcatccatcaacttcgccttgacgaaaaccacggccgatacagcagcgctacttcgtgggcttgccacaacccagctagctgctcctttcatcgcgcccccattacgcttagatctcgttggcgatacacgaccactgaagattgcttacaccacaacatcgcctgttggcacccctgtcagtgacaccgctgttaaagccgtcgaaaccgcggcggatgcgttgcgagcagcaggacaccaagtcgttgcggctgcccctgatgttgacggtactgctttaatgaaggcgtactacatgatgaacggcggcgaaactgcggccatgtttcaggcatttgccgcccaaactggcaagcagcccaccgctgccgacatggagttgataacttgggtgatctatcaggcgggcttgcacacctctgcagccgactacagtctttcacttggtgcttgggatcgcgcagcagaagcatacagccattttcatgagagctacgacttgctgctgagtccaacaacagccaaaacagcgccccgcatcgatgccgttttacaatcgccggccatcgttgttaaaatgcaacacgccgctgagctggcaccgcaggaacagcaagatttgatttgggatctttttgaacccagtcttgaatattcgccattcacgcaacaagccaatctaaccggtgcgcccgcaatcagcttgccgaccgccatctcacctgaaggcttaccactgggcatccaattcaccgccgccaaaggccgtgaagatcagctcctgcgcatcggctactggtttgaacaacaaggcttgttgaaaatgttacctgcatcgctaaaggagaagatctaatgggctcacttgctgaatggtaccaacgcattcccacgcctgatgatttaacccgagtcgaatcactttttgctaacattcaggcacaattcccgcaactcaagctcgaattcaagtggaatcagcccatgttcactgaccatggtacgtttattatgggctttaatccgtccaaaaagcaccttgctgtggccatcgagccgcaaaccatgacgcatttcatcccgcaaatcgacaaagccggttacgaccatagccaaatcattcgcttcccatggcacaaaccactagacgagcagttgatccacgacctcgtcgcctacacgattgaccaaaagaaagatgcgactactttttggcagcgataggcgtggcttgattttttgagaacaaaaagccttgaatccgatagtatctaacgtttgctatcctcgaatcaaggctttttattttgcacctcacttgctttttacctcatccactccggctctatagttcacgtaccgcgccagtgcgaacagatagtcggacaagcgattgctgtattgtaagatcacggaatcaagcggttgactctcagcatccaactgatccaatgatcgctcagcgcggcgggctactgctcgaccatattgcaaggccgccgccagcggatggccgccaggtagcacaaaggccgtgattttcggaaccgccgccatcattttatcgatcgccgtttccaatccctgtacgtgatctgcggtaatcgtttgatgccgcggcaccgcaacatcggccaacagctcgtacaattcgcgctgccgagcttcgaggtcctcagccaaccaatcaaagtctggcgtggctttagcctgcgaggcaacatagcctagccatgaatcaagctcgtctaaatcacctaatgcgacaatctggggagaaaactttggtacctttttcccgttaatctgtttagtgtcgccatggtcaccgatttttgtgtaaagtttcaaaatgtgcgcctcctcgatcaaaacgttgcaagccctgcagtaaaatggcgagtacgatcgggtaaaaaactagattaccgatggcatgatacgtgtcaaacggtaacccactcacatagtacgcccaaaagccgagaccattcaaactgccaatcaccgccatgcctaaactgacaatgaagccgtatagataccctagcaagccggcaagaccgatttgcagccaaattcggcggcgaataactggcaaaatggttaccataacaatcacaatcaccatgcagcacgcataagcaacaatctgcggcagtgtccagagtccaaagccaagaaataaattggacacgatcaaggtgctcatggtcaaactgaagccccagcgaaagccgagcaacagcgtgacaatcattaaaatatcagtgacaggctgcacattcggaatagggactttaacaatccgcaaaaccgtacataaagcggtcaatagaccaagcaaagccaccgcccgaacaggcgatggctttgttgctgatagctgcggcttcatttggtgacactcaggtcaaacaccactttatcgtgattcttgaccggttgttctgtcgctcctttttgggccatcttgccattaatcgtgtagagccagtaagtctttttggcaacattttgctttttgccagcaatttcggtaataaaacctttagaagccttcactgtccagccttttttcaagccagtcatgacaaccgactttttaggctgctcaatcgttttcttggcaaaagccttgccattttgtttcaactgataagtcactacaatctggttagacttgctgctgcttttggccgcatttccagaactgctgcaccctgccagcacaaacatcgcaacgaaaaagaccactaatgaacgtaaaacttttttcaaaataaactcctccacacttttttatttaattgggcaagcgccaccggcacaatcggtttgatcaacgagctcaaggtccttttgatcatgatccgcgttttgaaccgcaaagacagctgcaacggaaccatgaattgcggcacacttttgcttgtaagttttgacatcaatgggttccttaggtgcctgtttgaaaccagcacctacgtagggcaacatcgacgtcgacttaatgacatggcgatactgggaaagcaaaccagcaatttgatcggcttcttttggttggaaggtgacagtgcaactgaccgcgttgtcagaccagtacgtctgcaaaaatgcttgcgtggcaatctgttcagcaattgacaccgttccggctgaggcaaaggcaggatcatcagcgtgggcggcgcgaattgggaattcaaccaccatcgtgcctttcgtgtaaacatctggttcaatgtgataaccgcatgcctgcagagctggtaacaacggatcgttgccttggaaccgaatgcgctgaatcagataaccagcataatggaaatgcatcccttctgaaacgccggcaagtttcgccacagtccctgaaggtttaaccgttgtatgttttcgcgacggttcgcagcccaaagcatctgagtaagcctgatcggcatcgaccacagtgtgatacaaaccatcaacggcttgtttaatttccggatcgtaaatcggtttctggaccattttgccagtttgcggatcaacgactgactcaaacccgctcacaacccgccggccaaagtcattcaggaaccagtcttgaataccagacatggaaacaccgatacgccgattcttcttgatgatatcacgcgaaacctgccagtcataatgactaaaggtcacccgcttggcgaatcgtgctgccaatgtgaaggcctgtttcagcttccatccttgctcaactgcaacaactggaaagacttcaaacagattgcaaggttctccattggccaaggaaatctcaccgcaagggttggtaccctcaacatcaggatcgttttccgcattttcgccatcagcaatccgaccaaaccgccgtgacagttcaagattcacaatcccgggttcgccatttttggcaatggcgtgggcaaccggcgagtaagcatcgaattgtgtattgatcgcaacactattgttcgacgcccaacgatgatgataaagctgcttttgatcctgcttcatcgtgataaaatcgtcatcgtctgctgagccgagtgacatttcagcggagcgccgaacattgccagcaacgactgttttaccgatcaaattaccaatatcagtcgcatccaccgccgtcaagtgttggccaacgcgagcattgagcaacttgttgatatccaataacatctcaatcaatggcatcggtccagaggcagtaccgccaaaaccgtgaattcgtgcaccctttggccgaatgttggtgatatctaaaaccagttttgtctgaccgcttggattagtcgcggcaaaatgatggtcgatcactttcgcgttggctaacacccaaccttctcgcgtatctggcaaggcacaatgatcagcctgttcaccggcatgtgctttttcccactcgtcacggtcaaccgcacccattttcaaagaatcagcataactcgcgctattgcggccaatcacaaccgtcaactcaagcttggtcgcaacaggtggcagctttgcaatattatcctttgtcaccgaaaacccaacgccgccgcctttcatcagttcatcaaacataaaggagtatggcatcgacacagccggctgcgagacgggataatcttcaggcacaatgtgtgattggccataaggttgcgggcgaatggcgatgaaccagcaattgttcaaggcatcgccattgcgcttttgataatctgttccggaaatccacaaattacggcctgaaggtgtgcccgccaaaccataaatcagtttaaaaagattccgtgcttctttttgcaatgtttcaacgaccttgggatcaggattcgctgtatgtaggcgcggatcaaggttaatgttaccttcaaccacgcgcttgacggtttcgtcccagttttcagtgcgttgagcatctggcagccaccgagcataagtacgtttataagtgacccagccaagttcaccccaatgtggttttatttcttttttaacctcggcaataaaagctggtgccaaggtgattggtttcgtcataacttgcatatccgtacctcccgtatacaagatatggtatatcctcatgaatcttatatcaagatatagatttaacaataacaactagttagatgacggtaactggtggccgacagtgcgttcgccttttccagaaaatcctgagcaaattaaaaaatcgtcagagcaaaaacgtctccgacgattcctatgtgttcaagttagaaaaccggaccaacatatggtcgaaccagcacatgtgctaaatctagcgtctcgagctcggcaatttcttgaacgaaacaagtgatcgagccagctaacatcaggttcattggcatcttgccaacttgaacggcgacgatcggcatatgatgcgcataggcgtacccgatttcaaaagccgtgccaggatcaggcgtatcgccaacataatctaggatagccaccatggttgtcgcctgatgcaagccttgaatgtcttcaccaaagacctgacgctgccagcctggtgaattttcttccaatttagctttattagtatcatcgcggggtgagaaaacaccggtcaccgacttgttgacctgcaatgctgccaagacttgatcaagtcgctttgtttgagccgcatcaaaaaatggtgcggcgacatagatttgtgccatttagtttcctcccacttttgtgacgtgcccagcagcactaaaaatcacgctgccgctgccataaatattcaacaatgtcgtgatcgacaagccgattttcatgcaacaggctgtgtgcagcccgcgggccgcggatcacgacctcggtgtaatctttgatgcggtctttgaccaaatagcgaattgcaaaactgctgttgatcgccacttcaccatcatggcggccgccaattagtaaatcgccagcgatattcagccaccgcagatttgccggtaaattgccaattgtcttttgaaactgttgataaatcggtgcagcatgttccggcccggtgcgggtcaaccgccaatttaagattggtgatcgttgcgccacctctaaatcattcatcggcgcagcaatcgtgactagattggcgacaggcactgtcggcttgctcaaaagatataggacagctgtgacaccacccatcgaatggccgacaatgttcacctctgcaaacgcctgttgcgtttgcaacgctgtgatcaccttttccaagccatgcaactgagctgctggacgcaccaccttatctgtgaacaacacttggactgctgcatgatgatttaggttaagctgcccacgcaaatgcaccttgccatctggcgcaacaatcgctacaacatctttgctgagtccataacggcgctggagccgccagagcatatgcccaaacgaatagcgtgtgccaaggtgcccaggaataaacaaagtaggtaccggatccatcaccagcggaaccggttgataccccggccgtgccagcaacaaataatctgccagaccgcctacaaccacgacaagaccaatggccgcaacgatccagaaccagccgctcatgagctaagcctacagcttgtcgacttgatcgaaatccagttccgcggtaacttcgcggtcgaacatttcggtgacaactttcaacttcatcttttccttatcaactgccgtgactttaccgtgcataccggtgaaggcaccatcaataatcgtcactggttcgccaacatcgaattcaacgtcattgtggcgggtactcatacccatagaatgcaaaacattggcaacttcttcaggcaatagtggtgcaggcttagagccagcgccgtgagaaccgacaaagccggtcacacccggtgtgttacgaacaacgaaccatgattgatcagtcatcaccatttcaaccaacacgtaaccagggaaggtctttttcatttcgatcttctctttaccattcttttgttcatgttcttcttcttcaggcacaaccacacggaaaatataatcgtccatgttcatactgctagtccgctgttcaaggttggtcttcaccttattctcgtaaccggaataagtatgcaacacgtaccagcgtttttctgccgatgtaactgtttcagccataatgcgtctcctttaagtgttttgagtcaaaataaaaaaccgtcatcgaaggcggtttttgcactgacaagagtataccaaaaaattggcggtttgtcaggcatcagtataggaaagcctgaaagatcatgttaatgacccaatcaactgccgcaaaataaatggcaaagataatggaagccatgatgacggtgaaggtatcacgccgcgtttgccgagcagtcggccaagtgacggctttcatttctgcgaaaacacttttgataaatttcatcattctgctccttccatgtttactttgtctcttgatggaccgttacccggccacagtgtttacaaaatttttttaaggttaatcgttctgttcgttttgggttttcgggaacaaaataattccgttgcccacaaaccgagcaagcaagtgctactttcttagctgtcatcatgttccctccagtcacgtccaatatcttaccaagattatggggagatggcaagcagtgagggtgagccataatttcttcgtaggacttgggcttcattcaatcccgaataatcgtaggaagatcctaggcgaaaagttttcttgccgtgccaaactccgcaatcttcggccagctggggtgccgacgcgtagctagagcggagacagcgcttcgagcccacaaagcccgcgatctcgaagtcgcctaacaacatcagcgacaaagcctgatcgctgtgttgtttgcacggctgagccccatctggcctacgattgcttcgccttggcactatggtctttaaaatcgcaatcaataatccatgagaagtcaaaaaagaatacccaaccacagcgtcagcaacaacgtaccaccaacagttaataatgattgaatcgtgaaaataaaggttttatctttacttggcttgcttgtgtaacggcgagtattattgcgtactagcggccaagttgctagcactagcaggctccaaaatggtaacgtgcgggttaggacacctagaatcagcgcagcgaaagtgatgaacgggatgaggcggtaccattgcaaggcgcgtttgcggcctaggaagtatggcaaggtgaagcgctgatttttgatatcttgatccatgtcggcaatgttgtcagcaaacatcacggcggcatttagaatgataactggcaaagccgcgagtaaaagttgcaggagccagcctagatcaaatgaaaaggtgaaggtgcgccgtcccaacatcaaattaagcggacttggggcgggcatgttgatcagcacagcaatgatgaaagtaccataaccttccacaaaaccggctaacaactcacctaggggcagacgggacaaaggaaccgggccaaaggtatacagaatagccacaccaacaccaatcgcgccgatcacgagcagactaaggttggtgcgcatgaccaaaatgatgcctaatatgacactcaccagcaaaatcacgatggtcaagtcgagcatcccccacggtgacaggtgctcacggccaataatattttgccgttgctgatagctttgatctttggctttaaaataatcctgaacattgttaaaaccagtcacaaacaaggcgatcgctaactgcgcaagcccatagatcaggctattgacccatgaaaattgctgaaatgcccagcctgcatagctaatgcccagcacaaatggcaacatgctagccgccttagcgggtaatcgaataaattccagaaaaagtggccaagttaaccgatgatatggttcgctcacaggatcgcccccattcccaagcccaagaccagtaaaccattttcaataacgagattgatgaccgcagtatgaaaagtacgctgtttgctggggtcacgaatgaatcggtggacatttcggatcacaagcggccaagcaagttctatcaccaacgtccaagctggcaatgcaccaaaaatgacgccaaaaataatggctaaaaacccaacatacgccagcagcgcatacacgcgtggcgaccaccagctacccaaatacatcggcaaagtgtgccggtgattacgctgatcctcatcaagatccgacatgttattggctaacataatattagcaatggttgccataggtgtcacgcaagccagccctaatgcaatgatggcaataaagtcaccgcgcaagacaacattacgccacccaagatccagtgccagcaatcgacccggtgcaatattgacatacgtggcaatcactggaatgcccagtcccataacgataccagagaagatttcaccaagcggcagccgtgacaacggtaacggtccccatgtatacaaaatgccaatggcaaaacaggccatgcccatcaataatagtagccaatctgtccgccaaaccagcaccaagccgatcaatgaggcgacaatcagcataccgataatcattttttctaccagcttgggcgctaaatttgcccggccaatgacattggtggttgtttgataatgtgcatctttagccttacgataatccatcaaattgttaagtgcagtggtcatcatgtcaaaaagcagcatcgccataaaaaacaggatcgtattcacggcattaaaagtgtgaaaatacgtcaccgcaaataaagtgccaatcgcaaacggcaagatactcgcaagtttcgtgcgaatttcaacgagctcaaaaaataccgacaacggcataaactacccccttatttttttaacgtcgcaagtgtatagcctgaatccttcaaaagcttaaacttgtccttcaaccctgagctgacataaacctttttatctttcgtaataaaaatagcatcggcatacttcagcttttcaatataggccatcccaccagctaagcccttgtcaaatgttgcggttgacaaggcatcaccatcgacactctttttggtcacaatggaaacgcccattaagttattgtcgaacggatagccggttttaggattcatcaaatgcatatagattttgccatcgaccttgagataccgttcataaataccagaggtcacgaccgtcatgttgctagctggcagtgtgccgatagctgtcccgcgcggcttcttcggatcttgaatgccgacgttccaatcttttttcacattctttgggctcttgcccatcacataaatattaccgcccaagtcgatgatcgcggtggtcactttcttggccttgagggttttaacaacttcatccgtaataaacccttttgcaatcccgccgaggtcaatcgccatgccctttttcttgagataaacggtttgcttcttggcattcaaaaccacatccggataatgcaccaaaggcagacgctcatcaatttcactttgtgctggctttcgagcatccgcaaagcctatgtgccagagactggtaatcggaccgattgccaaatcaaaagcaccctcggaattttcgctgcaatgtttggcagcagcgatgacacgataaacactgggggtcacgtgcacaggtttgataccagcatttttgttaaccgcatccacctctgaccctttttgattgaccgtcaactcatcagctaattgttggacgcgggcaaacgccgcatccaaagcaccttgcttgtccttgtcatagattttcaccgtcaccacggttcccatcagaaactgggtatccgaatacggatcgccttcgactaacgtgcgctttgctgccgttttgccggcacaggccgttgcgactaatgccagtaacatcagcagaacgactacaaatcgtttcttcatcattttcctccaaacgtccgcaggcttgaaacctactcacgctctgtcattatatagggactttgcggcataagaaaagaacctgttcaaaaaagttctgaacaagttcttacttggttgagcaatcgtactagaccaattgcatcaccgaacgtcacaaaagtgtgacatcacaaaagtgtgacatcacattagttgttataaacaatattgtcgacttcaatcttgttagtgttgccattttgagcagcattgacaagttggtcagcatacaagatgaaggtatcggaactgtgggtcgcaccggaaacaacatcaaccttggctggtgactgtttagcaaccagtgacttattcagttcaggaatgtattccttagggccgactttgttgaccttcttcatatttgcttcgtacttcgtatcaagcgtcttggacttgccatctttgttgatgttgtcgtagttgctctctgtgatcttgccatccttaaccgtgatggagaaggtgacacgataaccgttgaagtagttcttttcttcaagtgtgtaggtcccgtcctgcatcttgccggtgttgttaacttcgattgtctttgtatcgccagcttgtgcagcttggatcaattgctgtgcatagttcttaaaggtcatactggaatcagtcgcaccagagataacatcaatagcgccaacgttggttccattcttttggaaggacttgttcaattctgggatgtattccttcgggccaactttagccttagccttcattgccttttcataagcggcatcctttgtcttggacttgccgtctttgtcgacgtaatcatatttagtagaagtaatcttgccatctttaacggtcatcgccatttgaactttatagccatgatcatagccggtttcatccaacttataggtgccatctttcaacgcaccgccagcaacctgtttctgtgatgatgatttcttaaccactttgctgctagatgctttactgcttgttgaatttttactgctggaactactgctgccacatgcacttaaaactaaagcagacagtgcaacaacggctgtccccgtcacaactttacttaacttcatgacatttaccccttttgcagttagctactgcaatattgtgttttcaatcacataattagtttagctagtcacttagaaaaaatcaacttattacgggtattataagcgctttctcattttctaatatcgcgacgtagaccggatttctgtgtttttttacacaaaaatgttcggatttagaaaaagacgtccggaacgttagacattaagtaaaatcaaaggctataatggcttagacacatacttgtgaatagtatggtaaagcaaatggtaaggagtgttatgcatggcgaaaaccaatatcgtcgtggttggcgcggggtttgccggggtatatgcgacaaagcacctggccaagcactacaaacgcaataaagacgtgacgatcacgctgatcgatcgccactcgtacttcacctatgtcactgagctgcatgaaatcgcagcggatcgtgttccggaagatgcgattcaatatgatttgcagcgcctgttcaaccggcgtaagaacgtcaaggttgtgacagataacgtgacaggcattgatcgtgataagaaagaagttgtcacggaaaatggcagcttcccttatgattacgtgatcttaggcatcggttcgcagccaaatgactttggcacaccgggcgttgccaaacacggtttcactttgggtaagtgggaagacgcgattcggctgaagcggcacattgaagatgtcgttcgccgcggttctgaggaacacgatccagcaaaacgcaaggcattgttgtccattgtgattgttggttccggttttactgggacagaaacaatcggtgaactgcgtgactggcgcgacacactggcaaaacagtacaaacttgatccaaatgaaatccaattcagcttgatggaaatggctccgaccattatgaacatgctggatcgctcagatgccgataaagctgaacgttatatggaaaagcgtggcatcaaggtcatgaagaacactggcgttgtcggtgttcatgaagaccatgttgatttgaaagacggctcaactttcccaacctgcaccttggtatggacggctggggttaaggcaactgaccaagcgaaggacttcggtttgaagcaaggccgggctggccggatcttagtaaagaacaacatggaatcccaagacgatccaagcatttatgttgttggggatgtttccttagttgatcaagacggtactggcaaaggccaaccgcaaattgttcaaggtgctgaagccactgcgctgactgctttgaccaatattgaagctaagcttgaaaacaaacaacaagttgaatacaaagcgaactattctggcttcatggtcagtctcggttctaagtatggcgttgctaacatcatggggtggctccatctttccggcttctttgcgatgttgatgaagcatttggtcaacatgctctacttcatccaagtttattccggttattatttattccagtacttcatgcacgaattcttccggacacgtaacggccgtaacatgttccgcggccatctgtctcggcaaggcaacgttttgtggacgcttcctgcccgcctcacgttgggtgccatgtggttgattgattgctggccaaagattcaaggcaaggaatcatggttcattgataaactgcgtctgccgttcacgtggctgcagccagccgcaaccagtggtgcttctgctgctggtgccgacgcaaccagtgcagcaaccggcgctgctgccggtgcagcaaaggcaacgaagactgtcttctcactgtcctatcagtatggaaacgatccaatgatggtctttgaaaagatgccaaactggtactacagtatcaccaaggcattgattccaaatcagcaagtcgccttctttatgcaaaaagccatgaccatcatggaaatcttgattggccttgcattggttgccggcctgttcacatggttgacatctgcagcgactatcgcctttgtcggtgtcttctgcttaagcggtatgttctactgggttaacatctggatgattccaatggcgttcgcctgcatgaatggttctggccgggcatttgggcttgataagtgggttgtcccttatctccagaaagtcttcggtaaatggcgttacggcacaccgcgatccttgtacggtaccgacacgcttaaataactgtctacacaaaaggctctgggtggacttacctagagtcttttttcaagagcgggaagctgttgtgaccatcttttccggccatagctgctccccgtccttcgtgttcaggcgtagcataaagtgcatgccatgaacatgaacttatccagcggtttagattggagcaccagcatgaaacagcccagcacattcaaacgttatctcaaaatgattcggcctttcgattggatcatcgttggcggtctgttccttgcggccttcattccttatgtcatctttgcggtacacgagaatcagcagcaacaagctgaaccacaacgtgtgctcacagctgtcgtcatgcatgacggccatgaggtttaccgcaaacgactgactggccataccggcaccagtcgtttcacctaccgcgctaaagacggcgattggaacaaaatcgaagttaaagatgcaggtgtcgcaatcacagaagctaactgtcaagatcaggtctgtgtccggcgcggacgcatcaccaagcctgggcaaaccatcgtctgcttgccgcataaactgctcatcgaaattaaagcaaacaaaggcggcggaagtacagggggtatggtgactgaatgagcacgtataaagctgaccgtacccgacaatatatttatattgccctactctgcgcccaaggggtcattattggcctccttgaacgcatgattccgttcccgttcgcctttgcacctggggccaaactaggcttagcaaacctgattaccatcatttctctgtttacgatgtcgatccccgacagttttatcctaatgtgtctacgtctcttgctcaccaccctacttggcggcacgctttcaacattcctttacagcggcgctggtgccgtcttgtcttggtttggcatgctgctcatcaaacaattaggtgaaaaacgcgtcagtatgatcggcatctctgcagccggcggcattttgcacaatgttggccagcttttagtggcatcgttgatcgcccaaagctggactgtcatgctttatctgccggtacttgcttttatgggcatccttgctggcatcgcagtcggcatcgcagccaactttctttttgaacacatcgatatcttgcggcgactgcgctacgaccgaaccaagcgccgcaaaaaaggagctacacatgaaaattcatcccatgtggcatgaatacccaacgttagcgccggagctggcttcagcgctagccatgatcgaaaaacagatcacgaccaacaacacaccggtcgccaaggcaatcatggagatgatcaatggcggcggcaaactgttgcgtcccgcttactgtctgcttttttcacggtttcaagacgttgatcgcgagaagatgatcgccttggcagcggccattgaaaccctgcacacagcgaccttgattcacgatgacatcattgacaaatcgcccacccgccgcaatcaggtcaccatccagaagcaattcggaccagacacagcggtctatgccggcgactaccttttcgttgtctgcttcaagttactgtcgcattatgcgtcaagcttacgcagcattcagcaagacagcggcagcatggaaaagattcttaaaggtgaactggatcaaatggccacccgctaccaaaccaagattaccatcgacgactatcttaaacaggtttccggtaagactggccaacttttcgccctcagctgcttcatcggtgcctacgaaagcggcagcagtcccacctttgctaaaaacgctgaaaaaatcggcatgaacattgggattgctttccaactactagatgacatcctcgattacaccagtgatgacgacactctcggtaaaccagtgtgcgaagatgttcgcagtggcgtctactctgcacccttgatcctggccatgcaacgcaatcggcaagctttcttgccactgctagcaaaaaaagatcagatcaccgatgcggaaatgaatgaactgcgccagctcgtcatccaccatcaaggcgttgagcaagcttacaccatggcccagaaacgaactgaacaggccatcgccggtttgcaaaaactgccagcaggcgctgcgcaggatgatttgattcgcttgacgcagagcttgttgaatcggaaagcttaattgaaccggcgtgatcgtagctgatggatcgtaattcctgtactggactcgtgactcattagaatccgcgtaatctagtaaaggtctaaactatagaatcctttgccgtgccaaactccgcaatctccggccagatggggtggcgacgcgaagctagagcggtgacggcgcttcgagcccaacaacatcagcttcaagcccggtcgctgtgttgtttgcacggctgagccccatctggcctacgattgctccgccttggcactgacgtctttaaagctgtcttagtaatttaaatttatccatgcagaaacaaaaaaggcacagccaaaagtagttgctctttgctagcagcatacttttgactgtgcctttttaattttgttggatgaatggctcgccgtcagccattttccccatacttaagataaagcccttggccattggtcacttatccaaacggtggctggcagcgcgatcacatacacgaccaaatcaaatgaggtaaagtgcgtgtcatagatcgtaaaaagataaacgctcgttaccccaagtgatattagtttgtgctgccaaaaccatcgaagggttttcttcatgagtgaacctcattttgactatctgactcgctttggttatctatgaaaccgataaccatcaccgtttgacattattgattgtcgccgtcgtgcttttctcgttgtgccataaaataggtgtaagcaacctgcaacgcccagataatggttagaaatacagccaagatcaccgttatgaaaacactgcctgatgtccatgcaatcaatgcaatggccagcaccccaaaaggaaacatccacaaggtccgacgaagcttgccacgataactcatcgcccagtaattgaagcctcgatccttatttttattttccactagtgaaccccctctcgctgaaaagatcggttacaaataagagcttttgctaaaatttgctctcagcatagcatgattgatttttacagacaacttttgatttacactagtagcaaaaagacaagacgcctcagccttcaataggccgtacgccttgcctttataacaattccatcacttatgggtctgcgctgcgacttctttgccaaactcggtttgatcaaaatgatcgatgatgtccttaagctcagcgtatcgcagactggcgccgaacaatggactacctggttcagtcatgatgccgtctgctaagttattgtgcacaacggtatcaaatcccatatgattgaatgccttgacgatcttggcatctttgaaataggtctgaacttgttcactggaagtcgtacttgggtctaagacttcttcgcgaatgccatctgtttcccaccagtagttcatcgcatcaatcaccaacttgcccttcagcaagtcggcatcaatgttcttgtatcgactgagtggaattgctaacaagataatgtcactgttagcgacaacatcagcattttcggacgcgattgcaccgggtactagcgttttaatggttaaggcgatttttttgactgatcccgaaccggaaatacgtactgtatagccggcatctaaagctagaccggcaaggacaatgccgacttttccggcaccgatgataccgacgcgttgaatagccatcatttcaccgccgccttttctgccagaatttccttgacccgcggaatgactttcgtgccatatagctcaatcattcgttcgcgttgtgccgccgtttgattaccagccccgtaaacaagatcaaaccggccgagatcaagcaagtcaatggtcgccgccatgcgtcgggccacggtctctggatcgcccacgtagaaggagccgaccttggtttcgccttcaaactgttcacgactcatcggcgcccacccacgcgttaagccaatgcgatcaaaattggctttgatatttttaaacgcaacttcaacggcttcgtcttcgtcatcggcaatgaagccgtcggaatgtacggcaatcggaaattccggtttaccgagttccttggccgccgcgtgatataactcgatatacggcttgaaccggctcgcctgaccaccgatgattgcgatgatcactttgtagccaaaattgacggcacgaatcaccgattccggcgaaccgccgataccaatgtaagtttcgagtttgccgttttcggttttaggatagacttcttgatttttcaaagcagctcggaatttgcccgaccaagtaaccgccttttcattgcgcaaagcatcatacagtcccagtttctcgttgaacaagtcgtcataatcggttaaatcatagccaaataacgggaaggattcagtaaatgaaccccggcccaacatgacttgtgctcgcccattggacagtgcatccaaggtcgcaaatcgctcataaactcgcactggatcatcggaactcagcacagtcactgctgttgcaagtttaacctgtttagtgaccgccgaaatagccgccaaaaccgtttccgggcttgacacactataatctggtcgatgatgctcaccaacaccaaaaacatcaatgcccaagtcgtcggccagcttcccttcgcgcacaatttgtcgaatagaggctgctgcagtttgcaagctggcgtcttcatttgccacgatgtcaccaaaagtttccagtccaaattgtaaatgctcaatgtctaccatcgaaaagcctcccaactgataatacttactttttgtaagttgatgatattatcataggcttttttaagatgcatggcaaccttttggagggtgaccagtcacacgatcaaatataggattaagccggctatagaaaagtgacttccaagttgaggagaagcctgcagtcaccaaagcaatgcgaaccaatacatcccattaataccggcattttctcgtttgataaatctcacctgcgatactgctgttagcgtcttgtcatcaacaagaaggcaacaaccctaaacacgaatataccggcctactggttacgtttctggctcccccaaatgatattaagagcgcgctcacaagacacacttaccgtctctctgcggtatgcgtttcgaatgcttcagatatcggtaaaaacaagtttgactctatcttcacaagtcgttcatttcgtgatagcttattgattaaccaagcagtcttccattgatcacaacgaaggagcaaattcatgaatctacctcaacggcaacatgaatttttgttgacccccaatgctaatctgcacatgcgtcccttaacatactgtcttttaagtacacttctattcgggcttccctttagtgccttcatgagtatgctcatctcctacagaagactttgggcagttctttcagttgtcgtcatatgtctcatgatcttccttgccagcattattacagtcatttcaaacgccaaaaaagagactttgccaagcctctttaaaacaaaacggcgatggttaatccaattactaggagcccttgtagaagctgcttcgtttctcttcataaaatttttaactagccaatgaagtatccccttgtacaagatcaatattgaatggctgaaattgctggaccttgatcccgaaagtttgttgactactaatgtttgattgcaaaaaaagacccagtaacttctcttgttctgctcatcctggcaggacaaaattgaagtccgctgtgtcttttttaacgtcatcaaatttgagaaggcagggtcatccccataactactctttcggcttcggccgccgctccaaatgccggcgcattttgtctagcaagaatagctggtcgttattccacggactgttgcgtcgggcgagatgggcggcgtagttggctgtgtcgtggttgaattctcgatcagagcgctggacttctttgagaaaatcgcgggagctgatccgcaaggcgccgcgggagaagacggtccattgttcagcttgatcgctagtaacgacgacaagctgcactagcggcgagttcatgtcctgtgcgaggcgttcaatgtaactatcagcggtttcatcttctttggtgaagacgacttgcagatcccatttggcataacttttaccaataccgggcacgtacatcgcatcgaagaccacgatcattttagcgttttcgtggctgcgatattctgccagaatgtccaacaagcgatcacgggccacatcaaaatgatcctcagctttgagttttgcaagttccggccagttgccgatgacgttataaccgtcgacgatcatgatgtgttcgcgcatttattttccctcatgccgactggcgaatgcctgatacatcaggattcccgcggccacacttgcatttagactttgaacgtggccgaccatcggaatcgcaatcgtcgcatccattaacttcgcaacgccaggcgagatgcccttgccttcattgccgatcaccaacgcagtactgccttttgcatcccattttcgataatcctgaccgtccatagcagtgccaaagacccacatgccgcgttctttcagcgtcttaatggtctgggcgagattcgtcacccgcgccaccgcgacatactcaatcgcccctgtgctgactttggcaacggcacttgtcaggcccacagcgcgatgcttcggaatgatcaccccgtgcaccccgcttgcatctgctgtccgtaaaatggagcccaagttgtgtggatcttccaagttatccagcaacaggaaaaatggatcttcgcccttatcagcggcatttttgaaaagatcatctaaggttgcataggcgtaaggcgtcattgccaataagaccccttggtgattgccttgttcactcatcaaatctaatttttgcttaggtgccgtgctcactaaaattttcttcttttgcgccatgccgaccaaatgctgaatcggttcacttttcaggtcggtttggacgaacaatttgttgatggtggcagcggtgccagctttcagcgccgcctcaacggcatggcggccaaagataaactcatctggatcatgttcagttgttgcttgcggcttttttgccatgtcccgtcttcccttcttcaacgtattggatacaccatgctgctaattcagcaacacggtcatcgcggccgatcaaatgtaagtagccgaacagtgcctcgaatcctgttgaaactcgataagtcaccacatcggtatttttcgcgtgcgtgtagcttttggcattgcgcccgtgcttgaaaatgtcggtttcgtcgctatccagcaggttggcttcctccatcccagcaatcagcgccgcttgtgcctttgcggacacaaaatccttggctgcccgttgcagtgatgccggtcgaactaaaccgcgcttgagtaagtgttcccgaatataaacttcataaaccgcgtcgcccatgtaggctaacgcgataccgttcaattgttttggatcaaatgtcattgtctgcgccaccgtgttccttgaggagtgtcttccaaaataatgccttgtgcggccaactgatcacgaatttggtcgctcttagcaaagtctttcgctgcccgtgccgcatctcgagccttcaccaaggcatcaatgtctgcatccaggttcttctgatcagtaaacaccacaccgaagatttgcagccaagcatcgtattcattcaaaaggtcattgatactttcacttttgaccgtctcttcattagcatattcattaagcaactttgccagatcgaataaaacggtgaggccattttgaacgttgatatcatcatccatggcagtcacgaagcgatccttcaaggtttgcagctgcttggtaatttgtggatcaacgccggtttcggccccgcgacgacgataggtcaaattctcacgagcaatttttagccgattgagactgttggccgcatttttgaggttagtttcagaatagcgaatcggcatccgatattgggtacccgccatgaaaaaacgtagaacttgcggatcaactgttttgcgaatatcgtgcacagtgatgaagttgccaagcgatttgctcattttctcgtcgtcttcaccaatcgtcacgaagccgttatgcatccaataccgaacgaactgcttgtcggttttagcttcgctttgggcgatttcattctcatgatgcggaaattccagatcctggccgccaccgtgaatgtcaaaagtatcacataacagcttggtgctcatgactgagcattcaatgtgccatcctggccgtcctttgccccatggtgactcccaactgatctcaccgggtttggcggctttccacaaagcaaaatcaatcggatcttcttttttagctaattcgtcttgggtaatatgttgactggcaccttcttcaagttcatccacattctgatgagataactccccataatgtttaaacttgcgggcccggtaataaacatcgccgtcaacagcataagcgtattctttgtcgatcaaatcctgcacaaattcaataatatccgggatcatttgactggcgcgaggatgagccgttgccggttcgatccccagcgccgtcgtgtcttccatgaacgcatcaataaaccgttgcgccaagtccagcggagcttcaccggttttatgagcagcattgataatcttgtcatcaacatcggtgaagttcgaaacataggtcactttatatccgcgatattcaaaataccggcggatggtatcaaacgcgatagcactgcgcgcgttaccgatgtggatgtaattgtaaacagtcggaccgcagacatacatccggatttctcccgggtgcaacggcgtgaatgtctcttttttccgggacattgtattgtataacgttaacatcggctcatttccttcctgtagcgtcttaactgcattttacaggaaacgaccgtgattataaaggaacggggcgggcgattgcaacattctgtgccgtgccaaacgccgcaatctccgccttggcactacgaccttaatgcttagcagactatctatcaaaaaataaaaaggaatgattttcctaaatacggcaatcattccttttggagctgcgcatgacgttcctgtttttcagcagccttaatcaattttccgcttcggattcagaatccccaacggatcaaacaatcctttaatttgatgctgaatctcatcaacatcaaagcctaattcttcattgttccattggttcttgctcatccccaccgcatgttcaccggaaatggtgccgccgagtgccaatgctttgcggaacatcagacgaatggcttggagcgcttctttgggcggttcttcctcatcagccggccagatgacggttggatgcacattaccatcgcccgcatgacctgccgtgtaaatttcgacatttaagtcctgtgcgactgaggcaatatagtccatcatttcgggcaatttagacaacggcaccgccatgtcttcaataatatgttggccgttagcgaaaaccgccggcaacatgtcctgacgcaacttgataatcgccgctgcttctttgggatcactggtaaccttgatatttttggcatgatcgtcatttaaaatctgctccgccattttcagactagcttcaccgccagcatctaaccgaaacaggagcattgcctcggcgccttcagcatagtgagtgccttcataacgatccaacgcagcaactgtcagaccatcaagtgcttcaagcatgaccggatagataccggaaagccgcaaatcctccacccctttagccaatgctgtcatgttgtcaaaataggcaattccaacaaccggcgtgccaattggaatcgggttcagtttgacagtgacttcagtgatgatgcccaatgtgccttccgagccgacgaataagtgcgtcaaatcataactaaacgcatgcttgtaagtgcggccgccaagtttgatttcacggccgtctgccaaaacaactttaaggccaagtacattgtcggttgtcgccccatacttcacggtactcatcccaccagcattggttgccgcattgccaccaatgcttgaaattggcttagatccaggatcaggtgcgtaaaaaagaccttgcgcacgcgctgccttatccaggtccctgttgatcacaccaggctcaaccactgccaacagatcgcctttgctaatctctttaatccgattcattcgcgctgtcgataaaataagactgccgtttatgccgtcagaaccgatcacggtgctcgtatctgcgctttggggaaccactggcatatgatattgacgcgcgatttttaacacaccttgaatatctgcaacatcgctgactgcaacatatgccagaattttcccggcgatctcacgttgggcattgccattggcgctatgttcgcgcgcgattttatcatcaatgtggatttcggcatgcggggccgcgtcttgcaaggctgccagaatttccgagttatcataagctgtaaaaattgccatcacaaaaacctcctcaacacctctaaaggcaggtggcagcgttgaccattcgcctctgaagcgtcgactttattatggactattttggtaaagatggcttagtaagacgctcggtggtgtgcctattaagacgccgattgaccctgcgatgagattgactgtcttgcctttgtctcaccagcaatggtttccttgggatgaacggtaataacagcctctcctagccaagtcgtttctggtgccatggctgccaagcgataaggttgacgtggttggccgctgcctgttattggcgttggtgtggcaacacaaatcgtcaagacatctgtgtccacaccagcgtctgctagatggcgaaagcggaccaaattaatggtctgttcttgtggcaccactagtggttcgcagttgccgcgataatcgagtcgaacgacatgccggccatgtgtgtcaaaaccagataaaacggccacctctggacgaccaagtacttgagttcgcggatcaaaaccgtcaaaactggcgaaacgcggcaatatgtaatagaagatcggtgacgccagggccacaggttccttgcttagtaaatgcaggccgactttcccgccaaaacagccggctgcagctgatcccggcaaatattgcaaggcaaaagttggttttgtggtcaatgtgtctgacggttccttgtcgttattgcgattgtcacgcatcagtggtcactcctgtcaaaattatgcttgatataattaaaatgatactcgcttgatccataaaaacgcacgttataagatttaccgaatttttgctgacgattcaatccgagccattgggccagattctccaagtaagcctgaaaaagcgcgactgtgttgcggttatcaaaaaacaggtgtttgttcacggaccatcgtcggtcctgaacaaacacctgcagttgtgaaaaatcacaacatgaactcaacattaggaagacaacgacgaaaaccagaaaaacatgcgctgtccattaatcatgccggggattggcttatcaggtcaatgaaaaagccaggcataaatgatatgaaaaatcgctgccgtcaccagtcctgtcatcatacccagaacaaaatataaaagtaagtgctgccgcttacctttcatttttcattcctacccttcctacgttgcaaggagctagtctccctgtcatttagggtaaccgatgtcgacaagttctgggggaaataaatataaacgttaggaaatcaccgattaacgtcgtcctttaggcacactcactcatttattaacaacaagcgttgcccttcgcgttccacccaaacctattgtttgcatgcaaaaacccgcacatctgcgtgggcttcctgcatcaattaaagttggccggtgacaagatcaacgtttttaaggacttgatcgcgacccatcagttcaatggtttcagcaagttgcggaccatgcatccgcaatgttgcagcgattcgaattggcatgtaaagcttgcgacccttgaccttggtttcctgcttgacttcattgacaataccgccaatggaataagcgtcaaacgtgtcaagtgcccgaatctttttggcgaaggcttcgatgactggcttagcattgtcatctgccagttctttgcgttcgtcatcggttaggtcagtggctttgtcgaagaaaatatcggcaagcttgctgatctgagcggtgtaactcatttgatcggtgtaaagactaataagctggcgcgcccactcgatggtcttcggatctggatcgctatgaattttgccgtcttcaatcaagttagccaaggacaaactcattaattcattcgggttcgtcttctgcttagccttgatgtattggttgttcacccattccagtttcttctggtcaaaacgggctgggctcttggatagccgctttggatcgaattgcttgatgaattccttcttggtgaaaatttcatcttcaccaactggggaccagccaaggagcgtaatgaagttgaacatcgcgtctggcaaatagccgagttcacgatattgttcaatgaactgtaacacggtttcatcacgcttcgacaacttcttaccggtggcgccgttgatgatcaaggtcatatggccaaaaattggtggttcccagccaaatgcatcgtaaatggccaattgcttcggtgtgttggcaatatgatcgtccccacgcagcacgtggctgatttgcatcatatgatcgtctactaccaccgcaaaattgtacgttggcatgccatcacgcttctgaatgacaaaatcgccgcccagtgtgttggcatcaatcgagattttccccttaacgatgtcgtcccactcgtaggtcttgtccattggaatgtggaaccgaatcacaggctccaagcccttcgctttggccgcggcaatcgcgtcagctttttcagcgtccgtcatgccctcatattcatattcgtaatgcggcatctcgtgacgagccttttgggcttcacgatcggctttcagttcctcttcggtccgataagactcgtaggcaaagcctttatcaacaagttgcttgatcagcttgtcatagatgtccttacgttcagactgccggtatgggccaaagtcgccgcctttgtcggggccttcatcccagtcaatcccgagccagtgaaggttctccatctgactcttttcgccgtctgcaacattccgctttgtatcggtgtcttcgatccgcagcaccaatgttccgttgttgtgccgtgcgaacaaataattgaacaacgccgtccgcgcattaccgatatgcaaatgcccggtcggacttggtgcataacgcacccgaattggtcgatctgccaatgtcttagcctccatttttctgtaaacatgcactgatagtgtaccacagaagggacgttcattgggctgatgtgggagattgaatctatgtcagttggcttctgatcgttctactaaacgacgcaacctttgcaatctatcattgccttaatcaaacgggaatctcatgccccatgcatttcgcacactgtccatgatatggctgacatcgtgagatagtagcaactgaccgtcatcgtgaccgtcatcaatgtaacgctgaaaatcacggacttcataaactaaggcatcggcctgatcgcctgcgcttaatacctcgctggtcgtggtatgggcatcaggggtgtaggttactttggcggttgtggcacgcggatagtcatcaatttcaacgtagccttttgtgcctgagatcacgccgcgttttggctgcttagcacgtaatgacagtgccatgacggccaactgctgatcagcattttttaaaatgatccctgattgttcatcaacaccggtttcaaagtacttgacggtggtgagcgttacattcggctgagcatctaagaacgtacgagcaaaggcagttgcgtatccgccgatatcaagcaacgcgccaccagccagatcattattgaagaaacgattctttggatcaaagtctttcaagctaccgaagttaacttgaacaagatgaatgtcacctaacttgctacttgcaatcagctgcttgacttgttgataaaccggcatatggtacaaggttaacccttcagataaaatcaggcccttgtgcttggccaacagctggacatcatcaaattgcttagcattgaccgtaatcgctttttcgccaagaacgtgtttgccggcattcaaagcttttttgatgtatgggtaatgataggtatgcggcgttgcaatataaatcacatcaacgtttgggtcggcaatcaaggcatctggatctgtatatgttttggcaatatgtttttcaagagcgaacttcttaagcatgtcggcattgacatcagcgacggcgtagatgctgccgttttcccggtttaaagcgtcggccatttcatgtgcgatccaaccagttccgatcataccccagttatagtttgtcatatgactcatcctttcttttaaacgcgttctccagacccgaaacctgcgtgtaagaaccttggtcgcaatagtcagagtccgatcatcacgcctaaggtcacttacactccggtttctaaccgggctggttcacgctctgcttaatttcatgtacctgaccatctggtgtttctatcaagagtaatgtcgctaagtgagcaaagtatgacgtcgcaacaactcccggtaatgaggctagcaaatgatcaacttttgcgatatccgtccattccgccatcgtacaatcaattaattcattgccgtcgcgcgttcgcgtgtagccatgtaagtggtagccattcgtcgttttgcctgcaagcttagcagcttggcagatgccatcacctgttcacttgccgcgctaacaacttccaatgtcagtggtaccgcggcattcagttgagcgttgacatttttctgagcagtgagaatcacataagcatggctcgcctgcgcgtgcaacttttcataaaaatgaatgccgccattacttttaagtaaatttaagtccttatcggcactgtcacagccatcaaaggcaatatcactagctatctgtgttgttgtcggtaaccccagtgtctgacaataagccagcgttacttcagagggactgcaaatctgaatacccggcaatggccgcgcgacaatgccatcagcaagcgtctgcatgtgccgaccaccgccaagactcactacctgatgcggctgaataagtgctagagcagcggcgatttgatctgtcatgaaagtcgcttcctctcttatatttttgatgaaattatatttctcatataatgtaaggctgaaatttagttttgtcaacagctagtttttaggattgtcttttgaaattaatcgcgtagaataaaggccggagagtttcataaaacagattattcagaaatttaattgaaaaggagctgtgttatgagtattattgaccgtctttatagcatgctgccaacactgaccgcgactgaccgtaagattgcgcaggttgttctgacgaatcccggtgctgtcgtgaataccaccatcgccgccctcgcaaaagaaagtaacgttagcgaagcctcaatttctcgtttttgccggacaattggtgttgaaggctttcatcaactcaagattgagcttgctaaggttgctgaaaaccgtagtgcgtattatcaggaaattaacgccgacaatcttcagcaagccttaagcaatatcagtgccaacaaagtcgccgaaatcgaaggcacactaaaaaacgccagctcacatgacattcgaaaaattttggatttgttaaaacaagctagtgtaattttagtagccgctgctggcgacacgcagccggttgccgatgacgccgtctataaattcaatcaactcggtctactagccatcacagacagttcttgggaaacggcgctcgcccaaaccatgaatgcacctgcagatgctttgttgctggttatctcaaattctggcgaaacgcggaatctcatcacccaaatcaaagccgctcaacaacgtggcattgctgtggtcgcgattaccaatcgcaaggattcaccgattggcttggccgccgattatcagcttttgaccgcggttcggcagcaaattttcgagtccgaatatttcttctcacgcgtagccgccatgacggcggtggaagccttattcttgttgcttctagctgaggataaaactttcatggcacatattaaggctcatgaagcattgattgcggagactaagatttaagtgttcgtcttaggccgactcttatcattcaaaaatgccatttctcctaaaaaaagaggggtgatttttccgcagcacagaaaaatcatccctctttatttgcaagtattaagtatgtttcaaccttaactaggaaaagtcagcaactatgccgtcttcgccgttctcgtcatcacctgacgattttgacgccagaaccaatacgtaaaggccaagactaaaattgtctgaacaactagtaggacttcttcaaccgcaccgttcagcgcaccaacctgcgtcagtgtcgccggaaagtcgataaaggcatgtaagccgattggcaacaatagccagaaccagcgcatgcgtttcataatgatgatccacacaaccacggataatgcgatctgaaccgccaaggcgagtagtcgttccatcaaggataacgaaatcgtccagcccgtcgttgccatcaattgtttcacttgcgtattgagcaccgaacgcgagctagcgggtaccttttcaagcatttcgtttactttgccgccattaatcagcattgcaaacataaagttgctgaacatggtcaggctgccaatcagaatcatttcaagcccgccatgacctaatccgtataggaatggtgtttcgggtgtcgccgtcttggttggtatgcgtttattaataaacttaagtcctagataacgaccaacctcttcaaaaacaccagctaacagcgcgccatacaacgcatatagaaacggcacatgttggaaatctttagcgatgccgcggaagggtccttccaatacaccagcgaataggaaaaaaacgcccatgccaataaagaaaaccttaacagcaccttttttgggcttgctgtaacgcagaatcacccagattaacaaaataatcggtaaggcaaaacaaagtagcatctcaacgcccatcatgttaaccgtgaattggctgacagggctgttattcacaactttatccattctgaacacccctcaatcaagtataaaagaaatgatgacaatacccgcgacgatcaatagaaaaccgacaaggatcacccaactcatcgttttggccatattgagcgtgaacccaatccccaaccgtttttcaacaaagagcgccggatcagttggattatagtaaaacatcccccagacccaatgctgattatcattcaacacagatcctttggccgtaagtcgccgcgttcccagaatatacaccaacggcaaaaaactgacggagagcagtgtcagggttagtgtgatgatcacaaaccaccattgaccttcagctgacatattcggcagcatgagttggagaaccagtaagctttgactcagaaaacctgtgaacagcagataatacaaaacggaattgcgcaccttaccagctcgcggttcagcatccggattgccgcgaactgccccgcgtgctctgcgggaaagataaaaagcacccagcacagttagcgtttcaaccgccagcgccaaaatcatgacccatgaatctgctgatgtttgctgaaaaccaagtacaagggctaaaaagaactgcggcaccaagacgagcccataggctgccggaaccagcgtttggggcttgagtttattcaggtcaacagtcaccttgctttgggtaagctcctgctgattccccatctctttaaggagttgcaaacttttccgatgtgccgccacaatcaaggcataattcagacagatcgaaagcaaaaaggcagcaatttgaatccaagcaagcgcagtcgccgcaaagtgcatggtggccgcaatcccaatgccaatcactgaaaggattgccgcccctgttaatgaaaaggcgagataacgacggcgtaattttttagctgctggcgttgtccaaatgctgttacgggcatatacaccgccgaataaaacatttcgccgtgacagccatggtgtgacagcctgaatcgcaaccaatatcaaccacgtaacaactaaaatcaccatttctgcttgcatcttttatcactccttcagatcatcataaagttcatcaatcatggtgtgcagtgcatcccgatctaaatgccgggccacggcctccgcgacaaccttttctaaggcaggttgcagcacctctgccactgcttgattcggggagccatgcgcgtgaacaacgacgccacggcctcgctggatctcaacaaagccttccctttgtagttccttataggctttattcaccgtatgcagattaaccccaagttcattgcccagcgcgcggatagacggcaaaatagtgccattcgtcaagtccccggtggcaatgccactcacgatagcatcgcgaatctgcgtatacagcggaatcttagaatcgaaatcgattgtcagttgcacgttttcaccttctaactgttctagttgttatagttagtgtataacactgaacgctcacttagtcaacaattcacaactcaaaaggcgataagagcacaaaaaaagtcccacgcaaaatatgtcatcgtgagactctttacaaactcttttttacagatcaataactacttttcccgacgacgcagtccaaatgatccaaaactgatcaaggcaagcagcaaagccaccccgatcgcaattaagccggtccgttggttatcaccggtattcggcaagtaacggcttatttgcttggttgggataataacttcgattggcgcggtgtcattatcggatagcggtgccgattctgtcggcgtagccgacatacttggcaaaacttgagttgacggtgttgttggtgttgatggcgtgactggcgttgatggcgtcacaggtgtcgcttgctttgcgtaaacgaacgtcacggttagactgcctgttgcaaaagcaccattttccgcgatgctgccagatgctaatcgtaagtagtgataattcgcgatcatcgttggtgtaactgcatacggatcgccgacatgaccggtcagaatcttatcaggcgcaatctgcttgccattgtcatcgacatatttcacgtcaacagttccttgagcaactggattcttagtgtagatgaaggtgacggtttgcgtaccatccgtaaatgaaccatcttccggcgcactacctgtcgccaaacgagcaaattggtaattcgtcatatcaattggtcttgcttcgtaaggatcaccggcttggccagtgagtattttatcagatgccaaccgtttgccgtctacgtcaacaaacttcacgttgacactgccacgcggaattggtgtcttcgtataaacaaaggtgaccggctgtacgtcattggtgaaagtcccgtttgctggtgcgctgtctgtggctaattggggattttcataatagtcaaaggcaggtgctgtcatcgtataaggatcaccgactttgccagtgatcaccttatcaggtgccaacatattaccctctatatcaacacacctaacgacgacggcattgccagttatgggtaaactacgattctgataaacatcggtgtctggcacagcgctcgttgtgtcatcgccagcgtctgtgacacccttagtcgaatattgaccggtttgatgaccggcaatgatctgggcattcatgccagtttcttgctgtttcaataccgttgcttgattagtcggcgttgttccagtcgcgttggtgaccactgaatgaatatgcgatgtcgatgctgcaactgactggatttgactaccacccacacaaatccccacaccaatcaacgctgccacccatagcgtacccgctttatacatcttatgctgagacttttcgttactaaatgcctgcaatgattttgcccccttctcatgacccaagccgagacgcgctcaaccgaaaaaaacaaagtaaatattacatattggtgacaagtataacacttgacatttttctatgtagctccagcacaaaaagcctctttcaattgccgtattgcaattcaaaaaaagacttcatagaaccaagtctaaaagtctttatcaattaactaatattttgagtgtttaaaaaccgtctacgtgccacaaagcaatgttctttagattgtttaaaacccaaacctgaagtcatgaccagtccacatccgcaatccaaatgcttcttttatttagcgttcattactgaaagtcattttcaaaattagtcctgcctttggtcgtcgctggaaagatgaatgccatttctacgaaccaacagctgatagtttctagatcaattggtattgattcaggaacttgcacgagatcatgaaagacagcaaaagaaggcagcttcagttcccgataagggatctgaagccgccttctttcatgacttaacagattatctctctttatcccgaattgccttttgctgatgcgctggctttgcgaaaatcatgcgccctgcagccgtttgtaaggcactggtaacaatcacttctaacggtttgttcatgtagaacttgccgtcttcaacaacgaccatggtgccgtcttccagatacgcgaccccttgctggcgctcagagccggatttgatgacggtgaccgtcatgccttcaccgggaatgacatctggtttcagcgcattggctaaagcgttgatgttgagcactggcacattttgaaactgggctactttgttaaggttaaaatcattcgtcatgacgatgccatctagcaatttagcgagcttaagcagcttgctgtcgacttcggtcatatcttcgaaatcgccttcatacatctcaatatgaatgtctttatccttttgcatggcattgagaatatccaatcctcggcgaccacgcattcttttcatggaatctgcggagtcggagattagctgaagctcatgcaaaacaaaattgggcacgagcatggtgccttcgataaagccggttttggcgatggcctgaacacgaccatcaatgatcacactggtatccagcaacttgtacttgcggaaatgatcgccgaccttacgttctaacacctgatcattttccgtatctgcagttcggcggttacggaagctcaaaagccgccgccattcttcgctgcgtgtcgtacccacccgaaaacccaagtaaccgaataatagcatgatgatgagtggtaggaagatattcagcggtgcaacgaagccatagaacggaattgaaataattgccgccaagatcaagccgataatcgtggataagctgccgaacaacaagtagcttggcgactttgcgttcagtgtcttctccaacactttcaaccgacctagaatccaaccaacgctgaggcttgccaacagcaggaaaacaacgccgccaatcaagccgtcaattaacagattgttcagaaaatggttgtctgcccagccgatcaaatcccaaagcggcggcaaggtgcccatcccgaccccaatgccaatcaggccgaagatgatatagataattcgtttcttcataaaatgaccccctttcttagtttaattaaagaccttatgcagcgcttcggcaatgcttgtaacaccaatgacttgaatatcttttggcgcatgccagccttgcaagttgttacggggtacaaaaatccgtttgaaacccaatttggccgcctctttgacacgttcttcgatccgattgacgcggcgcacttcccccgtcaatccgatttcaccgacaaaacaatctgtcggtgaaatctccttatctcgataagatgacgcaattgccacagccatggcgaggtcaatcgccggctcatcgagtttcacaccgcctgttgccttgagataggcgtcctgattttgcaacatcaagttagcccgcttctcaagaacggccatgatcaagctcacgcgattgtgatccaacccactgctcgtccgtttagcattgccatacatcgttggactgatcaaggcttgaatctcgactaagattggtcgggtgccttccatcgaaacaaccaccgcagaaccggttgcccccgccaagcgttcttccaagaagatttccgagggattggcgacttcctgtaacccgtcttgatgcatttcgaaaatgccgatttcattggtcgatccaaatcgatttttgacggatcttaagattcgatacgtgtggtgcatgtcgccttcaaaatagagcaccgtgtcgaccatatgctcaagaatcttcggcccggcaatcgccccttccttagtgacatggccaacgatgaaaatggtcacgcctttggacttggcaatgcgcatcagttctgccgtcacttcgcgaatctgtgccacagaaccgaccgctgaattcatttctggcacattcatagtttgaacggagtcgatcacaacataatccggctgcatttggttgatgacgtcttcaatactcggcatgtcggtttcgggatacaagtacatccccgaatttgccacgccaagccggccagcccgcattttgatctgactggcactttcttcgccagagacatacaaaacggttccgccggtattagccaactgccctgatacttgtaatagcaaggttgatttaccaatccccggatccccgccgatcagcaccagtgaccctggcaccactccgccgccaagcacccggttcagttcatctaagccagtcttgacgcgcgtttctttggtgatcgtcacatcgttcatccgcgtcggctttatcttgcttccggctgcggtttgtcgcggcacagacttgcttgaactgacggtttcttccactaaggtgttccagccgccgcaatttggacaccggcctagataagtggctgaaatatagccacagttttggcaaacatattgtgtttttgctttcgccatattatcccttcaatagttacgctttatcggttgaaccgaacccgctttgtcgcttggctaggccgccttcatcgccgtctgccaataagaatggcatgaaaataccttgaccgatacgatcgccttttttaatcacgacatcgcgcgggaaaaaattaagtagctgaataaagatttcgccttcattggctggattgttatagtaatccgcatcaatcacgccaatcccgttcggcaacaccaagccatgcttcaatggactgctcgaacgattcgctagcactaaaacttcattgggctgcatataggctttgatcccagtcggcaccaagtaaggtttcaacaccttcttagcgcgctcaaagtctctattggtcagtgggtgctcatttttaatcaagcggaaaagccggataaagtcgtaccgccaaatacttcttaagacgaagtcctcacgtgcataaaagtcgtaaccagcggcctgcttcgtctgccgggtcggcaaagttaaatcttcatcttgatactttgaaacaatctcaaaacctcgggtcttcatagctgcctccatttaaatagtgtccaaagtatcataccatgcgggcacatggcacggccatggtgaaagggcttccctccttgtaattataccgcgttcctgatagatttggggtagtagacaggttattaaacaggcaaacatgtaagcgtctgaagctgcttaagaatcctctaaaagtttacctgtaccatcacgaattgacccaaggaggtgccccatggaattccaacgagaaccaggtcgtttttttaacacggactgggacggccgcttaatggccgaagtcacttttcaagacattgatgacggtcacgcgtgggcggttgaccatacgtttgttgacgaaagcttgcgcggtcaagggattgccggccagctgattgaaacagtcgtggctgcagctcgcaaggaagacaaaacgattgaaccgctttgttcatacgccgtccatgctttccacaatcaccccgaatatgccgatgtcttgcggccaacaaaaaaagcttaatcgtccgccgtactgacatcatcacagcaacaaaaaaagccgctatgagcggcttttttgtgagcgcaagcagactcccttagaaacctgcaaccaggtaataggcgacaatcgtctatgctagccgatcattccagcgattcttcttagttggcaacaggaagtaaatcaataaccagatttgaccgatgattggcacataccaaagcaaaacccaccaaccacggcgatccgtgtcatgcaaacgccgaactgacagcgaccaattggcaataaaaataatgaaattaatcagtgatgcaagaaaggtttcttttccaggctgaaaattcaaaacacgcgtgacgttcatgccaaaaatattaaataaaatcgtcatgatgacatagccaacgataacattaagcaaccacggccaccaaaattcacgccgcgacgccgtgccagaaaagttgcctaaatgcttaaaatagttctgatatgccttaaccataagcttaaacccacctaactagataattgtatgtccaaataatactggacatagtctaaattatacttttagtaagtgcttattaaaagtaaaataccccgaaacttcttcttctgagaatgtgcagcattttgttgaatagattaacgagcttgtgccactcaatgatccattggttttccatctttaaattcaaattaaaatgaggtaaggtttctttaatgcaataaaaaggagatcgcctatgtcagaaattacatttgatcaaattaaagactttcaagcccaactagccaaacagccggctgccggcgccacagctcgtgcggtgcaaaacgttggcccacaagctgcaagtcgcgaacccattgacggtgaagatatgaaaccggtcttttctcttgatcttgataccggtaccgttgctaaccaaaagaaaagtggccgctgttggctctttgccaccctcaacaccgttcgccacggcattgctgatgaattcggcattaaggacttcgagttttcacaaaactacaacgccttctttgatcgtttggaaaaagctaatttattttatgaaaacattttagcaacggccgataaaccgcttgatgaccgcgaagttgccgattatctgagtggcccggatcaggatggcggtcactatgatcaggctgaagcactgatcgaaaaatacggtctagtccctaagtcaatcatgccagaaacctacaacagcgaaaaaacggttgaactcaacagcgttttgaatgagaagctgcgcaaagatgccaaagtcttgcgtgagttgaaacaggccaacgctggcgatgacgccattgccgctaaaaaacgcgaatttctcagcgttgtttaccgcattctcgcttacacttttggcaacccgccaacccaatttgactttgaatatcgcgatgataagaagcagtaccaccgcgacaccaacctgaccccgcagtctttcttcaaaaaatatgtgaagtggcattttgacgattacgttgtggttgcgagtgatccggagccgaacaaaaaatatcatcagctgtataccatcgcttctgcgaacaccgttgtcggcggtcatcccctgaccattctgaatctaccacctgaccagttgaaaaaactggctttaacccagctacaggccggtgaagccgtttggttcggcaatgatgtgctcgctgatatggatcgcaaatctggcacgcttaaaggtgggctgtataactacagtgacttattcgatctggatcttcatttcgacaaaactgatcgaattgtgaccaccgaagcagaaatgtcgcatgctatgacgctgaccggcgctgatgttgttgacggcgaggtcaccaaatggaaagtcgaaaattcttggggcaaagacaacggtcacgatggctattttgttgctgatgcatcttggttcgaccaatatgtttatgaagtggtcgttcgcaaagatctgctcgatccagctgatcaagcagcacttaaagcaacaccaattaacgtaccagtctgggatttcctgaattaaattagacttgtatgctagactaatgatgttcgacaaaggcagtgcacctacatgctagctcatgctttcatgaacccgcttgccttcgtcttcataacgcgcttgcagtcgcagaggcttgcacatttgggctcaagcccgcttatgctccggcttctaagcgcttctgctcgcgcttaactttaacgcgctcgccagcccagaaacctgcgtgtaaggaccccagatgcaatggccaaaaccgggccatcacatctggcgccgcttacactccggtttctaaccgggctggctcgcgctcacaaaaaaggagtgtcttttaatgtctgcagaaattaccactggcgatctggctcaattcaaacaagatctccaagccacacccggtgcatccgctcttcaaaaagcggtcatgaacaacggtatcaacgcaactgctgagaacaccgacagcaaagttgccatgaccccgactttttctattgaacttgataccggcagcgttgccaaccaaaagcaaagtggccgttgctggatgtttgccgccctcaacacgatgcgtcacggcattcaagcacaatttaaaatcaaagacttcgaactttctcagaattacaccttcttctgggacaaatttgaaaaatccaattatttttatgaaaatgttctaaaaaccgccgatcaaccactcgacagccgtaaagttgcctttttgatgaccacaccacaacaggatggtggtcagtgggatatgttgtctgctttgatcgaaaaatacgggatcgttcctaagtccgtgatgccggaaacttacagctcaagtaaaagtagcgagttgaacggtttgttgaacttgaagttgcgcaaggacgccgttgcgcttcgcaaactggttgctgataaagcaagcgatgctgatattgaagcagctaaacagaaaatgttagctgaagattatcgaattttggcttacaccttaggcaacccgccgacgaagttcgacttcgaatatcgcgatgatgataagcagtatcatattgaccgcgaactcaccccgcagaccttcttcaagaagtacgttgcatggaaccttgatgattaccaaagtatcatcaatgcgccaactgacgacaagccatacaaccatttatacacggttgaaatgctcggcaacgttgtcggtggccgcgaagttcggcacttgaacctcgatatcgatactttcaaagccttggccgttaagcaactcaaggcaggcgaatcagtttggttcggttctgatgttggtcagagttctgatcggcaattgggcatcatggataccaacatctataagaaggatgatcttttcaacaccgacttcaccatgaccaaggcggaacgcctcgattacggcgaaagcctcatgacccacgcaatggtcctcaccggcgttgacattgtcgacggcaagccaaccaagtggaaggttgaaaactcttggggcgacaaggtcggtgacaaaggctatttcgtggccagtgattcttggtttgacgagttcgtttaccaagttgtcatctccaaaaagtacctgtcagctgacttgcaagacgtcatcaagaacgaatacgacaaaccaaccgttctggccccatgggatccaatgggtgctttagcttccaaataagtccatacgaattggtaagctgtcatattgcaaagcctcacggtcaatgatcgtgaggctttttgctgttcgcaaaccccttgcgaaaccatcaaaaaatgttttgctagttgacgtatcgaacttttttgattaaagaaaaatggctctacgtcaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctctcgcaacgctccaaacgttgctttcagaccggccagatgcgatttcatgtccccaataccgaggtgaataatccaggtttaaatatgtgaatttcgtgaatcgccgcgccatcgccaacttgctagtcgggcacacaaaaaaacacccctgcacaagcagaagtgtttgaaagacaactgaagttacttgattggtttccaggtccattcctgaacttctggaatatcatcgccgtttgcgcggatgaagtcatgatgatattgcaaggtatcatccatcttctgaacaaacgcggcagccttttcagcgtaggctggcacatgctgaataacatccttggccaagtggtaacggtcaagttcgttgagtacccgcatgtcaaatggtgtggtaatgtcaccttcttcacgatagccgtgaatcagcacattgcgattcgggcgagtgaagaagatgtcgcgaatcaacccttcaaagccatgataagcgaagaggatcggtttgtcggtggtgaagtagctgttgaattcagcatcactcaaaccgcgcggatcgatttccggactgcgcagcttcagcaggtcaaccacgttaatgaagcgaatcttcaaatctgggaaggcgtcgtgcagcaagttaatggcagcaagactttccatgtttggttcggttccggcagcggcaatgacaacatctggttcgacgccatcatcattggaagcccaatcaatccgcttcaagccggaattagccaaaacagtggcttcatcaatgctatagaactgtggccgcggctgcttggatgtgatgagcacgttcacggtattttgtgagctgaacaacttcggagaaatggccagcaagctgttggcatcagctggtagatactcgcgaatgtattcagccttcttttcagccatgtgtgtcaaaatacctgggtcctgatgggtgtacccattgtgatcctgctggaaggaagtcgatgttgagaccacgttcagacttggataagccttatgccatggttcttcatgtgccttccgaatccacttgaagtgctgagtgagcatggaatcgacgacccggaggaaagcttcgtaactggtgaataagccatgacggccggtcaacgtgtagccttcgttaaagccttccgcctgatgttcggacaactgcgagtcaataatccggccagccggtgccaaatattggtcagccggttccttgattggttccagccattgacggttggtcacttcaaacaagctatacaaccggttactcatggtttcgtcagggccaaagatccggaaattatgcggattcagcttgatcaaatcacgcagataatcagaccacacgatcatgtcttgcttaatctgcttgccgtgttccttgttgtccagcgcatacttgcgataatctggcaataccaacggcttcggatcaatcccaccgttcgtaattgggttagcagccatccgctgctcaccctttggcggcaatgcagccaattcagggatcaacttgccgttttcatcgaacagttcctctggatggtaggacttcagccagcctgccaaggaatcagcgtgttccatgtcttcagcgtcgacaggaatcggaatctggtgcgcacggaaggaaccttcgattggttcgccattccaactcttcgggcctgtccagccctttggtgaccggaaaataatcactggccagtgtggcatcgtggtgtcgccagtctcacgtgcatgtttctgaatggccttaatgtcttcaattgcttcatccaaaactttagccatttccggattcagcttctctggatcatcgccttcaacgaagaatggcttccaacccataccactgaagtatttgtctagatcttcatctgacttacgtgacaagatagttgggttggaaatcttaaacccgttcatatgcacaatcggtaaaatcgcgccatccgtgattgggttaatgaacgtattgctgaaccatgatgcagccaatgggccggtttcagtttcaccatcacccgtgacaaccgccgcgatgacctcaggattatcaagaatcgcgccggttgcgtgactcaaagcataacctaattcgccaccttcatggatggaacctggcgtttgtgcactcgcatgtgaagcaacgccacctggccatgagaactgcgtaaataggttcttcatgccttctttatcctgcgacacacgcggataaatctccgaatacgaaccgtctagataggaattggaaaccatcacttggccgccatgacccgggccttcaatataaaacatgttcaagtcatacttattgatcacccggttcaagtgggtataaatgaagttctgcccagcaatcgtgccccaatggccgatcggatgcggcttgacgtcttcgctcttcagtggccgttccagcagcgggttgtccttcaaataaagttgaccaactgaaatatagttggctgcccgccaataagcggtcatcttgtcaaagtattccttggatgagtaatcaacagtctttacttttgtatccatgctcatacctactttcgattttaatgacctcagtataacacagattccgaaaaaagcacttactttggcttaaattcacttaaaatgccttaaatattttaaaaaatcggtttgtaccagtttttatcgtgcacaacacctactgagaaactattctgaaaacgctcgctgctaaactggactcatcctgaacattaccgtgctagaatgaaggtaatgatgaatggttcctaatcaaggcaaactaaggaggtcacttatgggcaaacatcttttaaaaacggtcatggccgtgacgctgattggcgccgccgcttactgtctcaaacgatttagtgatgaactcgtcgtgtatgtttcacctgatgatgcaccggccaacaaagattcttggactgacttttagtttgaacattcggagatgttttgtcattgtcacagtttgattggtgattgcgactcttcgctttgatcggaagtgttggacttgtaatcattggccaattgacagctgctggtattattgttttcctgatggaagtgccatcggtattgaccgcagctgcctgctatgtcactagaacgtcgacgcgtctggttagttaccgggcgtttttttgtgctgcagccttgaccctgactggtaaaatggatttatcaaggagatgtcaagatgtccacatcagtaaaacctcagaaccgcgggcttgtcatggcggcggtttttatcgccacgttcatgacttccgttgaagttaccattgtcacaaccgctttgccagcgattattagtgacctgcatggattggcatatcaaagttggatcatgagtgcctacttgctcacaaccgctattaccacaccgatttatggtaaattagctgacacaattggcaggcgcggtatttttcagtggggcgtggtactgttcacgcttggtaccctgttaagcgggttggcaccgcatatcttcttgctcattttggcgcgggcactccaaggtatcggtgcaggcgccgtgatgccgctgacatttaccattattgctgattattatgattttgctcatcgggcgaatgtcttagcccttaataacacagcttggggactttccgccttggtcgggccgctgattggcggttttctggttgatcaattgtcttggcattgggtctttttcgttaatgtgccgcttggtattctcgtttttctgcttattcaaatcggttatcgggaacctagtcgtgaacacggcgttctcacgatcgattggttaggaattctttggttggcggtgacgctgattgcacttctacttggcattcaggcgcttgatcggcaaccggtgctcgccggtgttttgttggcgttggcacttgtggctggcttgctattgtaccatcaagaacagaaagcccccgatccgctcatcgcgccgaaaatgtttcataacttcacgttcacagtgcaaattttaactgccttgttacttagcggtgtcttgattggctatcaagtttacttcccgatctggcttcagtcgttgtatcatctcggcgcgacaacagctggtttagttgtgacatcgagttctgtcctttggctcgcctcttcatttttggtcggtccattaatcaaacgctttgtgccgcgaaccatgacactttggctcgtcgccattctgaccttagcttacttattgctcaccattgcttccccgcattttccggtttgggctttttatgtcattgccatgattaacggaacggtgatgggcattgtgatcagtatgaataccgttttgagccagcatcttgttggcaaagaatacgttggttccgccaccagcatcctaactcttggccgttcgctcgggcaaactgtgatgaccggtatctatggtgccactttgacgctcgtgattcgcgctaatttgcacggtaacacttttaaagctgtcaatgccgcgattagtgctaatgctgccgccaaaagccacgatcctcaggtagctgccaccattctcactggcttacacggtgttttcgtgatggtggtcatcgtgatggtgcttgtgtttatcctcaatttgcgcgatcctaatcgccacgtcattcaataaaccgccgttaaatgatcagccgcatccaacatttgggtgcggttttttcgtgcacgcagatcaaccagctagtctccagactgcgcatgatgacaaaaaaacatcggtgatcggccactgaacagccacgcacatgcaacaccacacgtctggttactcctattttttgacaatctacaatctgtaggttgcattcttcaaatcatcggcgtatattcgtctaacgtaatatagataactcaaggaggtcgcatggctatcaagcatcgtattttggatcgtgaaaaagtgctcgccgctgcccgggtgatggtgacccgtgatggtattcgtgagctcaccttccagacactggctaaggaattgaatattcgttcccagtcgctatacaactattttagtaacttggatgccgtgattgaggcgctggggactgagttcatgcacaacttacatcaagaactcattgaacaagtcagtggcattgctggcaaagacgccattcgcacttttgcgcaaaccacgcatcgctatttcgaacagcaacaatcattggatgaaattatttactttgtgcatcattttccagaaagcagtccatttgttcaggcaaccggcgatgtgatcggcttattaaaacacttgatcacccataccgagttcaaacacatggcaaaagaaagtttcgtccaaaattttatcagcagcgtgctcggttttaccgttctggaagtcatgggctttttgccagatggccaacctagccgcgatacgacttttgaatccctgctggatctctatctcagtgaagtaaaggagtaactcgacatgatcaaagatgaatttaagttcatcggcaaaaacaaactcattttgctctcagttctcgtcattaccttaatcccatttctctactgtatcttctttttgaagtcagtctgggatccttacggtgacaccaagaatctgccagtagcagtggtcaaccttgaccaacctgtcacctatcaaggcaaaaagcttgatgttggtgcgcagactttgaccaagcttaagaaaaatcatcaacttggctggcatttcgtttctgaagcagaagctaaaaaaggcatgaaggcagacaaatactacactgtcattacgctgccaaaggatttttccaaaaatgccgccaccgtcttagacgagcatcctaagaaaatgacgctgaagtacgagacaaatgattcactcaactatattggccaagtcatctccggcatcggcgttgacagtctcaactccgaaattcgtgccaacgtgaccaacgcctatgccagcgcggtttttgatcaaattaagactatcggtaatggcatgaaaacggcagccggcgccgctacccaaattgatgctggccaagtcaaacttgacgatggcattgatcagtacaccgtcgccgtttcgcaagtaaatgacggcgtgcaaacgatgaaggttaaagttgcaccgatgtcctcacaaatacctaagctcgcaagcggcgctaatcaagtcgcaggtgggttgcaaacgctcaatggcagtacgacaaacctagcaagtggcgttaatcagcttgcggcgggatctggccaagttacgagcggtttgggaaccttgcaatcgcagactggcacacttaaatctggtgtagggcaattagcaacaggatccaataaagttactagtggtttagcgtctttgcagtctcagactgccccgctcaaatccggcgtaggccaattagtaacgggatctgatgcggtcaccagtggcctagacacattgcagagccaagcaggactacttgttgacggtacggctcaattacaaactggttcaaaaaagctaacaactggtgtcaagaactatacgcaaagcgtgacgacactctctaacggcattgatcagcttgctagcagtaccagttccttagataatggaacaaaagcattggtaaccggttcatctcaagtaacacaaggtcttcaacaagtaggcaaatccgttgattcacaaaatcagcaagctgccgcatccttgcccaagcttcagaacactctcactgaatatgaagctaagttaaaatccgaacccaatcaaaacccagaattgattgcgggctttgagcaaattcaagcaagcgtcaacgctttgatttctcagactcaaactaatggcgccaaaatggccacgactctcaaccaaagcttgattccgggttcggaagaactaacaaacggtttaacgactttgaatcaacaagttccgactttaacggcagcaattattggccttcaaagcggttcaaaacaaattattgcaaacaatgaccaactggtaactggcgcaaacaatctgactgacggcatagggcaaatggcaacacaaacaccttcactagttagaggtgtagatcagctttatactggctctagtcaagtttcaggaggccttagcaccctgaaccatcaagttcctgtactcaccagcggcgtcaaccaactttacgccggttctaaccaagtttcaggaggccttggtagcttaaacaaccaagttcctgctctcaccagtggtatcaaccaactctacacgggttccagccaagtatccggcggtcttggtaccttaaatggccaagttccgacacttaccaatggtgtcggtcagctaaccaatggtgccagccaagttgctggcggtgtcaatcaattaaacgctagtgtgccgacactggtatccggtgtcaatcaactcgccgacggaaccggtcaaatcaatgacaagagcgacacactcaaatctggttccagtcagcttgaagacggcgacaagaagttcgctaagacacttaccagcagcgcccgtaaggtcaatggcattacgttaaccggtgatacggcaaagatgttcgctgcacctaccaagacagcgcaaaagcattattcttatgtgccaaactacggccatgcacttgccccatacgttttgagtctggcactttacgttggcgccttggtcttcaactttgcctatccaattcgcaaagtttccagagcagatggtacggcaactcagtggttcctgagcaaagtagccattggcggagctgttgcccttggcaccgcggttctcgaagcaactttgatgatggcgaccggtctcaaggtcgacaacatcggcttgttctatctgaccgcgatcctcttctcctttacgtcaatgtatctgattatgttcctctcaatggcattcgataatcctggtcgatttgtggcgatggtgggattgatgctgcaattaggtggtgccggcgggacattcccgatggagatcaccaatcagttctacaacgccattcatccattcctgccaatgacctactccattatgaatttccggaacgcgctcaccggcggcattgccgatagcactgtcaccctcggcttcatggtattgatcgccttcacgatcggctcgctcctgttgctgtggggcacaatgattctcttacaacgtcgtcacttaatgggtatctcacaactcgacgacaatcaaaagctccaagctgtcgaaaaataagcttcaagacgaaaaaaaatcacggcaaacgccgtgatctttttttgtcttcaatgcttgaactttgtcaccttgtcagcaatcgtcaggccagtatcttcaggaaaatagttaattttcgcacacaccatttgactagtaccgcctgccttcgctgtgacaatcggaatttctttcaaaatcgccatcagctgatcataatcgccttccattgtggtttcaaaagcactaacttcataattaattccggttgatttgatataggcgatcaccgcatcaaccactgccaagaccttttgtttctctggatacatcggtaacacttgcacagcaacgctagcattcatttttaggtctcccttgtgacaagattgccaaaacaactcacgagcaaaaagcatttatttatgagtcatcgctgacggatcggcggcgtgccgccacttgccgctacccggatcatcatggggcggctctacttgaaccgcttccggcggccatgccgcctcagtcaaatctggctgcagtaaaaaccggtcgtcatacgcatgccgaacttgcgttttaccatgttcgtcaatcaaggcatgccattcgcgagcttcgtctaacgtgatttgatcaagtgctggcgcaaaatcagcctgcattttggcatagttcgtatacggtccaaaaccgagccggttgaaaagacgcatggcatacgtatcagctacaaaagtttttttgccaaaggtgtacattagcatgacatccgccgtttcattgccaatgccatttagagccagcagagtttcacgtaactcagctgccggtttttctgcaatcttctcaaaactaccgccttgggccacaaaccacgtcaatagatcgtgaatccgctgcgctttttgccgataaaagccggctggccgcaccaacgtttccagctctgattgcgataacgccatcaagcgatcaacctgcatgtacggttgcaaattatgcacggcttgggcaacattctttgaactggtgcgctgaatgagaatcatcatcagccaatcttccaatgaattctgctgccaccagtattgtttgccataatgacggctcagattatgcatgacgattaagcgtttatccatcttttcacccctattcccctattaatatcgcacattcttctaaaaataaagtaaactggtcctatcagcagtttttgcaaaacgcggcgcagtcctgttaggaaccgaaatataagtcgctttaagcgtgacagtcaagcgctgactattgcgaccaaaagccctatctgcaggttttgggactggagcatgcgttttataaggaggcaaacgttatgaccatgatcgtggtctcagatattcacggtcatctggaaacaatggatcgagtgcgggcgatgcaagcaaagtatccccatactttgaccgtctatttgggtgactacattgatggctatccatacggcgggcgggtgctcactcaaattcgcgagcaggtgcaggcgagtcaggcaatcgcgatccgtggcaatcatgatcagatgctgctggattatctcgccgacaaagataatccatggttcatcaatggcggcaaggctaccttacatcaaatggtgcaagattacgcgccagctaaagcacgcaaaagcaacctacaacaagccgcgttgacctacatgtccccgctaattcaattcatcgccgagatgccgactgctgttgagtttgacaagctgttgctcatccatgccggtctagacctctcgctggaagaccctttaaaagaaacgacgccatttaatcgaatgtgggtccgtgagccgtatatctataatatggacgaaaccaaaaatcgggaacatcccatttttgctcacaatccgatcgctaaaacgattgtcaccggtcacacgccaactgccttgatttatggcgactatgaaaacaatgtcaaaccatctctaccgccaacttcattcagtgacggttatcctaaatgcccggttaaagtcattcaatatccagaagaatcaccacgttactttatcgatggcggcaatcatatgacttataaagaaaattacggcaatatctgtgttttcgatgaaacgaaaggggtcatgattgattcagatcaggggattaacgccaattaattgtctgtttgctcgtccattcctcagaagcttatgcagacacaaaaaccatctccccttcagtcgagagatggttttttaattgaaaagtcattaacgcttagctcaatgccatgacgtcacggacgatcattaattcttcattggtcggcacgagcaatgttttcacagttgaatctggtgtgctgaggtcggcttcgacgccgtgtgacttgtagttgatgtcattgtcgatcttagcgccgaggtaatcgagtgaacgcatgatcttgtcgcgaatctcgtcaccgttttcgccgatcccggctgtgaagacaagcacatccacgccgtccatcaaggctgcgtacgaacccacgtacttcacaacgcggttaacgaaaatatccaatgccagtttggcgcgtggcttggtatcttcgtcagcttccagatcccgcatgtcgttgctgatgccggaaataccgagcaggccggaatcgttgttcaggatatgaatcatttgccccacatcagggacatcaagtttcttcatgagataagccacaagtgatgggtcaatatccccggatcgtgtccccatcgtcaccccggctaacggcgtaaagcccatggaagtatcaatagactgcccgccttggactgcggtaacactggagcctgagcctaaatgcatcacaatcatccgtaagtcttctaacggcttgttaagcatctcagctgcccgcgcgctgacgtaacgcacacttgtcccgtgggcaccatatttgcgagcaccatatttcttgtaatagtcatagggaatactgtagaggaagttctcaggttgcatggtttgatggaacgccgtatcaaacactgcgacttctgtggcccatggcatcatctttttgaaaacatcaatgtaatctgcttcaaccggattatgcaaaggcgcgtagtcacgcaggttttgaatctgcaacaaggtagcatcatcaactacaacggattcggcaaaagtctccccgccggctaccacacgatggcccacaccagtaatctcatgcagatgttcaaccaaccctaacgccttgatgttacccatcaaactggcgacggcttcttgatagttagcaattggcgtatcgctttcatatttctgcccatcaccatacttaattttaacttttgattgcggctgtcccaaccgatcaaccaaaccttctgccagctgaacctcagctggcatatcaaaaagcttccacttcagggttgaactgcctgcgttgactgcgagaatttttgccattgtttttttcctcctctaaacgggtagtcggattgccgcacacgtaatcgcacagcatcatgactttttcttggttttcggcgaatcggggtcagggtgttgcgcatgccaggccttgatctgctctagccgttccttgaccttggcttcgctgccttgagtcgtgggatgatagtacgttttgccgataagattatccggcatggtttgcatggtcgttagtttatcttttgtgttgtgagcatattgatagtccttaccataacccagatcctgcatcaaatccgttaccccatttcgaatctgaagtggaactggttcggccagcgtttcggtcgcatctttctttgcgccttcatacgctgtgtagagtgcattcgatttcggtgcaagtgccaaataggtgactgcatgtgtgagatgaaccgtgcactcaggcatcccaataaattgacacgcctgataaacagcaattgtaatctccaatgcgcgtgagtcggccattccgatatcttcgctcgcaaatcgaactagccgccgagcgacatacaaggggtcttcccctgcttccagcattcgagccagccaataaatggccgcatcaacatcggaattgcgcattgatttgtgtaatgctgatattagattatagtgctcctcaccattcttgtcatacaataaggctttcttcgtcaacaactgggccacatctgcttgggtgaccgttatcacgccgcctttggtttcggcgtttgtcaccgccatctccaaggtgttcaaagcgattcgagcatccccgttagcaaaatcagcaatctgagctaagagctttttgccgatcttaaccttctgcagaccataaccgcgcggatcttttaacgctcgctgtaacaggtcaaccaattcagcactggtcaagccgtgcaacacgaaaacccgcgtccgtgacaagagtgccgcattgacttcaaacgaaggattctcggttgtcgcaccaatcaggataatgctgccgcgttcgacatatggcagaaaggcatcctgctgcgccttgttgaaacgatgaatttcatcaacaaacacaatggttttctgacccagctcgcgattctgttcagcctctttcatcacctgcttgatttctttaatcccgctggtgactgctgaaaatgtcacaaactgtgccttcgttcgccgagcaatgatccgcgccaatgttgttttaccgacaccaggcggaccccagaaaatcatggaactaatctcgtcatgttcgataagattgctgagcaccttatccttccctagcaaatgcgtttggccgacaaactcatcaagcgtctgtggccgcatacgactcgccaaaggttggaagttaccattttgaaatagactttgatccatatgctcacctccgatcaacgtccagacttaatattaagcgttttcaggccgcggcgcaaacattcaattgttctattattgtgttaccatcatgataagtaaattaataaccaaacagcgctgctgaatcacgcgttttggccacagtagcaaagcactttaatcaggaggaatcacaccatgacacaaatgccttcatcactacaaggatttccaaaaggtgaattcgcagctttttcaactgcaaaaatgacccacttcttaccttactcacaagaaaccagcactgacgacttgaaaggcttctttggcgcaaattaccaatacctcaccaaaaccccgattggccgtctcaaaattgacatccccaacacggagcaattgattgtacaatacggtgagatcatcgctcgcttcaccaatggcaaattcaagatcattgacagcacctacttccacaaaaacttcaatgatccgctagtagatgaggatgaaaagggtatctattagccaacgttacgagacctttacttcattaaaaaatgcagccgcggctgcatttttttatacattgagtggtgcttatgcctcatcgtcacgaaacttggttggcagagcaagaatgacaatctgaacgatgatgaggagtaacgcaattaagcttaacggcacattacccgcatttcgatcaagagttgatagaaatgctgatacgacgttgaaagcaatcaaccaccatggactaacgcctgcatctttgaatcgccgccaaccaactgtcaacgctggcagagctaacattgaccacgcgtaaatgatggcgaaaagaatgaaaacgatgatgattgcaccagtcccaagcgaattcacaagatggtcaatattttggctattaaatccgctaatggccgcgccaccgataataattgaaataattgagaagatcataaacaaaaaagtagggatgatgataatcataccaaacaggatactccaccaatattggctgcgactggattcaccagtaaagtcaccaccgcggatgaagaagtccttaactgctgtaccaaaaccaacatcaatcgtaccgcgcgtgttaggttgagccggaaacggtacaactttctgttctcgactcggcaacaatagaatgaccaagttagcaatgccgccaattaaaggaaacagcaatgccaaccaccaactcatgccgctaaccgctagtaacgggccaataaaactaatgataataatacccagataccaccacggactaactttggcgtcacgataacggcgaatcgttaagctcaattgtggatagccaagatacccaaagattgaaaatgccaacgttgtcagcgtgaacatgatattgctgcctaacgaatgactatccatgagagaaaatggaatcgcaatgccgaacagaacaccagcagccaaccctaataaaaattgggcaaggaaaagccaccaatactgtggtcgtgaactaacacccttaaagtcaccggcccgaaagaaaaagtccttaatagccggcccaaaatcgttttctcttttcatcgtgcctcgcctccaagtatttgttaaggcgagtataccatttgcggtcgtctcaccaaaactttataaccttcataaacttaagaattttatgcacaggcttcggcatgccactgaacaggttgatcacactgctctcattatgactttttcaccgtgcgatcggctagccgcaaatccagcagttcttcaatgacattctcccaatcttctggtcgcggcggtgacagccagatgacttttgaaatgtccgtatcatgataagcattgaccaaatccgtgataatcaatttagtttctggccggacttcgttggtcaccttgacgttcaatgttgaaaagtacttgatgtcgcgttcaataatggtgttgtactccttgcccagcgtgaaatcaacacagacataaagtggctccagcaccttgttcaaaggcacattggctgccaaggtcaacagacaatggtaaaacataaacttcgactgattcctatccaacttaaccgaccgcgcctggacaaattgctgacaatagtcaaagaattcgggatacattctaaagaagtaactgacttcaatatgatcatcaaagaattcactcctaaacggcaaggccagcacatcaatcaaacacttgttgacaacgtattcgatattggccttctcagacaatgtcaactgtacatcaaaattggcttcaaacccttgaatgaaagcccggccgtgctgtttgattgtatcgggaaaaacgatctcctccgacgtaataatgccaataatggcaaggaacgttccaaaataatcgcactcgctgtcaatcgtctggtcgcttgcggtaaaatgcgcctgataaatcgcaataacccgttttctggtttccagcgtgcgctcgcgaatattgcgcaccaaatcaacaatttccggtgatgtggcaatgacatgcccttgctggaatctaaccaaactgatcaaaaaatacgctttagtctcgatgagctgactcattgacggcgttgcttctgtcatcttcagcaactgcaaaagctcatgcagcgtactgcaaacattgtcatcaaacccggtttcatcaatatgcgcaaccaccatgattttcgtcagaagcagtctgatcgccaattcatcaccagtcagcttgccatcattactcagcacaatgccccaacttttgagcgtatcccgcagagccgtataccgtttgtacataaaggcatagctaccaaagtgttcctcggcaaattcggttaaattaaatgctggtggttcgtgcatcagcgtcatcaagatcttaatttgaagtgactgcttcagataatgttccaaaaaaaccgatgcattcgtattgtgatattcatgcaagataacggtagtgttcgtcacttcgatcgcaaaaaaatcactcaagtcgaatgctgcaatatcttcagcaatctctttggtctggcgtttaaaaagataatatgaaatctgcaatttatcttgcaactcgctgttcttcaatttgcgattcggatgctgatcaagataatacagtaactgaagtttcttttgatcgttcttttccatcagttcaagtaatttcacaaaatccaccttgtttttgagatcgtacctgtacgtgccagcaatgttttcccagcaaaacggtaagcaatattggccaaatatgcttgttgttgcgttgttttcccactttgtttgtacctgttcacatcaaaaattcgcacactttggtcatcggcagtaaacatgtccgataaccaaatgtgcaaattttgttgggctgctttttcttccgcttcagtgtccttcacgaattctcatattccttcttagtcaatctagtgtcacgacaatgttggtgcatcccatgcggacctaggttcgacacaagataccgtttcaagatgactgttccaattcgccaacgtctcaatgttgccattgattcattcgcagccctgtccattagttttatcgactaatttaatcactgaatacttacgaatattgtaccattattcttattcatccttgatcaggacgcttgctccttcttctttcgtttgaaaacaatgacgagtagaagcgccacaatcatgatcagtacagcgacaacagcaatgagtgcatacaattgccagctattatcttttttaatcgagacatctttttgattcagatttttggccactttatcggtaatcgtgaattgctttgtcagcgtccagtgatcatggtaatgctgtttgccatcagctgttttacgagtcatcccgccatctgcctgctgattgccatacacctcaagatgagcaacatacgtacccggcttaagcgtcttgccttctaacgcaattggaaaatcgaaggtcgtgtccggcgccatttgcaagccttctttagccacttgatagacagatttatccgaacctttagccataattttggcatcaaccgccactttgttgacgaacgtcgcggcatcgttttccatggatgccaagatcacattgcggtaattgatctgactcggcttaacatcattcaatttcacatgagccgctacctgatcagtactttgttgcatcaataagccaatcacgtacgagaagcgattgttgatggcaacccctttacctgcatcttttgcagcttgatcgcctggctgatgttccttcaaggtaatgccgcctgccatcacgccatggagtggtttgcttggcatggtcacatcaagatttaaaaccgtgctgcctttagcagggatcttgacctgagctggcgttttgacataatccttcatgttaaaggcaaggcttttcgctggcttgatggcattttgaccgtattcaaccacgccgttaatattcgtcgttgcactggcaatgccaacatccacagccacctctttttctgtatcgtttcgcaagtcaacatgcagggcctgcttagcaccctgatccattttgatgtcaaaatagctaacacctttattgacctgattgtccggcatctgggccttggccgcaaagttcaattctgaggcaaaaacatgggctgcaggggtcatcaacatggcaacaaacgctgctatacagaaaattgtttttttcacaaaggatctccttgtcttttaagatgtgatcggtcatgtctattcaagttggaactagatgctagaaaatgtatgtgcgctaacggaaaccaattgcgtccaacattttcggagaatcatgagcttacttgttatctggtgtatccgttaaagtccaggtgaatgttgtcgcatacttttcagcgtatttcgtcgtggcgcctgggacggtcaattcaacgctgcgtgccgcatcatcggcatctttgccccagttcaataggtgcgtgccagtacctgacccagttttagcgttcatcaccgtttgctctgcgcccggcaccaaggccatctcagctgtaccatcagggtgtgctgcggtggaggcggtgaccacatgcccattcttaagccgaatttgtgcaccagttaattctttcccgctaacggacgtgagttggtcattttgcttcacaactaatttccaaccggcttcggtgccgcgattatcggtgacctgaacaaagttgggtcccactttttccgtacctgcagcatcttgatatttttgtgctgctgcaaagtaagtcttggtttcagaagtgatttcttgcttgccaaaattgaagctggaagcaaaatcaatcgacaatgggccttgtgttcctggttgaacaaccttcttcggatcctccgcatcaattggggtggccgttttagttggatcaagcggatcgactggttttgtcactttttctgttggcttaaattcgattgaaccgttcgtgctgtacacaccaccattagtttgggcagcgagtacggtcgtggcattgacggccatggtacccatggctgcagcggctgctaataaaacaaattttttcatcataacactccattttttagttttcatcgtgcatctttgtcaggtgccagcaatctttgttgtcagtgatgacgctatgcgaagctaatgatctttgtcggtttgctgctttggtgctaagttcccccgaatcactgttccacgtggctctttagctttttggtgacggtgttgtgttggttggcgttgattctaacgtccaggtcaattcggtgacatattccttggccatcttcggcgaagttccaggcaccgccaactcaattgacttggccatcgtctgttcatccccgaatcgataaatccaagtgcccatgccctgatctttagcagccgcaagcggtgcgacctcagcactgcctggcacaagcgtgatttccttttgaccagtcggcgcatattgctgatcaattgttgatgtcacatttccattcaagaacttcaactgagcaccggttaattccttagtgtcatcatctttaactgaaaattgtttttcttgcttcactttcaatgtccaaccttcaaacgtcccgcgcttgtcggtcacctgaacaaagtttggacgatccacggtcttgccgtcatcctgtgagaaaacttgcggcttcgcatagtacttagcatcatctgcgctaatcattgcttcgccaaaagtaaaactggaagcatagtccaaggatagtggtccggtggtaccattggttgccgtgccagttgggttggtcggattagtcggcttacctggcttggtgtcgcctggatcaagcggattctttgctggtgtccgggtgacatcggttttaaacatcacctgaccgtctgatacaacttcagtcgttgccccaaccattgagactggcatgctgctgagaccaatcagggttaaccctgccagtgatgccactagataactttttttcattttttaattttcctcttccttgtcttttccatttcgtttgagaatcaaaagcaatgtgataatgagtatcgtcaacaagccggccatgctgcaaagccaagcttgcgttgtaccaagccgtggcatgaagccaaattgatctgcattcgttgtttgcgcatcaggtctgtctttcgcgtcatcagtttgccctgtccctgcttttttagcctgactgtcagtactagcggatgacggtgattcgtaaaagccaacttcagcgcctgaggtatagccatcccctgcttcggctgcatcaacctgtgaaaacgggttgcaggcgaagcccaataagaggacagtcagtaaaatcatttttttcatttcattctgtcctccttaattagccggcacatcttgtagcgaccattctacttttcccgagaaagtgcccagtttttgtttctcaactggaatcgtcaacttaaacccacgggcactgctgtcaatcgtttgattccactcactgctaacatcgcgttgatcgacatcagctgtttcttcaactaagatgctctggtcagacagaacctgttcctgccctgtttgactgatataactcatgttgccagtcacatcgatctcaccatttttgaatggttgaatcactttcatcgatagccgagactgttttttggcaatctttcgactgtcctcaattaacaatttcccacgaatctgcggtcgcacaacctgagtctcaccgctaatgagcaaggtgccaaaatcaaagtcaggcacttccaccagttttaatgcgcccgactgtttgtctttctcatctggcttcggttgatccggcggcttcacatctggagacgttgctttaaatggtgagccattgcgggtaaacctcaaggctgtgctcttttgaatgcgattcgccgccgatttgtctaacttggttggcgtacgttcaactttcttgccattcagttgccaatcggaatcatctgattgggtttctaacaactgattatcggcataaatgtcataaccttttgtctcggcactgaacggggcaaaaatcagattcgcggactttcctgccgttaaaccagtgggacttttagtaccgtgatcaccagacccgaacgataactcgtcggcattgtcaatcttgatcgtgccatctcctgagtggaagaaatcaccgcgaaggttttttaagtccgccttggcgccgggtccaagattgatgcttgatgctttcgtaaatggcgtggctttggttgtttggatcaacagctgcccattcttttggacatctaccactaaatcgtcatggtgatacatgaaagcaccgtcatttttgtccgtcaggtaagcatccagaacggcatcttcaccaattgtgatgcgattgttgtgatgagcgagcccatcggtgtaaaccagagcattactgctcacaactttcagacgagcgcgcttcttcaattccaagttcagcgatccggctgatgcccagaatgtgccgagcaacggattgtccgccatttcaatcgtggtatccgaatcttcttcaaaaaggtaattcgtcgcttcagcaaattcctgaactaacgcgccttttttcatcgtataaaatgtattcttacctttgaaaacgatctggttgcttggcttgcggatatggaatggttgggcgccgcgatcagaatagtaatcaacattttcaacgatgatcttgctgttttcagtgtgattgtcggctggtgcgatcccatagtagttattggctgattcagcgacattacgatcacctattttcaagttcttaaacgtgatgctaatgttactggcgttaaagtagatgccgcgatgccagctttcaccactgttgtacatgtacgtgtacttgtgatcaccatcgatcgtgactgagtttttcacgggaatcgcttcgcggccaatattgatgtcagccgttaatcgcacataaggaatccctttctcaatcgcttcttttaactcggcggttgttttcaccgggcatggatgatcttgatcaaacactggcactgcaccagatcgcaaccgactatcttcaattgatctttttgatctggccgcagttggcggttctggtttggccgccgatactgcgacactagcagatgcagcagcttcttttgaagaacttgccgacgattctttggcttgcgtcggtttttcgacactggcagatgctttggcacttgatgcgctcgcctgtgtcgttttctgctgactggtactaggctgagatgtcttacttgaatcaaggatactttcagcgccagacactaaactgtcagtcgctgaggttgaagactcgcttggcatgagcgatttagcaagttgcgtgctcgcgcttgagacaagcggctgtaacaacatcaacccagacaaaagccaaaaaaaagctgcttcattcgtatcactcccccttctctatgttattgattatataagcgagttctatattctgtcattttttctttttatttgaatcatgaaaaaataaaaaatgatttgtgcaaatcctcacacaatcactttttggccacttctcaaatgaccatcaataaccactaagcgcatcgtgtcttgacagatggtctgatatctcaaaaatgaaatcagcgttttttaataatcgcagcgtcaacggattgttcgccattaggctcaaaacacgcatgttgcgcaatctatggtaagctaacgtcatcaccatcacggaggctataacacatgcaaagttttgagaagtaccatccaatcatgtccgtgcattacaccatggactggttgacgacatttaaaatcaaggatattttccagttgcgcgccgatcggcaaattgccgcagaatcaggccgtgaattcgatcaaagaatcaccgacacggcccgctacatcaatcgttccatgcgcctcgtcatgagtaacaacgccttgttatacgggatcaaggatcgtgctaatggtgattttcttggcagtttctgtatttggaacttcagtgaaaagaaaaccgttgcccaagtacgcttcgaaaccttggccgagcgtcaaggtgaaggcgttatgagtgaagtcctcaaacggatgcttggctttgccttctttgaattaggtctcaaacgggtttatgtcatcttgccagccaccaacgaacgagcagcgaaattgttagccgccaacgtcttcacacaggtcggtgattatcaccacgaccgcactttaccggatggcaccaaagttccactggcgcgctttgaattgtcggctgatgctgttgccgataatgacgcctttcatttttaatcagcgcaccataacgcgctcaccattgcagaaacctacaggtgatgtccttgaagctaattgaccaagcctgggtcatttggcttcaagtcccctatgttccgacttccaaacacgcctgctcgcgctcaaaaaaagatctttgtacagaacgccacacgcgtccgtacaaagatctttttcgttgttttaatgctcatttgctcaacatacttggctgccgactgacacccagtcttggcacgcgcctatcgttagaccattggcgccggaaacaaggtcatcatcacgagcaaataccccgccaacgccggaatcgcaattaaggtacccatcaagcggctaaaaccatgtgaagcaccaagtagtcgcaagccttcaacaatcgcatccatgatgaagaaagccccggcaatggccgcgaacaaagcaccagtcatgacactcaatcgaaacatgaccacactagccacaattgccatgacggctaccaaaatctccatcttcatcaatcgtttgtactccgcaggattatccaaaaaattaaacatcgctggcacgcgctccttttggtctgacaaatcttcaatgtcgagagcataccacgcctgccaggatcattagcctcagagccaagaattttgaaaagaccttaagcactttaacgaaaacgcaacccttgtcttttcacaagagacgtggtaccttttgcttactaaatgtaagtaaaaggagcactgaccatggctaatcaactcactggattgcatcacttgaccgccatcacctcaagttcaccaaggatttttcattttatgagcggtattttgggcctgcatcttatcaagaagactgtcaatcaggacgatgtgcgaacctatcacctgtatttcaccgatgatatgggcactgctgggacagacatcacctttttcgactttccggggattcaaaaagctcagcatggtaataatgagatcgcgcgtaccagcttccgcgttccgtctgatgccgcgctgacctattggaccgatcgctttgatacgtatcgggtgcatcacgatgcgattgacgacttattcggcgcgaagatcctccgcttccatgattttgacggtcaacagtatcaactcatcagtgacgagcataaccatggtgttccagcaggcacgccttggcgccattcaaccgttgacccgcaatttgcgatcggcggccttggcccagagtacatcaccaccgaccactacgacgaactggtcggtgtcatgaccgatctgcttggcttcaagcaaatcgccaaagacggtcaatataccttgcttgaactcaatgacggcggccacggtgcgcaagtcattatcgactatcaacggttgattccagccgcttatcaaggcttcggcggcgttcatcaccttgctttccgcaccgatgatcgcgacagcctccagcattggatcgaaaaaatcggtgctgctggtttaaactcatcaggcttcgttgatcgcttctacttcgcctccgaatacttccgaccaattccagacattctgtttgaaattgcgacagatggtccaggcttcctactagatgaaacctacgaagaagccggtgttcacctcgaattaccaccattcttggaagatcagcgcgaggcaatcgaacggaatttggtgccatttaacacggaaccgcagacggcggggaaggcataattaacgccttctcctctatgacatgacctcgtccatataataaggcaggctcaaaatgagcaggtctatttttaaggctttatatacccatacccagccgcctcagcttgtgccagtttaacaacgccaaccggcaccactggtacgccagccggtaattttgtttcgtccaagtgacgttgctgtagggaattgtggcaggcaaaaaagtgaacctgaggatgcgcagcgatgaaggcggctaccttttggtcaaagaagacggtgatgccatccccattcaccagcacttcgatgtctgcgtctggctccgccgccagatagttgtcaagattggacgccaagtgtggccagcgttcagttgtatctaaatgaaaaattgtttttagtgtcatcttgtctcacctcagcttgaggataccacgagtcgcccatcaaaaagaagctgaaacagattgccgcctgcgcgtttggttacagcgcagtggcagtgtctgtttcagcttcttttaaaagacagccgttagttgtgtgttacagcgatgccagaatcacgaagttcagaatgaacccgattgtgacaattgccaaaactgggtggatttccttaaccttgccggtgatcagcttgatcaggcaatagaaaatgaagcctgccgcgatcccgtatgagatgttgtagacaaagcccatgacgatggatgccatgaaggccggaacggcttgggaaagatcttcccattcgatttccttgaaggtgctcatcatcatgatcccgaccaagatcaaggcaggtgccaaagcttgggtcggtacaatggcgatgaatggcgcaaagactgagctgagcaggaacatgccggcaacgacaaccgaagtcagcccagttcggccaccagcaccgatgccggcagcactttcaacataggtcgtgacgttactggtaccgaagatggagccaacacctgtcgcaattgaatctgcaaacagggcgcgatccattttagacgagaagcctgaaccttgttccagagcacgttcgtcagcatccgagaaaatcccggtgcgccggcctgtgccgatgaaggttcccaatgtgtcgaaaatgtcggagaaactgaaagcaaaaatggtcatgattgacagggcaattttgtctgggctggtaaataacgatcccatccccttagcggaaaaagcggcgccaaaggttgtctgcaatgatgcaaaagtgctgctaaaggaatttgcagcgctcagatgcaagttggtcacgcccattggaatcccaatgatggtcgtcagcagaatcccgatcagaattgcgccgggaacttttttgacgttcagaataaccatgatgatcaaaccaatcagggccagcaaagcgccggcttgggtgaagttaaccagtgccggcacaatgccaccgttggaaacaaccgattcaactccatgtttgagcgtcagtgcgcccgccttcaacggttggccgttgatggtgttaatgctggaagcttcagaagtaaattgtaagaagccggcgttcttgatcccaatgtaagccacgaagaccccgatcccaccgccaatcgcatgctggatggtttctggaatcgcgacaatgattaatttccgaattttggtgacagtgattaaaatgttgatcacgccacaaatgaagaccagcgccaaggcttcttgccaactgaatcccagcgcgaaaacaaccgtataagtgaagaaagcattgagtcccatgcctggtgccaacgcgtacggcacattagcgaaaagacccatgaccagcgttccgactgcactggcaatgatcgttgccaagaaaacggcctgtgccggcatccctgtctgtgataggacttggggattaacgaataaaatatatgacattgcaaaaaatgtggttagacctgccatgacctcggtcattggcgtggtcttattgtctttcaaatgaaaaaagttttccatgacacgctcccctaaactgtgaatatgaaaagtgtacccgagactgacgacagttgcaatagaaaatacgtttatttttcttttttttatgattaatgttcgtgttttccctaatttcaaacacgctcgtcaggcttttcggaaagcggtatgatgagactacaacattcgtttacagaaagaaggtcatttttatgtggctctggatgcatcttgtttcatgggcagttctaatcattgcagcggggatcgctctttttagcaagactcgccagtttatgttatggacgatgatcacccgcgtttgttatcttgtttccattgtgagcggcattgtcttgatgcgctttgcttttgcgcgcaatccgttgttgacggtggttaaaattctaatcgcaattggcctcatcggcttaatcgagatcgccttcgctggcaaaaaggaccatcgcctgagcaaaccgattgtgtgaagcacccttgcagcgttagtattggtgacagtcgctggatttgccttagcccaattccgaccgttcctataaacatagagcgctctcaggcaagtttagaaaaattgggaaccaatctcgtttagaaagaaacggaggtgacaacgtgtcacttatcagcaccttacttgtcggcttgctcggtttattgcatttgacgatcatggccttggaaatgttcggcaaaccagaaagtcaggccgaaaacttcagcatgccgcttgcttttgttaaacaacccaatgctcaaattgcattgaaaaatcaaggcatctataacggtgctctcgctgttgtcatgttgctcagcctagtactgctgcacggcattgatcaattgattaccttgcggctgttaaccggctttgtcaccgtcgtgggtctatacggcggcgcgaccgttagcaagaagatctactttgtgcaagcaattcccggtgcccttacctgcctgaccttattcttttaactgattcgttaagccaatgtgcggcgtgcatcctgaatgcttcacttaatgcgttcttcggtatcatgaaaaccacgatcatgacaaaaggcgttctcacaaacgagaacgccttttgcatgggctaaggttggaacacgagtcgagccgcaccgcgatcttgccagtgatcatgcacctgactgagtgatagaaccgttgttggtgtcacaaattttccagcggttaaggccgtgaataaagcgggcaattcccgttgatagtcagccaatgtcagactgccttggccactgccgaccaacgttaatccggtactgcgcaaagcagcggccggcaaggacaatgttggcccagcggcaccaccaatctcaatccaaatcaacttggcagcatgatcacgccgcgcttttagcagtgtcatcatcacggttgcactgggtgcgccccatagaaaatcaagcacaatgtcggctggcggtaaagccgccaaggcagcagtgtcaccaagctgcactgtcgtatcagcaccaagatcgcttaaggccgccaacttgtcaggatttcgaccaacccccgccacatgtgcagcgcccattgttttagcaatttgaacagcggcagttccggccgcccccgttgcacccagaacaagaacccgcttgccaacaacctgcccagctttgacgcgcaaggccatccagcctgccattgccggattcacactcgcggcaatttgcgcaggatcagcatcttccggcagtggaaacattagctgttgctgcgtcactgtttgctcagctaaagcgccgaattttggatcacgtgttagaaaataaaccagttgcccatcactggtgcgaccaacgccatcgagtccaagaataaatgggagctcaggggttttggtataatgggacccatccgcctgcgagcgaacgcgttgattgacactgctagccaaaactgtgatcaatacctgcttaggcgctggcttcggtgctggaaaatccccataaatgggggcttggtctaaatgagttacaattgctgctttcaaaggaccacctagtttcttgaaatttaattacatgtaatatattctagagtgtaactccaagatcttctgttgtcaaaatatattacttgtaatttaaaaaggagatacctatggcttctgatttcacccaattacaacaagccattcgcttgctcaatgcccatactcgagctgctgatgagcaagcgtggcaagtgctttttgatcgttggctggcaactttaccctctgaaactcgccggcaaatgcaaacagttcggtttaatcatgcccaattgacgttactcacaacgctggatcaaagcagttgcaaacaactgcgcaatcaggatttaaccgctgctgttccgttctcacaaggcctagtctcacgctatgttgctcgccttgttcaattaaacttgctgacaaaattatccttgcccgacaatcgcaaggcctacattgttgcactaactccgcttggtcaacaagtcgctgccttacatcagcaaatgcatcatcacacaaatgctcaacttgccgctgtgcttgatacccttgatccccaagacgttcaaaccaccattcaggtactcacaaaactgactgatcagcctttacagccccagtcataatctcactcacgatatgctcgtcataacgccctcgccagcgctgaaacctgcgtgtaaggaccttgggcgcaatgaccaaagaacggtcatcacgcccaaggccacttacacttcggttccacccgcgctggctcgcgctcacttcaaaggaggcatttacgatggttctcatttcgatcctgctcgatcttatcgctcttggcggctactttcttgtcactgccagtgcaacgcagcctatcttctggttgctcacgattgttgaaggcgtcattgtcgttatcttggtaggctttttcttctcttaccgtggcaaacgccgttctcgcttttatgatcctgacatcggtgccagaccgtacaccgttcgcttttcaatcattgccgtctccttgttcgtcaacggagcggccttgttcgtttatatcatggcaattcgtggcaattcgattttttaagcaatcaatcccaatattaaaaaacgtgctctgccattaacgtattcgtcaataggcagggcacgttttgctattcagttgactactttgctggaccagtaacttccgtgctggtttcgcctttggtcaagaaatcaacgagatgttgtagtgagaagtaaaccatattatgcacagccgtctcggtgtagtaggcaatgtgcgggctgagaacaacatttggcatccccaacagctcatcccacaacggatccttgaagctgccgtgcttggcgagattcaacaagtcctcggtttcgtattcataggtgtcaatcccgacaccggccaacttgccagacttaagattgctgagcatggcttgcgtgtcaatcagatttggccgagccgtgttgatcacaatcgcacccggtttcatcaaattaaatgccgcttcattgataatgtgggtattttgttcaatcccaggaacatgaagatcaatgatatcactttgcttaaagaggtcttcaaggctgacatagtcaaaatctgggtgatcgcccttcattggataaggatcgtaagcaatcactttggcgccaaaacctttgaacagtttgatagcaacctgcccaatatgaccggtgcccatcacgccaacggtttgctgaccgagttccttaccgatgaaggtgcccgctttttcataatcgcccgcctgtagttgcgcctgtactttacccatattacgtagcaagtacaaagtatcggtcaaagcaaattcagcaatcgctgctggtgaataagccggtacattgctcaaacgaatgccgtattgcttcatggcagtcatatcaatgttatccgtacccacattccgaatcgtcaggaacttgataccatacgcgtgcattttttcaaaaacgccggctgcatatggcgttatttgcaatgaattgatgccatcaaaccctttagcccattcaacggtgttttcatcgagaaattctgtatggtattcaagtgtgttgcctgtatccttggcccattgcttgaaatattgaatctcgtcaacgcgtgcaccgtaagcaataatcttcatgtgttaaacttcctttccaatttgtccactcaccagtatacaagatgcctcggtgaaaaagcatctttaaaaaatgggccgctgcccttgttcaagtgccaacaagtcgcgcttcattggcaaaccgccacgaaagccacccaaaccaccatctttgcgcaggacgcgatgacaaggcacagcgatcataacgggattctttccgaccgcagagccgactgcttggaaggcgtgcgaatgaccgactgcggctgccacctgtgcgtacgttcgggtctctccataaggaatcgtctgcagatactgccaaacggcttcttgcagcggtgtcccatggtaagtcaccggtactgtgatggtttgcgccttgccagtaagataatcatcaatggcgttttgaaacggcaacatctcttcttgattaaattcaagtgaaccgctgacataatcagccgcctcgctaagcggcgcatccggtgacccgacgaaggccagtttcccttgatcggccacgataaaataggcgtgattgggcattgctaaccgtgtgtattgcattctttgactccttatctgcgctgtttatagaaagcgcgttcacaaccatggcagagggtttaaaagccttcttaatattacaccattttttagcatctttatcgccgatgagcccggattgtgctaaactgaggtttctatcaaactcggataatacgcggaggtactatcacatgaaaattgtcgttttagcaggcggccggagcacggagcgcaatgtgtccatttctagcggctaccggatcacgaacgccttgcggcaaaaagggcagcaggccacctttattgacctgtttcttggctacgacctcgaagggaagacggtcgaacaggtttttgatgacgccaacaccagcaaggatctgaatatttcagatgcgattctgactgatgaagacatcaataagttacggccagatggcagcacccagctatttggtcccaatgttatggcgatctgcaaagcagcggacattgttttcctcgctttgcatggtggcgatggcgaaaacggtaaggttcaggctgtgtttgacatcaacggggtcaagtatactggctctggcccgctggcttcaggcatcaccatgaacaaggttttcagtaaggaagtcatgttgtatcatggcattcagacttcaggattcaaggaattcaagcgcgatcaagggccaaaacaaacggtcccgtttgattttccagttgttgtcaagccaacatccggcggttccagcgttgggacacatatcattcataatcaggaagaactcgaaagtggtcttgaagatgttttccgcttcgacaacagtgccattgttgaagagttcaccccaggtcgcgaattctcgttaggcgttgtcaatggccacgcttactcggccatcgaaatcaaggtgcgttctggttggtatgatttcaagcataaattccaagccggctacaccgacttcatcaccccgccaaaggatctcgatgaagatgtccatcaggctatgaaagatgttgccgtccaaacgatggatgttctgggcctgcaaaattacggccgaattgacttcttcgccaacgaaaaaggtgtttgggtcattgaagccaacaacctgccggggatgacaccactgtcactgttgccgcaagaagccgaagcagacggtgttgactacggcgatttggtgatggatattgtcaacggcaagctcaagctctacgctgacggcatgaccgaggctggactcttaacgaagtaagccacatcggccaaaatatatcttcattttgctcaaagtaaccataaaaagtcgctatctgaaatcaacgtgatgccgttgacgattcagatagcgactttttctttgagtacgagcagatttctgcaactgggagcgcgtatcgcctacagttcacaaccaccgtggcgactgcggaaactcaattgtatccccgactttgacaggtgccgtgacgagcaacccgagacacgggacttcgtcagtatggtgcgggtgttgccgcttctcaatcgcacagactttacctgttgtcgtgccattaaggcggatcggatcgcccggctgaatgcgttcaaccggaggcgcaatcgtgatcactgtgccgcgcccagtaatcgtggcagtcgcttggatggtatacatatcgctttccccctgatactgtgtcttgttaaaaatcgcacagtttaattaaccaacacttcctgataggtcttctattcgatcgtaacaggttgccagcaggaaaaacaagcaaccggtttacggttagaacgacgatggtgtcatctttttgcccgcttgcgtttcctgcatgttcaatagataattaatgcattgtatgagaaagcagggagatctttatgataaagccgcaagcattacagccacatgatcaagttgccattgtcagcctcagcgccggaacactaggtgaaagctttgcagcccatcagcttcaacttgggactgagcgattgaaagccatgaagctggaaccgcgctttatgccaaacgccttacgcggccaagcctatctcaaagcccatccagaagcacgcgcagcagatttaaaagccgctttccttgacccgagcatcaaaggtatcatctgtgccatcggcggcgatgatacttaccgaatcatcccttacctgctagatgatccggctttcacgcaagcagtcgctgatcatcccaaactgttcactggtttttccgacacgaccattgaccatctcatgttttatcaattaggcatgactagcttttatgggcctaattttttaaatgatctagctgaattagacacgcgcatgttgccatacaccgccgccagttttcagcattatttcaaaaatccggcgacaacggcgattagttccagcccgacttggtacgacgaacgcacggacttttcagaaagtcagttaggggtaccgcgaaaatcacacaaagaacagcatggctacctcgcgctgcggggtcaaggccgtgtcactggcaccttacttggtggctgtctcgatagtctccacgacttaatctacccggttcgctatcaggacgaaccagaagtggccaaaaagtaccagctcttcccgcaagactggaccaacaagatccttttcattgaaacatcagaagacaaaataacccccgcagcttaccgcacctatttagaacatcttgatgaacatggcgttcttgcacaagtgaaggcaattctcgttggcaagccccaaaatgaaacttactttgacgcttaccagcaggtgctgcttgatatcacccaaccatacaagacgccgattctgtacaacctgaattttggccacgcctatccgcgaaccgtcctgccatacggcctgcaaacgacggtcgatttcgatcagcgtcaagttacggtagatgaaccttattttgctgataagttgtaaacttcgtatcgaccacttaaatgttgcgtacaggtaccgtaaatcccgaccttttctgtaaactatgtgctattttcaaagagcgagagcaggagcgcttagaaattgaagtgtcagtggccttgaagtgaaagaaacgtctcttttggttcctttgcttcaaggtccttacacggaagtttctgcgactgcgaacgcgtctaaggagggaaaggctatggaccaaacgcaaaaattgaatgctccgattcgcaaacatattttcttgatcgttgctggtgtactgcttttattgttagctgccgctgctggttttgactggcaaatctcgcaaaccattggtgatatgaacgacccattcgccactttgttccaagacgttgggctgtggaccgcaccgttgatcatcatgctcagttgcaacattgtttgtcattatgctattcgttcacaacagctggcgtggtatacccgcaccttaatggtgatcggtagtgtcatctacgctggttgggaactttgggccggctacctcaagtatgccatgaccatggtgatcacctcgctgaatgatatcaacgctggcaagccaatgggcatggctaactctgacggcagcaagctaacactgccgggtgccaccagtatcattttgttcctcatcctctacctcgtcgtgttcatcggcagccagtactggctcgcccacaaaaccgatgaacagcttcattacttattgaaaatggccgttgttgccaccttgatctgcctgctatctgaccaaatcgtcaatgccatgaaaactttctggggccgcttccgtccttatgaattaaacggcaatccgacccacttcacaagctggttccagccaaacggcgccaatggtcacatgagcttcccatctggtcatacccaaaccgccgcgaccttgctaactttgacatggttcgtcgatcgtgacaagccaaaacgccagcggctggtcttctggctcaccttcgcttacggcgccgtcatggcctacacccgcgtgcgcatcctcgcccatttcaccggtgatgtcaccatgagtctgatactcacatggtcgctcattctgatcctagccgcggttgtacaacaaccattagtcgattgggaagccctaaccgcccgctcgtcagcgaagaacttaaacacagaaccgatctcctgaaacgcaacttaccaacaccgcttatatcaaaatgctaatttatttcgccacagccgcttgtgaagataggctgtggttttttgttgtggtatatgagtaacagtccgttcccaagctgtttattggaacccgcggctttcattttgttaaaactatatcaacaaagttaaaggtggagggcggttggtcgtgacattgaatccaattttgttgctagatgaggacgatcaggaatttgtcagacaattcgttttatcttccggttcactcaagaagctttctgaaaagtactcggtctcttacccaaccatccggctacgtttggatcgcgtcattcgcaagctaaaagcggccgaattggatcagaaaaacaagtttcaggttagcatcatgcagatgatcattgacgacaaattcgatttagccttggcccaagaaatcattcaaaaatacaaggagactaccaatgattgaaacactgatcatcgtcatcgtcatttctcttcaaactttttttggctacatcgaaagtaaactgctcggtgcaattttgccaatcgcggttattgtggccgacatctactttttagcaaacggtttgctttcactctcttttagagatattgctatgcccatcattggtcttttgactttgattagcctgtgggaaggcggacggcaatcaaaattaagtaagcaaaagcgggagatgcagaaaatgaaggctcaggatagtaagcgtcaggattaatgcgcttgtgtttgccttgatacatttatctatgcttctgaaaaccttcttagcagccaagaaggttgttcttgtccgtcagatccgcctttcaccaccaacatttgtaccaaatgaagacaaaaaatggcgagccgcttcgaccttctgaacgcttacgcgccgatcgttacgaactcaccgtggtttggcaccgtcatggagtatagcacggaagcttgaggtatgacaagcaaagaaattgaaactgttatcattgtctttgccgcctcttattcgccacataccccgcagctatcgcgatgacgatacaaatgataagtacaattttcatggcattctatcccctctggttagtataccagaacaaatttctttgatccttacttggcgatctgtctgtgcttagcctgatctttctactgtaagcatcgttctcatcacggttcaaggtgttggtcttcaaatgctgctgataaacaaacatcaagattttttgtgaagtccacgttcacgctagggtaagagtttttatgtttttgaagtcttcatgtctctttctttcacttctcgtcaaaaagtatactagaatgaggatgtttagccgcagagcctaataaaggcgttttctaacatagacgactgtcgctgatgatgaatcattttttagcatctgtaagagcaatttttaccaaccatgaaaaattttttaggaggaatttgatgaataacgatgttaacgccacgtggcctaagttaccagtagcactaaagaagattgcaattgatcccacttctgatgactatgaacttatgtgttcaaactattttgtcaccggtcgtccaaagctaatcttaagggcaacgacagagcgtgatgtcattgctagcattcaatacgtcaaaaaaattagagaaaatgttagccacagtattccgttttcatttcgtagcggcggtcatggcatttcaatggcttcggtgaatgatggcggtatcattttagatatttcacagttaaatagcgttactgtcactgacgcggaacagggattggttcaggttcaagcaggcgcagtctggggagatgttgccgaggctttacgtccgtttaatttaatcatctcaagtggtgattttggtgatacaggtgttggtggactcgccacaggcggtggcattggcttactcgttcgtcgtctagggttgacaatcgatcatattgtcagcgctagactagtaaccgctgatggtgagatccgtgtgactgatcatcaaaagtatcctgatcttttttggggtattcgaggtggaaattcacagttaggaatggttacagcattcacttttaaagcaagtaagttggttgaagagaaatccgatatttcgctaccatttactgtacaaaccattgaatcccaaacgagcaatttgacaaagttcattcagcaatggcaaagttggataactcacgcatctagtaaaatgagcagcaatctcatgttgactgccgagaatagaaatactgttcacattaatgctagtaatttttgggcaggttctataaattctgatgcgaaagccttgtttaaatcagctctaagcctttctgaagtgaataaacatcaattagagacaaaaagctatgctgaattggtcaaggctcctcatatcccgcattctggacaacaacctgttttcgtaaaaaatattttactggatgccatgaatcctaatattggcgatattatcagcaaaatacttgtttctccaggaatcattggtattgaaatgagagcaattgacggcccgctaaataccattaatgctgatgaaactgcatggcatgatcgaaaagctaaagtattcttagctatgtggttgcaaaaggatacagcacctcatgctaaggagctttttggcccactacaagatttagggacgggtgtctatagttcctactcaagtgatctatcgatagaggaaagtcaacgtatttggccggaagaaacaggtcgcaaactgagaaaactgataacaaagtatgatccacaacatctgtttaaccaaggacactattggtaatacgtggccaatctcgatgccactgaacgttatttctgtggtaaaatcaccgcttagctgccaagttgcatagacaatacccctcaatagtattttcagtcgttacccatgactttaaagagtcttaggcaatctgtttcgaattcactaaggcggttaacagggaatccatactcactgatctttaacatcaagcggcttaattgagaaataattccagatgcttttacgtattaacttaaatcgtgttgcgcattttgggcgcgaattagtgtatttaagatgctatatccttgactcaaggatattgtacttcgaagattattcgcaataaattcgttcttgaaggggtattcagtctgactaatcaattgtattgcagcttgttgattgaaaatggttcttttatattcaattctgttatcgtccagccacaaccattgcgcgccaaattggtttgagaatggcatgcctatgctgcctgcgttgataatctttttattaggcaaggacaattcaaactgtatatgagtatgtccacaaataatatacgattcttgaactcctttaaataaagtctctatgtaggctttattttgttgtggagaaaaaacagtggtgttatcatttttcacagcatgacaaaagaaataatttccaatactaatgctgggaagtaagtttcttaggaaagacacttgcttatagctcagttgatttgctatccaagtcaattgctcagttgcctttctagatagtccaactcttttttttgcataaatatcaacgatatcttgatcgttgtttcccataattcccacagttttgaatgtggtggaaacgtgctttaataacgacaacgtttccaaaggcataggtcccgcgatcagatcacctcccaaaacaactaagtctggagacagtttctttacctgttttaaaacctctttcaaagcaggataatttccgtgaatatcatataatgctgctattttcattaatatgattccctttcctaacaaagattaaaagcagggtctcgtattcctaactttaaaaatccgggtgcgatactaacaacagctatcaacaggatcaatagtcagtcattggttcgatagcttaagttatcattctaaaatataagcgcaattgatttaaaactgatgatcacttgcgactagtatttgaaaaatcaacttcgtttggtcaaacatactcttaatatctggttcagttgttggagatgccatctggcaaagtgcaagcggcatgccaatgaatgaaattgttggccatccgtcttggtacaagggttggccctctccaaaataggcattttttcgtggcttcaggatttgatatcttccactagcattggtaccacttaaacttttcaaaaccaaatccctgttttctttagtcgaagcatatacatacaaaggatcatataatccagtcgcaattagcttgttttccttttggctatcaacataatcaagaccccctaagtgttcaacggttaggcctaaagccttcttcatttcaagatgctgactagtttcatacatgcttaaatcacgcagaaatcgcgaagtggcttgccttccttcaattccgctttgtggaatttgaaaatgaccactcacaaatccaaacacaagtgtatttttaaatttaaggttgtcatgtttaatggcatgtaagacagtgagcaatgcaattgccccattttcttctatatcgtttggcccatacgtatgtgtatttataaggatttgtttgctccgattttcccccggaacaagaacagcaaatgatttcgttgttacatttgtctcatattgtcccgttagtgttagtcttactggttcctttctatcacgacatcgcttcaaggcttccagctgggtttgatatacccaaacagaaggaatccccagataactattagtaaaaggtagaacttcgcggttagcgagatcctcactgatgtgttcccaaaccagaataacgccgactgcaccattatctttggcggcttgaattttacctaaggtcaatgtggctgcaactaatgggtgtcttatgctaaatccaatgtgagtatgccgagggtacttggcaacctgatgcattaataaaagcttaggaatcgtaaagtttttcactttaataacgaccactttacccttcatcttcacatcgtgttttgattgaaagaatctaatttctcctttcacacccatttctttggtgattccagaatatggaactggtcctaaatttggtatcttttcttttgttgaatcattctcaagagaacagctactttgaagacatctattaattttaaaaggaaattcgatagtgttaaaaccaagattcttaatttcgtcttgcaataactcaataaatttggcgtggctgtcagtagctgttagccgcggaccgatagcctttaacttattttgccagaaagccataacattcatatcaagtgtcatttgaccgtctccttattcatctaactaaattcaaagtcttttttaaacaaccagtgaaacacttattatgtaattaatgatattcatcaattatatcaacgacaatagggtaaacccttacgtaaaggttgcaattcttaaaaccataggacaccaatgttttataccggaagctaaaagaacgaatgtgggttcgtttgcccgacttcttccagcactatttcccgggtaatgacccagtctcgaataacgcgccttcttatccagcccgctaccttgccaccgccatccatctttgccacaataagcccaagcgaggtgagtagcatgaatttttcaaagcagcttcatcagatccgcatggcacaccagatgacgcaggctaacttagcggaacagcttcacgtttcccgccacaccgtctccaattgggaaaatgaccgcaatttgccagatctagaaatggtgacgcgtattgcccggatatttgaggtctctcttgatacgttgattcttgacgatccaaaactaaacgaaaaactgatccaagatagcaaaataagtcgtcatcaaatgatcatggcggtcatgacgacggctgttgccatgatgtcagggatggcagccacaaccttatttggattctttccacaatggctcgcacagctgatttggtggccttatgtggcggttctgtttctttttagttatatgctcagtccaaaatcggtggacatttttgctgactggtcgattttgagtcgacggttgattgctggtggtttttctgtgctcggtttgatctttttactgacaggtatcgtccttatcacggttcaagatgttgatcttcaagtgctgttgataacgctcagtggcttcgttacgatcctcatgactaaaccagtatggccacgtcatcaacatgctcgctaaatcctcgcaaaagatcacccacgatagaccctctccgtagctctgctgtttgccattgttttgcggtaaatatctctgcgatcatggcgcacctccaacctgtcaccacaggaacatgcttcattcagacacaacttttgatttgaattgtacacgcgccctaccagaataaaaaccgtctagctcaaaatacgatgggttaaagtttaatattcgaggaaggttcatgatacaaagccacgaaaaaagaatcgcccacgaaggacgattcttttttcgttacgcgatatcccaacctgagcatttgctaaggcttacttgtctcgccgattagccacttgattcaggctaaacgtgatatgtttcttccggtgaataatttcttcctgacgaccgtgaaccattggccgcttgttcgggttaccgaggtagccacaaagacgcttgacgacatcgcaagtggctggatcatggttaccgcattctgggcattgatagcctttggccgttgcggtgaactcacctttgaacccgcacttgaagcattgatcgattggcgtgttggtgccgagatagccgatcttgtcatacgcatagtcccaaacggcttccagtgcctttgggttctgcttcaggttcgggtattcacaataatggatgaagccaccggcactgtattgcggataatccttttcaaaatcaagtttctcaaatggagttggtgatttgcgcacatcgtagtggaaactgttggtatagtattccttgtccgtaatgtccttcacgataccgaatttcttcgtatctgctcggcagaaggtatcggttagcgattcgcttggcgtgccataaaccgagaagtggtagccatattgtttttcccaagccttgcagtgatcgtccagagccttcacgattgaaactgagaatgccttggcatcgggattcttttcccatgcagagccgtagaaaacagtaccgacttcatataaaccaatatagcctagtgaaaccgttgcccgcccatttttgaaaagatcgtcaatgctgtcggtgtcagccagcttgtgaccaaaggccccatacttgtagaggatcggtgcgctttctggcgttgcttgtttggtgcgttcaaccttatagagcaggccttccttacagatgcgcatccgttcttcaaaaatcttccagaatttcgccttgtcgccattggcttccattgcaatccgcggcaagttgacggtgataacaccaagattcatccgcccagcgttcacttctttgcctgtcttgggatcagtccaaccctgcaggaagctacggcagcccattggtgctttgaaggaaccggtcaatcgtttgatggtgtcataggaaacgacatcaggatacatccgtttggtggcacattcgatcgccaattgtttgatatcatagtttggatcttctggtttcaggttcaaaccgcgtttcaaagtaaagaccaatttcgggaagatggctgtccgccgttctttacccagacctagaattcggattttcaggatgtctttttggatctcgcgttcaatccaactggtccccaaaccgaagccgactgtgacaaatggcgtctggccttgggtggaataaagggtgttcacctgatactccaaagtttgcaaggcatcataaatatccttcttagtctgcttcacagccagtgcttccagcttagccggatcatcaatcacactgccgaattcacgcaaatgtttttgatagtttttctcggcgaatggcgccaagacctgatctgttcgatcgctggagcagccgccgtattgactggaagccacattagcgatgatctgggtcatttgcgtcacagcaacttgaatcgaatgggccggttcaacttcggcattgccaatgctgaagccatggttcaacatgtagtcaaaatcaatcagacaacagttggtttcggccataaacggggtgtagtcaagatcatgccaatgaatatcgccacgtaaatgcgcgttggcaacagcaggcggcagcattttcaggccgattgccttggccactgcccctgcagttagatcccgctgggttgaaaagacccggctgtccttattggcattttcgttaacaacgctttcgtcgcgattcactaagcgcgagacgttataattaacatcttgcttctgtttgcgggctaaatcacgcttcaagcgatactcagtatacgcttcagcccagttatacttttctgcagcgatcaaggtctgctcaaccactgtttggatctccgcgatttccacatcatcgtggtagcgatcgcgaatcttagccgtgaccgtatccgtcaagtgatcgatcgtcagcacgtcactcggtgccagttttgccacactttctgccgccttcgtgattgcagtgctgatcttggatgcatcaaaatcaacaatgcgcccgtctcgtttcttgatttgtgtataaaattcgatcatggctaatcccccattacgttaacttgaagtgcttgtaacaatgtatctagtatacaagactcagcaggaaaagtaacgggttatccactaaattttgtggttaattatcgactgcatacactatatagtgtgttttgcattatttggttgttcacgattcatcttgacgataacgacggtaagcccgagtgttataacgtttgcgcatgtgaacccgacttctgctttttcaaaaatcgtttgatcatagcccaaaaataaccgatatttttgttgaagtttgagtttaatcaacaaaaattcggctaattttttaaagcttttttcgatccagcagcttgatcgccgcgaaaaataaaacaacggcggcaacgacagcaatgaccatggccggcatcaatttcgttagcgcatcactgttgacaaggattttcatattgtcgccaatgagggcaaccggattagcatgttgccaacttttgaccatttgtgccaaatacaacagtgccatcaccacaatcgtcagcagcaaaccgccataattattcgttgctagtgtggagccaaacacgatcaggctgaggaagaataagccaaagactaataatggtaagaacgcgagtaccacatgcgggctgcgcgtatcaggaaagtagtacgcggtgtaagcccacgttaccaaaaaggcgaggctggtgatccagatccagagcaacatcccgacaatcgctttgccaacaatgaccgtccagcgcggcaagcctttggtgaccaagttaacgagtgtgccttgttgaatctcctgactgacacaaccgccaagcatgagggcaaacacgtaaatgcccatctgggtgatgttcttgtaatattgggtccatgcatccagcgaagtcggcttagggaccgccaccttaatgccgccaagaccaccctttaacagttccggcatgagtttggcgatcagcggactcaaaatgccgaaaatgaggaaaacaaccgtcaaaatcaacaagcggtgagtccgccagctttcaagcagttcttttttggtgaaaataaccgctgcgttcatcgcgtcacctccatgaagatctgttccaaattggcttctcgctgggcaagcgtgatcggaatgagtttggcttcaagcaacatggtgaggacgcgatcagcagcggcagcataggtaccggtgtatgctgcttgaagactgtttttttgttgctcaaggtgcgtcagctggccctgctgcaaggttgccaacaaatgcgcggcttgttgcgcttgggcagttgtcgcaaacgacaaggcaatctggtttttagcatactgttgcttcagatcgtccaatggcgcactcacttgtagacggccatgatgtagaatcccgacatggtcgcaaatccgctccacatcactcagaatatgcgttgaaaacagaatcgtagtctgaccacgcagactagccaataactgtaaaaaatccgtgcgaccctgtggatcaagcgcgctggtcggttcatcacaaatcaagagtttcggggtgttgagtaaggcctgcgcaatccccaagcgttggcgcatcccccgcgaaaagccactgatacggtgcttggcatctgccaagccgacttggatcaacatggcagccacccgcgactgcaattcagcgccgcgcaaacctgtcagctgaccgcataatttcaagtattctggtgccgtcatgtacccataaaaagccggcacatcaggcagataccctgtctgccgattcgtctccgtttcaccgaaatgcacaggctgaccagcgacttcaatggctccggcgctggcttgatccaagcctagaatcaatttcatagtcgtggttttcccggcaccattttcgccaacaaagccataaatcgacccagccggcacagtcagattcagatcttgcagcacttgcttgctaccaaaatgcttgctgacatgttgcaaagttaggatgttcaattttcatcctcccgtccaaagacaaagtacacaatcggaccaatgatctgaatgaaaatcacgagcaacagccacaataggcgattgccgaaccgataatgctgatggcgcaggatatgaatcactgcggcgatcatcaagccaaactctaaaatgatcagtggcactaaaaatggccagtagtctgcaaatagttgccaattggtattcattttctttcctccaaggtttgctttgatttaaattattgagattctgaatgcccgtatatacgagttctagcgatgcccgctcacttgctttaactcagccaacaacggttgcactactggcagtgttctgatcttagccaatgccgggttttgcaagacgaaatcagccagaacctgtttggcttgaccgctaacccgcggtgattggctacctaggtccagttgttctagccatggctcaatggcatcaaagtaagcatcgccatgcagcgtcaatggcattttggttgccgtcaaaacatgcgtgaactcctgcaaaagggccacggcttcatccgttttatcctgttgcgcaaagccattcaaggcagctagttggaaattgagccagactgccggattgagtgttgctagatcaaaagccttggcaatcgcttgcccacgttgatacgtcgcagccaatcggttaggatcatcctttagcaaggtcatgtaattagtcagttgactcatgatgatgctcaagtcctgcatcaagccgctttgactggttgcaatggcacgccgcaagtcgcctttttgctgaaaagcaccggcgattaaactgtctgcaggcagttgttctggcacatattcgcccagcaacgctaacacatcatcgggtcgttggagcaacagcagactatagccttccagttcgaccgccttggccgttaactgcgccttttggctattttgccgcacacggacaaacaataggcgggcttcattcacatattcggtaactttcgcggtttgtgatgttcccggtaaaagatcgtaatgattcaaaatcagcagccccatttgcagcaaaaatggatagcaggcgtaataccgccgaatcaagttgcgaattgatttcagtaccgcgtctcccggttgagtttcaaaggcctgcttcattgacgtatagatgcgacgaatttccgtgctgctcagttgcgcatcataagccatcaacttgtcgatgctaacgtcaaaataagcggccagaatcggcaacaacgtaatatccggatagctttgccctgtctcccattttgaaaccgaggctttggaaacaccgacaaaatctgccaaagcttgctgggtgatgcctttttgcttgcgattagcactgatcacagcaccgacattaatttccatcctgttccctcttttcacttatcattgtagcggctcaatatgggtaagtatatcgagtggttgttaacttagccattgttaaatcaaccattgggatactcatgatttattctcggcaaaagatgcaaagatgttgagacatcattcacatccattgaaaaagaccaacaatttttgccccagaattgttggcccttctatgtataattcattgagatttaaaggttccagtgccaaggcggagcaatcgtaggccagatggggctcagccgtgcaaacaacacagcgaccgggatttgtcgctgatgttgttaggcgacttcgagaccgcgggctttgcgggctcgaagcgccgtcacagcgttccagccccagctggccggagattgcggagtttggcacggctcaggactctttctacaaaactaatcgaaccttattttgaatatttctccgattccccacccgaaagttgccccacaaatcttgccaccaatggattgtgcaacgcctcaggctgccaaacgagcgtcatgtgcgtcacccatggctcataatcaatcacggcaaggtgactttgctgactcgccaaagcggccatggtcgccggtaccaacgccacccccatccccatctgggcccaatgcaacgccgtgcgcgcgtcatcacacaacacagcaattatcggtgtgatgccatactcggcgaaagtggttttgaatagcgaactaaaccggcgatacacaatcagcggctgctgcttgaggtcgggaatggttagcgtggctggcaagggctgcgacgcggcagcaacggcgatcatgtggtcactgcttaggcgacatgaagctagaccgtcatcattaaatggcgttcggacgatggccaaatccagaatgttgcggcgtaacttgtcgaggatgccataagtgttgtcctcataaagcgcaaactcgacttgcggatagcggcgattaaaggcctgcaatttttgcttcggcaggacatcaccggccgaagaagtcagtcccagcgccagtgtgccaatctcaccttcaccgctacgccgcgctgcgttctcagctgccgcaaccgtctcaacgatctgttgtgcgtatgtcataaactgttggccgctaccagtgagtcggacaccgcgcgacccacgttcaaacaggcgtacacccagttcatcttcaagtgctttcaattgataactcaacggcggctgcgccatgtgcaattgtttcgccgccgcagtcatctggcccgcctctgctaccgctaaaaaataggtaatttgcttgagattcatcgcgattgatcccttcatttttaatcgtcagcttcgcaatccttcagctccactatacacaaattgtatggatagtacctcgaatatgtattttttatattgctcaccacgcgttacacttgagtcacaagcgtgtgatgaagcagctgataagttggtcagtcatgtcgacgacgtccaggaactgtttcgcaccaactaaaaattttgtcgttaatgttttgattcaggatgggatgattgaatgcttgcagatactcgcagttatcaagataaaagtcaggcagcagtgttaaagcaactcaacacgacaacggatggtctcacgagtaatgaagctaaaaagcgactagctcagtatggtccgaatgcgattcctgagcaaaagcgcaataacttgcttgatttcttaaagcgctattggggtccaatgccgtggttgttggaattggcgattgtactgaccttgattttaggccatgacactgaaagcatcatcatcttcgtattgctgacgattaatgcggtgattggctttgtccagtcgaacaattcgcaaaaagcggttgcccttttaaaaaagaagctggagattatggccactgttcgccgcgatcaggcttggcaagcactcgccgctagccaagttgtgcctggcgatatcgtgcaactgaaaattggcgccattgtcccagctgatcttgcgattatcgctggcaatgtcaccgtcgatcagtccgccctgaccggcgaatcgctgccagctactgctagcgctggcgacctgctttactctggcagcattgtcaaaagcggcgaagttcaggccgtcgtcttaaacaccggcacaacgacttacttcggtcaaacggtgacgttggtgaaaaccgccaagccaaagtcaaaacaagaagaactgatgctcgccattgtccgttatatgctctatcttggcattgccgcatcggtcattgtcgccatttacggcctttacctgcatgaaagtccggtttttattctgtccttcgtgctcattttcctgattggctccgtgccagtcgccttgcctgctgtcctaaccattgttcaggctgtcggggcaatggcactttccaaaaaaggcatcatcgtcagtcgcttgacgagcttggaagacgctgcttcaatcgatattttctgttttgataaaaccggcaccatcacccaaaacaaattgtcgatcattgcttgccaaccgctcaccggctatactgccgagcaactgttggatgctgcagggttagcggcagatcaagaacatccggatgcgattgaccaggcggtgctcaactatgccgccgaaatcaagcatcccctcgatttctctaaacggaagcagttcgcgccgttcgattttgccaccaagcgcaccgaggcggtcatcacgacctctgatcaccggcaaatgcgggtcatcaaaggtgctgttccgacgattctggcgttatacgccaagcagcatcctgctgacactgcgcctgccagcgctgctattcaacaactagcaactgccaacgccaaaaaaggttatcgttccctagctgtcgcaagcgtcgtcgattcgcaaatggcgttagtcggcgttttggcaatcgccgatccgccgcgagcggattcagcatccatgcttgcacggctaaaaaacttaggcatcaagccgatgatgatcaccggtgacagtgtgccgattgcccgtgatgttgccgaacaagttggcatcggcaccaaaattctaccagccaaagctttgaaaaccggcaccgcagccgataaaattcaattgattcatgaaagtgacgggtttgccaatgtttttccacatgacaagtatcaaatcgttaagttgttacaagaagatggtcatctcgttggcatgactggtgacggggtaaacgatgcccctgcgctgaaacaggcagagttagggaccgccgtcagcagcgccagcgatgttgccaaggcttcagccagcatcattttgacgcacccgggtttgcatgacatcatcgctgccatcaccaccagccgccaaacttaccagcgtatgctgacttgggtcatcaacaaaatcaccaaagtcattgagatcattatcttgtttacacttggcttcttctggttaaaagtcagcctagtgtcgctgctgggaatgtcactgctcgtgttcgccaatgacttcgcgaccatgtccatcgctactgataatgtccagtcaactgctggtcctaatcaatggcgactcggcccgttaaccgcggcttccggggttttgggcttgtggtttgccttagtcgacctcatgatcgtttggttagggctaaatcagttccacctcagcttgccagtcttgcaaaccgctgttttaattggtttggtcttcaactcccagttccgtctgctgatcgtccgggaacggagccacttttggacatcttggccaagccgcaccctactagctgtcaatcttttcacaattatcatctttgcgctgttagccttgaccggctggctcatgccggccatcagctcaccgcttttagtcaccattctgctactgacactggcagccacaatcgtgcttgatttcctgaaagttgctgtctttcgttggttaaagattgcatgataatgcgtgctttgtttaccaaaaaaccaccgatccgcttcaaattcggactggtggtttttgtgtgcttttaaaataagcaatgactaattttcttgtccatgctgcttttcttcaatgtgcgctttcgtcagcgcgtagatttccaaaacatggtcatccaccaaatgataataaatctgtttgccggagcgatcccccacaaccaaccgcgcttgtttgagcaggcgcagttggtgggaaaccgctgactgaccgaggtcgagcatggcggccagatcggtgactgtaattggccccttggcaatagcaagaataatccgcatgcgggtcgggtcactcatggttttaaacacatcaagcacatcccgcaattcggcgtcactaggcaccgcgttctcattcatgtccgcattacgaacatcattagttgtcatagcactgcgctccttaagatacttatggcccattttaacagactttggtatcgaaaggcacttttcactgagggcggatgtcggcagttttcccttaagctctctgcggaattaacaagcgtaggccatttaagatgacaatcagcgtgctgccttcgtggaacatgacgccccaagcaatgttggtgagttgcaaaacgtttaggacaaccagcatgacaacaacagccatggagagtagcaggttctcgatcacaatgcgattcattttagttgaaacttgatgcgccaatgctaggcgtgaaaggtcattttcgactagaaccacatcggcgacatcaatggcgacatcagttcctgatcccatcgcgatgccaacctctgcattggctagggctggtgcatcattgaccccgtcgccgaccatggcaacgggccgcatggtggtctgcagctcacggaccacggcaaccttttgttcgggcatcacattagcgaccacttgttcaatgcccaagtcggcggccacggcttcaccggtttgttgcgcatcccccgtgatcatcaccggttgaatgtcgtgccgtttaaggtaattaatggccgatttagcgctgctttttgcttgatccatcaaggcgatcaggccaacaaccctttgatcgaccgcaacgaaaacaacggttttgccctgcttactgagtgttgcggctcgcttgcgaaatgccggatcaacttgcttgaatcgctgcggcttaccaatggtgtaagtgtatccctgatactcggcggtcaagcctttgccaatttcgttatgcacatccgtgattggtacatcacttttggaataatggctcacaatcgcattcgccaacggatgattactttgcatttccattgctgtaataatctgagtcaaggtggcttcatctacatccgacacaaattcgctgtccgtcaccactggtacgccttccgtcaacgtcccggttttatcaaacgcaatggcttttaactgggtcagattagctaaatagctgccacctttaaaaagaaccccttgccgcgccaggcttgaaatgcctgacaatgtggccggcaccgcgctggcggccaaggcacacggcgacacagccactaagaagacgatcgtgcgatagatgctggttgcccatgaccaatgaagtaaaaatggtcccgcaagtaaaacaatcggcaatacagccaataccgccttcacgtaaatcggctcaaaacgttgaatcacgctggctgttttggttggggagtcttgggctgactgcaccatctggacaatcttagcaaaaaccgtttcatcacttgacttggtaacccgcatatcaaaggttgacttgccgttgatggtcccaccaaaaacctcatcgccggtttgcttttcacggggaatgctttcaccgctgatcgcagcctcattgagactagcagtgccggcaataataacgccatccgtcggaacctgagcgccattcagaatctgtaattgatcaccgatgtttaatgctgtcactggtacaacttctaatgcaccggtgtcggtatagcgccgcgcttcttgaggcgccatagccagcagtgccgtaatttctttgcgactcttgttttcaacgtactcctccaaaaaatgcgcgccagcaaaaatcagaattagcatcgcggcctcttcaaaactgccaatcgcaatggcgccaagtgcagccagtgccatgaggagatgaatatttggcgaaaaacggcgccgttttctagttgcttgaatcgttgccatgataccttctgcaatcacttgataacccgcaacaatcgcggcaaaaaccaacaacgccgcgcgagctatcggttgggtgatgagtaagccgccaatgaaggtgatgacgccaagcatataaaaaataatggccttgttttttttcatctttgatcccgcccttacatttaatgttcatatgagcatacgttcatatgtcatcttcaatataccgactttaaagaacggtgtcaatcatgaaaataccttgattgcgacaatctccggccagatgggactggtagagcggagacgacgcttcgagcctcctctggccgacacttgctccgccttggcactgggctcttttagaatccaatgaatgatgtcctaatttgtcaaaaaaagagtcaccagtgaattttcacctagcagctcttaaaaaatcgctattgaattatcaaatcgcggtgcgtctagcgcgataccttatcccaaacattctcaaggacattggtttggtcacggtcagggccaactgagaatgtcagcaggtcaacaccaagtaattctgtgatgcgttcaacgtaacgccgcgcattttccggaagatcatccaaagttttggctttggtaatatcttcttgccaacctggcagttcttcatacactggcttgcattcactgaggaacttgagcgaagctgggtagttttcaacccgttcgccatcgcgttcgtaggcaacacagattttgactttgtccaaaccggttagcacatcaattgagttgaggcacagatccgtaatcccggcaacacggcgagaatgacgaacaacgacagcatcgaaccagccaatccgccgaggtcggccggtcacagtaccgaattcgtggccagcattgcgaatgaaatctccggttttatcgagcaattcagttgggaacggaccgtcgccaacgcgggaggtataagctttcgcaacccccacaacccgatcaatcttggaggcaccaacgccggcaccaaccgtcacaccgccagcagggttcgatgacgttacgaacggataggtcccttggtcaatatccagcataatcccttgcgcgccttcaaacaaaacgtgttcacctttgtcaatcgcatcgttcaacacaattgaggtgtcgcaaacatactgtttcaattgttggccatattgataatattcttcaaagatatcatcaaaattcatcggcgtactatcataaactttgacgaattcttcattcttagctttcaaattagctttgaggcgttcttcaaagatttctttgtcgagcaagtcagccatccgaatgccaactcgagcagccttgtccatataggccgggccgatgccgcgattggtcgtcccaatcttgtcggcgcccttggctgcttcctgcaatttatctaatttaatatgataaggcaaaatcacgtgagcacggtctgaaatccgcagattttcgccagtcacgccttgttctgcgagccgggccaattcaccgaccaagctcttaggattcacaacaacaccattaccgatcaccgataactgatgcgggtagagtacccctgatggtacgaggcgcagcttataaacctcgccatttgcatggatcgtatggcctgcattgtcaccgccttgataacggctgaccaccttggcgccttggctcaggaaatccgtaatcttccctttaccttcgtcgccccattgtgtaccgacaataactacagttcccattaactgatcgctcctcacggcttagtgcgggcatttttacccgccatctggtagtctaacaggatagcggtatgaaaacaagcaaaatccgaactttaaattgataagaaaaacatttttatcaaaaacacgaacgaaaatatttgattctccccctttggcaccgcaatccgaaagagtgccctcatctttcaattcaagcaacggattttacaactatcgacatatcgcctttttaaacgagtcttcaccacgaaatcaggtacaattatcacgaaggaaacgaaagtagtcattgttgtgcctgacgaaatcacctattatgaaaattgtgttgacgttttcaccaacgaaatcctcaagccctttggtatcatgatgtgcacggttgaaaagttttcagtaacgctggataccccaacatctgtcgcaaattaagacttgtcggctaatcaacacccgatttcccaaggagggtcctcaaatgagtgttaaaggcaattatcaaagtacccgcagcgagctatctgaaaccgagaagaaaatcgttgattatgtgatggcacacagtcaagcagtcttaacgatgagtgtgcatgatctagctaaagcagctggtaccagtccggcctccgtcagtcgcgccgcgcgccggctgcaattcagtggctataacgagctgaaaatgcagttagcggctgatctgaaaggtgataccaatcaatcggatgatcaagaaattcaaaaaaacgccaccctgacaacgatcaagcaaaaactgctcatagatgccaatcaatctttgcgtgaaaccgtcgaccagattaacgaagccaatgtcgacacaattatcaacttaattcatcaaagtgatcgtcttcttgtgtttggcgtgggcgcttcttacttagcagcgcaaaacattgcccaaaaatgggggcggcttggctatccttgtcatttcagtgatgacctcaatttgttcttgccacttgcagcaactgcagatgtcgaacagacactttgctggttcatttcgaattcaggtgaatcgccagaagtcgtgttagctgccaagttggccaaaaaggctggcttgcaggtgattgttaccaccaaactcgggaaaaattcgctcaccaagtatgctgatgtgagcattcaaacctcccaaccgatggaggcccgcaaccgcttcgctgcaacccaatcactccacacccagtttatgctcatcgacattctatactatgcctatgtcagccgatactacgatgcagcaaaaatagccacggatcaatcaaaagctgcagtgactgcctatcgtgaatttttacgcaacggctttaaatgagtcttcgaagctttcacatttcagacgcgtctgcagctgacgtgtcttttttttagccttttttgaaattttatttcacatttaaaagaaaatagttgaaataaaagtgagtatcaggtacgtttttatcaataaagggcttccatcaattttccgacgacgcctgccctttaacttgacgtaacgtttatcagccaacttgtcagactgattttccaaagaaagaggctaaaaacatggcaattaatttagatcaaatgacgacggaaactcgaaatcagaaaacaatggcattagacacgatgacggtccatgactttgccaccgtcatgaatgccgaagatcaaaccgttgctcagtcagtacaacaagcactaccagctatcgaaacggccattcagacgatcagtcattcactcaagaaagatggccgcttgttttatatcggggcaggcaccagtggccgactgggcgttttagatgcagcagaatgcgtgccaacctttggcactgatccggaaatggtgcaaggcctgattgcaggcggcatgaaagccatgactgtcgcggttgaaggcgcggaggattctaaagagctcgggaaaacggatctgctgcaacggcacctatctgcagacgataccgttgtcgggattgctgccagcggccgtacaccttatgtcatcggcggtcttgattatgcgcaagctgtcggtgcggcaaccatcagcctcgcttgcaacacccacgccgaaatcagccagcacgcccagatcgccattgaagtgcctgttggaccagaagttttgaccggctcaactcggctcaaggctggcactgcccaaaaattggttttgaatatgctgtcaactggcgccatgatcggccttggcaaagttttccaaaatctcatggtcgatgtactgccgacgaatgaaaaactcgtggttcgcagccagcgcatcattcaacaagccactggttgcgatgccgccactgcagcaaaggcatttgaagcagccgatcagcacgttaaattagcgatcgtcatgattctgacacagcgatcaagcacggacgctcaaaaactactgacacaaacgaacggcttcattagccaaactgtcacagcaagttcggaggagaaaacagatggcacaagataagtatcaaacgatgggcgatggtatctacgcccacatcggcgggccgcaaaacgtggccaaattgatccactgtatgacacgagtccggctgacgatcaaagacgaggccaaagttgatcaagccgcacttaaaaaagtgcctggcgtgctgggtgttgtccaagaagaaacgctccaagtcattgttggtccagggactgtcaacaaagtcgcacaggccatggttgatcgagtaggggttgcattaggtgaccctttcccagccgacacgcaaccgcctgctgaatcaaatcaatcggcagttgaagctaaagccgcagaggttcgggcagcgcataaagccaagttaaagcaaacttggtggcgggctgctttaaaacatatttccgctattttcattccgctaattcctgccttcgtcggtgccggcttaatctccggcgttgctggtattttagccaatttgttaaccgctggcgatttaccaaccagctgggcgtcatttattactgtcttaaaagtcatcaacggcgggctcttcacctttcttaatatctatgttgggataaacgccgcaaccgagtttggcgcaaccgctggccttggcggcatcatcggcggcttagtctatctgcctggcgttgtggccccgatcacgatcaacaacgtcttcacccatcaaccgttatctcctggtcaaggtggcatcatcggcgtcattttcgccgtctggttgttggctgtggttgaaaaacgcctgcatcgactcattccggacgccatcgatatcattttcacgccgatgctcagcctcttatccatcggcctgctgaccattttcttcatcatgccactcgccggttgggtctcaagttcattggtcggcacgattaactggacgttacaagttggcggtgccttctcaggcgctatcttaggcctcgccttcttgccgatggtcatgttgggattacaccagattctgacgcctattcatcttgaaatgatcaagagcattggctacaccggcctgctgccaatcttggccatggctggcggcggtcaagtgggtgccgcccttgcactatggatcaagtgtcgacaaaatcaacagctcgtccgcttgataaaaggcgctctaccagtcggtatcttaggggttggtgaaccgttgatctatggtgtcagtctgccgctgggccggccatttgtaactgcctgtattggcggtggcatcggcggcgccgttatcggcatgatcggccatatcggtgccatcaccattggtccttccggcgcagccctgattccactcatcgccaatcaccaatggctgggttatgttttcggcctactggcttcctatgcaggcggttttctggcgacttacttcttcggtgtgccagaaagcgcgatggtgccgaccagcgctgacggcaccatcattgaaccgctcgcagtaaatacagcagctgtttctgaaacccctttcactagagcaactagcccggatgcgactcaatttgtggcccctgctgctggtcaacttcaagccttgtccgaagtgcccgatgatgtcttttctcaaaaaatggtgggggatggttttgccattgtcccaagtcatggcacggttgtcgcacctgttgacggtaccatcgtcagcatcatgccgaccaaacacgcctggacgatgacaacctcaactggacttgaaattctcgtccacatgggattagacaccgtcgcattgaacggtgaccccttcactgttcatgtgacagaaaacgaaaccgtaaaggcaggtcagcaaattgccgaaatggatctacctgctattaaaacagctggcaaaagtacgacaatcatcaccgtcatcaccaacatgacccatgtcaccgccatgaccagcttcacagatcaatcgatcactgctggcgaagacgtcctgcgcgtcaccagccaatcagaaagttagtatatgaaagtcgacggcagattgacttaagcttatatttgagtgatcgtgtgtgccaactaaaaaaatcgttcctagagaaagcacagtttctctaggaacgattttttgcttgcggttgatacacaattcgtcttttgatagatgccctgatagcatttaaaaatctcagtgccaaggcggagcaatcgtaggccagatggggctcagccgtgcaaacaacacagcgaccgggcttggagctgatgttgttaggcgacttttagaccgcgcgttttgcgggctaaaagcgccgtcacagcgttccagccccagcaggccggagattgcggattttggcacggcaaggaccttctagcccagattttttcccagagtatttaaaatctaataaagcccaattcctagatggtaacgatggctcgacttgttatgtgccaagtacagattagcgtccagcatttttcaattgtgcctcttgcaaatacgcaaagatgtggccaaaggcaatttcacgaatctgaccatagcgaatttgcgccgtttcgccatcatctggtccgactaggtttaagtcaaaatcggtttcaccgacattttccggataacccagaaaatgttcatcgctgtcagctactttaatgcgaaccacccgttcaaacccagcggcctctgagatgatggtccgaatcaagtcatcattcggatcgaactcacgatcagcattcaacactggctgctggctgaagtgatgggtttgatcccatttttcgtaaaagctgatcgtttgcaaataatccgaaaccgtcgctacattttggatgcttggtaacgtcagtaaaatatagccaccaaactggccggccatgtctttaagactcaacaccacaacccggtcgttgaccgctttgacgcgacccacaaagaactggtcttccggtcccttgggtacgactgaaatcaagcgattgttcgccaaggcattctgaaacacgccagccagttgaccgtcattttggtacagcttggtggccacgtgctttagatgatcacgttgccagaccagttccgtttccagtttgagatcaaggccatggaattccataactaaaatatccgagaaatcaacctgcaaggcgcgcacatcggtgtagttgaatttgttgaagatcgccatactaaagcgatcctcagccacagctgttacctgcccttcaagataggcatcatcatcggccaccacgaccatgaccatttgaccattcgccttagcctgcgtcgccagttgctgaatcaagttctgtgttgcatcgaactgcaatggcttttcttggccttgcagcgtcaaaaaatgctgggcctgtgccaagttaattcgaaaattcatgctatccagatcatccccggcaaattcaacctgatcaatcgcagaaaatgcgatcaaggcacatccatcggcaatccctgaatcattgtaggttcccagaacaaccgcatcatgacctaacacctgtacgtatccggtgtaaaaatcgtcggtatcgcgctgatacacattgatcagcaggtgttcattgagtgctgtcattaaactcatcaaaatggcatccatgcggcatccctcactttcttgcgcttaaatctaaaaataactttctaatctttcttgctaatggtttattgatccggaccattataggcaatattcgtaaacttgttatacgacttcacaaacaacaacttgacggtaccacgcgggcctgaacgatttttctcaatgatgacttcaacttcaccaacattgtcatccccgtcatcattgccgccttgatcgtcgtcatcctcatcgccttctgcatcgcggtaatagtcatcacgatacaggaaagccacaatatcggcatcctgttcgatcgaaccggattcacgaatatcgctcaacaccggccgcttatcctgtcgctgttcaacgccacgactcagctgggacaacgcaatcacgggtacatgcaattccttcgccagttttttcaactgccgggaaacggcgctgacttcctgttggcggttttcttggccagaaccttcaatcaactgcaaataatcaatgataatcagccctaaatcaccttgctcacgcgctagccgccgacacttcgcgcgaatctccgccattctgatgcctggcgtgtcatccatatagatcttcgccttactcaagctacccatggcgataatcaagttctgccattcttcttcattcagctgaccagttcgcaggtgattagcatcaatactaccttctgaacacaacatccggtttaccagctgttcagcgcccatttccaaactgaaaatggcgacacttttgtctgttttcgtcccaacattttgggcaatgttcaaagcaaatgcggttttcccgacagcaggccgcgccgctaaaataatcatttcgtcctcatgcagccccgtcgtgattttgtccaaatcacggaaaccggttggcaacccggtgattgcctgatcattttgatacaactgatcaatctgcgccatagcctgattcagcacatctttgatctgtttgaagccggcctgattgcggttctccgagacatccataatctggcgctcggcgtcttcaactagtccttcaacatcgtcttgttccgtatagctgcgactggcaatgttttgcgccgtactaatcagtttgcgtaacgtgctcttctgctgcacgattttggcgtagtataccacgttactggcaataggcgtcgccgcaaccaaatctgtaatataaccaaccccgccaatatcatcgaggttgttatgattgtccagataatccgacaccgtaaccgtatcaatcgctgtgccgttatcctgtagatcggtcatagcttggaacaacagccggtgtgctttcttatagaagtcatccgccgtgacatactcttgtgcatccggcaatgtgtcagcattcagaaaaatgccgccaaggacggcacgttctgcttcgtcactatgcggcggctgctggtcaattaattgattatccatgcgcgtcctccttcagattaatcgtcaaaaattttttgtcgcctatccctaacagtctacgttaaacccgcagtcaagacaagcatcaccgcatacagtcgaactacacaaacaatttaacgaaaagcaatggtcactgctgtatcaccggtgattgactcagtccacaacccactaatttggaccagatagacaaaaagacgcgatcatctggtcgcgtcttctggcagaataactattcttatttttgttcaatcacgtgtacccgaatgcgggcatcaatgccagggaataaattaaccgtgacattagtgaaacccagtgaacggataggctgcttcagatcgatcttacgtttatcaactttgatctgatattgcttatccaaagcctgcgcgatctgcttgctaggaatcgaaccgaacaaccgggaatcttcgccggctttgctttggatctgaacaacggttttgtcgtcttcgatcttagccttcatggcctcagcctcggttttcttttcagcttccttcttctcttcaagccgctgctggccgcgcaaagcactcatagcctgcggtgtcgctgctttagccagccccttgcgaattaaaaagttttcagcatagccgtcaggtacttctttcacctgaccgcgattgcccttgccacgaacgtcttgtgtaaagatgactttcatcaaaatccctgctttctatgcgtcttcgtctgcttttttgatctgagcaagcagatcagtccgaacttcggcgatcgttttgcctttaatctgggtggctgcgttactcaagtgaccgccgccgcccatggcttccatgatgacctgcacgttgacatccccagtcgagcgggcggaaatgccgacatcaccgcttggccgtttcgtgatgacaaaactggcatcaacgccattgagtgacaacatcgtatcagccgcttgtgctgcaatcactgggtcataacgcttatcctcttccccagtacatagtgccatatttggcgcaatcatttcaattgtatcgatcaaatgattccgttggatgaagctgtcgatattttcctttaacaggttctgcgccaacatgccatcagcgcccatggaacgcagatagctggcagcatcaaacgtccgcgtgccggtgcgtaggctaaaggacttggtatccaccgtgatccctgctagcatcgccgttgcctcaagcttatcaagacttggcacatttgtcggctggtattcaaacatctccgcaatcaactcacaagtggagctggcgtacggttcgatataaaccagcatcgggttgtccggaaattcttcgccgcgtcgatggtgatcgatgataactgttcttgccgccaaccttttgtacaagtcaggcgccgctgagatcgacggcttgctgtgatcgaccaagatcagcaggctctgatccgttgcttgcgacagcgctgcttccggcgtcacaatggcattagcaacttcaggatcttgacccacttggcccatgaggcgttcgacatcggagtgcagatggtcagggtcaatcacaatgtaacactctttgccattcatctgcgcaatccggcgaatccccatcgaggcgccaactgcatccatatctggccgcttatggccgacaacaaagaccttgtccgtctgcttaaacaattcttgcaaggcctgcgcaaccatacgcgcccgcacacgcgtccgcttttccattggattcgtcttgccgccatagaaacgggcttcatggcctttggcgcggaccaccacctgatcgccgccacgaccaagcgccagatccaagttactctgcgaagtcaccgctaactgagccaagtcttcatcgccatatgcgatccccagcgacagcgtcaatggataattctgtttcgaggtttcttcccgaatcacatctagaatcttgaacttgtcacgttcaacatccttcagcgacttggcataagccagcaggaaaaagcgatcgttgtcaatccgcttcaagaacatgccaaattgattggcccaatccgtcagctgattcgtgacgtaactatttaaattagtaatgacctgatcatccatggtttgtgtgatctcgtcatagttatcaatgaagatctggccaatggcgatcttctcgtcttctgcccgctcttcaatctcagcatatcgggtcacgtccatcagatagacaaccccgatactcttttgcacgataatctcaaactgatgctgaccccaagtcaccattttcgtttcattggtgttctcgttgctgcgaatcaactccgccaattccgcatcaacatgttccaacggctgaccaagaacgtcagtgtcgccaaaatacttctgcaggaatgggttcgtccattcaatattgagattctcgtcataaatcaggatcccaatcggcattttgatcagcgcttcttgttcgccgcgcttgatccgataactgaggtccgaaatatactgattggtattcttggcaatggtttctagggcataaaaaatcgtggccactagactaatcaaaatcagcagcatcaacaaagccaaccacggacggatcagtgctcccatcagaataccgatcaccgccagcacgaccatcgcaatagctgcatatcgcattcgcatgtcttcaagaaactccggcatacgaatccgctcaaacaatttcttcatatagaaaaactcgctttcacttagcgcagatacttaaggatttctttagctattctaccatactgtgcaattggattctgcgagcgacttgtaattgcctgctagtatcacgtttacaaaaaaatatcaaaagtttttctcgttttgctagtatttttctaattgcaagtttacactgtaaacacaagttactttgtaaacctagtctaaggagaaatgtgatgaatattttgaaagtaaccaacttatgcaagacctataaaactggtaaaaaagcgctgacggatttgaactttacagttgaggcaggcgaaattcttggctttttaggaccaaatggtgcaggcaagagtaccaccatcaacattatttcaacgttgcttaaagcggatgcaggttcgatcgtttatttcaacaatccggacttaagtaacaaggcgatcaagaaaagacttggcattgttcctcaagacattgccctttatgaagatatttctgcgtatgaaaacgtcaaattctttgcggctctttatggcgtgaaacgggatgtcatgcgtgaaaaggtggatagtgcactggaaaaagttggccttttagaccgaaaggatgacaaaccggaaactttttctggcgggatgaaacggcgcctgaatattgcgtgtgcaattgctcatgagcccgacataatcatttttgacgaaccaaccgtgggtattgatcctcaatcacgcaatcatattttggaatcaattaaattacttcggaaaaacggcgctactgtcatttatgtcactcattacatggaagaagtccagcaaatctgtgaccgaatcatcatcatggacggtgggacagttctgcttaacgataaacttgctaatattttaaaaacatttggcggtgccacctatcagctgactttagtccctcaattttcaagtcaagtgcaacgatgataacgaattcttgatagtggtctaggctgttacgccatgcatcggtagtaatcgcatgggcgaagatagttcagaatacgtctgggacgatggttcagtgcggggcaatctagctcgaatactaggatagaaagcagagagttggcggagcggcgatgggctcagtggtgagattggtcttagcagagtggttttctccgcttagaccaagaccgagcttcgagacagcgcgccgggcttgcgcgttggctcgaagtcgtgcccaccactctagctgcgcggtcgccaccccgaatcgccgcggagtcaactcggacaataggatcaagcttaattagagtagaaccgagaaaagcttgacacatacgggcctgctcacgctctcccaaacgcgttcgcaggcccagaaacctgcacataaggacctcggacataaatggccaaagcccagccatttatgtccgaggccacttatgctccggtttctaaccgggcctgctcacgctctttacttttccaagtgcccagcgtacaattatcgacaccattttaaacaccgaaaggagcgccgtttctatggaaaatgcaacgaaggcagaagaacaggctcgggtcacggcggtcattgagaagctcaaggcaaggctagcggccattcatgaccagatcgaagcggcgcacaaagaaaccagccggattgaacgatcttacggtgaaaataccaaggtcaacgttaccgaagtcgatgaccaaatggaaaccaacgctgcggttcaacaacagaaagtcatggttgcccgcgccgtcgaaaatgaaaccattctcaaacacgaaggtaatcgtctcaccctgctagcggacaatccttattttggccgtatcgatattgacgaagatggcgatcccgacacgctttatatcggcactgccaccttcattgaccaagatggcgaattcttggtttatgattggcgcgcgccggtaagttctatttattacaacggtacccttggcgatgtcagctacgatacaccagcaggcgaacaacacgccactttgaaaaacaagcgtcagttccaaatcgaacacggccacatcaaaaccatgttcgacaccaatgaaaccgttggcgacgaaatccttcaatccgttttaggcgatcaatcagacgaatacatgaaaaatattgtcgcgaccattcagcgcgaacaaaacgacattattcgtgataccaccagcgacttgcttgtggttcaaggggtcgccggctccgggaaaaccagtgcggtcctgcaacgcattgcttacttgctatatcacagccgtagcgatctggatgctgaccaaatggtgcttttctcgcctaaccgcttgtttgccaattacatctcacaagttttgccgagcttaggcgaaaagaatatgcggcaggcaaccttgtttgaattcttggcaaaccgtttcaccggcttacatgttgaaacattatttgaacgttatgaacatgatgcagctggattgccgccagctgctgagcatatccgtcgctttaaagaagcgccgcgctatcttgaagctatctacgactatgctaagcaaccgaagcggacaccgcattttattgacgttgagttcaacggtgagactttcttctcagccgcaaccatcgcaaaaatttatcaagcccagccagcattgatgcagccagttgataagtttaccgccactaagaatgctttgatcaaacgtctgaatacccgaattcatatggaagccaaacgagactgggcgcagttgcgcgtttccgatctgtcacaaactgaattggaaaccttgaccgccgatcacgaattcgataccggtgaagatgaacagcgatttgtctcggaagctattgtctcaaaagcattttcaccaatctacgatgcactgtacaacgatcatttttacgatgtgttccaagactatcagcaattcatggcacaggtgaaaccacccgttgctccggctatctggcacacaatggtcaacgccttttcagacggaatcgaagcgcatcaattacgcttagaagatgccgccccgctgctttatcttcgtgatctcagcaccggcagcggtcaaaatagcctgattcagtatgttttcgttgatgagatgcaagacttcagtatggcgcagttgttgtacttgaaacacgcctttcctaaagccaagttgactttgttgggcgatgccaagcaagacgtgtttaccagtaattatcagcctagtgatttcattcatgaaatcgaggacgttttttccggctataaaattcgactcattacgttgaacaaaagctaccgatccacgcaaccgattactaactttgccaaagctttattaccagaacacgaccatattcaggcgtttaaccgtgctggtgataaaccagaagtcttgacggtagcgcgcacggaagcacccgatgctttgtcaaaactggtgacgcaactgctggcaaccgataccaccgtggcgattctaaccaaagatgcccaaacggctgatcaactttacgccactctcaaacttgatgcaccagtcaccttgctatcggctaatgaccatagtcttaaaaacggttgtgtcattttgccagtctatctcgcgaaaggtttagagtttgacgcagtcatcggttgggatatttctgcaaccacgtatcaaaatgaagccgaccgtgatattctctacacactttgctcccgagccttgcaccatctcacactcgttgctttggacgccccaagtccattgatcacggcactgcccgctgatctctacacacatgcaggggatgcctctgaggcgcgtgtctaatgccacccatgcatcatcaacaaacgcccgtgtcttcgctgacacgggcgtttgtttggcttctagaatcatgataaattatcaatggaacgatttaatcaattctgtttattaaaaatttggaggtttatttttgtttaatctactccgtaccttcatggccgtttacgaaacacgcagcttttccttggcagccacgcacttattcaccagccagccaactgtgtcacaccatattcatcagctggaaaatcaactaaaaacaaccttatttgaacgaaacaaacgcagtgcgacgattcccacagcagctgctgatattttgtatacctttagtggcaacctgctggctgagtgggaaaaaacgcaggaagcgattcaaaatagtcaaaaggatgccattgttgacctgcatattggcgtatcgcaaagtgtcgccgctgttctattttcccgaatcgcagcggctttaaaaaaggcttttccctacttgcaatatgatgtcgccgtgctcaattccttgcaagttgtcaaacagctggaaggccaacatttagatttaggctttattgaacaacctttaaccttaaagggcgctgtccgaacagccctttgtacggatcaactgatcgctgcaggttggtctaccggcacttggattacccgcgaagaaggctctgggatgcgctattacaccaccgcttatctgcaagcagccggtatttcgccgcaacacatgatgactgtcaataacaatgccatgctgctggcattggtacaacaaggtgtcgggcaggcacttttgtcggatcaagtcgcactcggcaatgctccggcacaagcaattgggccgcaatttcaacggcatttttacttgctgcaaaacccaaccgccaactggccccacaaccaggccatgctagataaaattgttgaagcagctcgcgcttcggaagtaacccgctgatggccaagctgctttggatgactattaatcagacagttcttgagtagcagttgctgtttgcttgactgttttagctgtaagccgcaaaaagtttagataatggccggtcacaaatatcagcatcaaactcgctacaagccactcaccccactgcaacacgctcaacaagttatgcaccaaccccttgctggcaaagatagcaataaagcaggtcaaagcagttgcggaaatgacgagtggaaaggtgaaggcggcaaaactcggataaaacgacagccgcgtatactgtcgaatgctgaaaagggttagaaaatacaggcactgtgcaaaaattaacatgccggttgcaaatgccaaattcggatgcgcgaagctggccagataaccggtcaggcaaagcgaagccggtgcggcgatgatcgtcagtaagggttgtgttgcctcaggcagcggtattgtcctgacacgatgcagcacaaacggaaaaactgccacgtagatcacaaatgcaagccagaaaaggggctgcccaagtgctggcacgaattttccactggtcacgggaatgacgccgataccgacaaaggtgacaaaccagctcggataaatcatttgccattctttttgttgcgggagcaaatgccgtgaaacgaaaaaaatcattaagccaaaatggataatcaccgctaatacccagatgacagtagcgatccccaccggcattccccaagcagttaaataagtgcacaagatcatcaaggtcatcgaaaatgtcggcgacaccgatgcgatgatcggatcctgtaaacttttagctgcgtgtaagggagtcaggcaaattttcagtaaaatcagtccaaacagcaaagcagctaagcctcctgttaggttccctactaattgccaacctgccagtttgtatagattacccaacgatgccaatcccagtgtcagtcccgccatcggtaacggcactcgtttcaaaaatgatctcataactgcctccttatattcttgctattaagtgtagcaagaatcatcgtcatcggctaaattgatcttttgcatgattaacattcacttattgaattaatcatggtgacgatcatgcgaccaatctaggctaaaagtttcttgccatgccaaactccgcaatctgcggccagatgaggatggaacgcgtgacggcgcttcgagcccaaaaagcggtctcgaagtcgcctaacaacatcagcgacaaagcccggtcgctgtgttgtttgcacagctgatccccatccggcctacgattgcttcgccttggcactgggatctttaaaaccccaataaatcatttatgagaaaataaaaaatgaacaacttccaattgcgaaaattgttcattcttatttgacgcttatgaatgatgtcctaaccttagtttggaaaattctacacgagcaaaattgttgcattgttgagcatatgcaacccaatcgaataacgcatgtctcttgttcgcaagtaagtccaagcaaggacgccgccaagcgcggcatagatgaagaagttataatccacttttccggccacatgtgcaaagccgaagactgcggcactgattagcacactcacccattgccaggatcgctgcttcaaagagccgaaactgttcatcaagaaaccccgaaatagatactcctcaacgattgggccaccaacaactgctaataacttgattgaccacggatagtttttaactaaatcaagcaggttactttggttggcagcttgaggcgcgtgcatgacttgcgtgagcgtcacgttgatgagctgaatcaaaaatagcaatccgataccttgccagatcacgctagaaggatgagccaccgccagcgcaggttgttggcggtaaaaatgtcgatagcagaccatcaatgcagcaatcagtgcaccgaatacaaagaccaaggcaccaatggccccataggcaccccacgtggcctcactgcggatcaacgcaagttcggcagacgaataggcgataaagcctgcagcaacgccaacaagttggacaaatgagcgaagaattttcatgaaggcaatcctttcttggcatgtttgtctttaagggtaacattttagaagccagggtgcatggtgaaacatagccgtgaagaggcgtgtcatgcttagaaagtgaagcataaggtcccaccataacgcgcgagtcatccccaaaacctacgcataaggagcttagtcgtaatgatcaaagcccgccctcacgtccaagaccacatactttccggtttctaaccgggttggttcgtgctcacaaaaaaacctgacagatttaatatctgtcaggcgcggtactatcagccgtctatcggattcgaaccgacgacctcatccttaccatggatgcgctctaccgactgagctaagacggcaaatggctgtgttgtttaaaaacaactgcctaattaatgtacactaaatccccatagctcgcaagtcctttttataaaaatgtagcgtagaaagcaaaaaaatgcgcattgctacagctgttttaactggccatgctgtcctttcataaaagagccgccttgccttaccgtctaccgtgccactcggccttgaactcggttagaaaatcttccataacctgttggcgatgcatcgccatttttttggccgcatcggtgttcaattgatccttgagtttcaacagtttttcataaaagtgattgatgacggtgccttctgttgtacgatactgagccgcggttaagtcagctcgtggtggtaaatctggatcatacatccgcccaccatgtgcaccgccatacataaaagcacgaccaatgccaatggcaccaatggcatcaagacgatcggcatcctgaaccagttgtccttcgaccggcaacgattgatggtgttgtaagtttgctttaaacgacatgtgatcgataatcgtcaataccatttggacttggtcagcgcgcatgccagcgtcgaccattgcctgctgggtggcggctttggctactggcacatccggaaccaatttatcgtcataggtatcatgcatcgtggccgccgccaacacaacggctgtatcagcctctggtgtttgcgcagctagttgttttgctgtcgccacaacccgctgaatatggtcaaacccgtggccactgtgatcttgctcagataccttttttgcaaaggctgtcagctcttgccattcgatcatgaatcgttgctccttttcgttgtccaccattcagtcacctgctatgtgattttgttaacaaatcgagcttttttctgccgtatttattgcgtcaatcaacctcaatccttcatactaaaagtatacagaggttatgaaaaaaagggggagcacttttatgaaaaagcaatatttggcagccagtcagtcggtgaatcaattcaaccgactcttttcaccggtttcaacatcggaaattccattgaatcaacaaaacctgcttttctggatggcgaccgatgccacgccaagaacaccaacgagcttggccaaagagatgcacgtcactaaggctgcgatcaccaaagccagcagcccgttgattgaccgggggttgcttgaaaaacaacccgatcctgaagattgtcgcagcttcaagctcgtgcttagcgaagaaggtaagcaagcaattgaggatctcgggcctgaatacttgggcaacttagaacgtctctatcatgaacttggcgagaaaaagtatctgaagttgatcaaacttctcagccaagcaactggcaccttagtcaccgaataaaccggtcatctcgtggcacaaacacctcattgagatcaccacaatcaagcctgacgctcagttgcgtgaggctttttcagttgactgggcgacacaattttgtcgccgactgttgccgtttttctaggagcgttacaatgacattatcaggacgtagctagcccgattttgtcagtagccggctatgtctatctttttaaaggagtggtttgatggcaattcccgatcatatcagtgttcgcggcgcttacgttaacaacttgaagcatctcaatgttgatattccacttaacaaactggtggcgatcactggtcggtctggttccggtaaaagttcattagccatgggcgtgttatacgctgaaggtatgcgccgctacatgagtgccttgtccacctacacccgccggcgccttggccaaacaagtcttgctgctgctgactcagtacgccacattcctagtgccatcgctttgcggcagcggccaaccgttccaggcatccgctcaactgtcggtacggccacagaagcgctcaacgtcattcgcctcatgttttcccgtctcggctcgccggtttgtcctaatggtcaccgcgtgtcgccaaccctcgatattgccaaggcaatggatctgcccaatgacggtgaaagcggtatgggcatgatcacttgtccgacctgtggcgtccgtttcatggcttttgctgctgaagatttcgccttcaattcaactggcgcctgcccgacatgcggcggtactggtcaagcgcgcacactggccgccaaccggctcatccctgatcaaacactgacaatccgtcaaggtgccgtggcctcgtggcgcttgcccggtcgcaattttatgccttttgtcgcacaagcaatcggcattgatattgatacgcctttccaggacctgccaaaagatcagcaagaacaggtttggcacggtgaacgtaaaaaatacgccatcaatatccccagcaaaaccggcaaaatttttcatatggaccatgcacagtacgagaatgccttcaatgcggtcgaagattctttagcgacgaccaaaaatgaacgcgccattcagcggctgaatcgcttctatgagtttggcatctgcccgacctgccatggcagccgattttccccgaaattattgagccagcacctagtggatcaaaacattgctcaggttagtgatatgactttaacgcaattagccgcgttcattcccgaaatctatcactggttgccagcagatatgcagtcactggcgcacgatattatccaagaactgacgcaattgcttaagcccatcatggaccttggcctcagttacctgaccctgagtcgagccgcggcttccttatcgactggtgaattgcaacgcattcagctcagtcgcacgcttcggactgaaacgaccggcgtcctttacgtccttgatgaaccgtccatcggcctgcatgctgcaaacgtttctggattgctagaagtcatgcacggtttggtcaatcaaggcaactcgctggtcgttgtggatcacaacaccgccatcattgaggcagccgatcaagtgattgagattggtcccggtgcaggcgttgctggcggccgactcattgatcaaggtagccctgaagcgatcagccatgatacccattcgttgattgcaccctttttaaccggagcggctcccttgattgttcgcccgcaagctggtgaacaagaaattaagcaaaccaaacaactgcaattaaccgtaactgatcgatttaaccttcatgacctgcatgtccattttccagttaactgcttctcagtggtatccggcttttctggtgctggcaagtcaactttgatttttgacgccctagtaccagcgctgtcagcaactgctgaccaaccagctccagcatttgttcgtgatcttgaccgcggcggcctgcgccatgtagttgcgattgatgctacgccggtcggtaaaaatgtccgctcaaccgtcgccacctacacagacattctcgaccatctgcggcaccttttcgccagtttgcctgatgccaaagccaagcactatacgagtagccatttctcttacaacgtcaaagccggcgcgtgcccgacatgcggcggtaccggcgtcattaacttagatatccagtatctgcctgacatgcagcaaacttgcccgacttgtcacggccgtcgctacaaccccgaggttctgaaaatcaaatggcagcagcacagcatcgccgacttgctagatctggacgtggactccgccttgaccgttctgaaagacgaaccggctattactcacacattgcaaaccctgcatgacatgggcctcggttatttgcatttaggtgaaagtaccccgacgctgtctggcggtgaagcgcagcgcctgaagctagttgcccacatgggacgctcccaaaaagacacgctttttgtcttcgatgaaccatcggtaggtctacaccccctggatgttcaaacgttgatcgctgtttttcaacggttgctcaaaaccggtgcaacggttattgccatcgaacacgatctagacgtcatcgctaacgctgattatgtcttggatctcggaccaaaaggcggtgcagaaggtggccgcatcatggctgctggcacaccgcaagcaatcgccaaacaagggaaaggtgaaactgccccttacttggcgggccatctggcggcctttcacgttaagtaggcttgacaaaaagagatgcctcggaaagtgataaccgagacatctctttttcatacatcaactttaaacgttcaagatcgaatcaatgtggctgatttcttctgcactgaaggtcagattttcggttgccttcaggttgtcttccaaatgatcaaccgaggtggtcccgatgatgacactggtgacaactggatcacgtaacagccatgccaatgccatttgcgttaacgtctggccacggtcatgtgctacttcgtttaactcgttcagcttcttcacaaccgcgtctttcccatgggaaaaagtggcttggttggtcggatgaattttgaacgtatccggaataccattcagataccgatccgacaacaagccttctgaaagcggcccataagcaattaggccggcaccatcggcttgaagagccttcgttagaccagaagtttcagcctcacgattaaacatgttgtaactgaactgattcagcacaaatggcgtatgcagatctttaaacatcgcaatcgcatctttggtttgctgggtatcaaaattcgagatcccgatgtaaagtgccttgccatcacgcaccgtttgatcaagcgcattgacagtttcttctaaatcaaccgtatcatcaaagcgatgcgcataataaatgtcgacatagtcaagctgcaggcgtttgagtgaatcattcaagccttgaatgaccgctttgcgcgaagtcccaacgccatatgggcccggatgaatctcataccccaccttggtgctgatcaccaattcatctcgataagccttcaaatccgttgctaaaatttgaccaagcaaactctcgctgctgccaaaaccaggttcatgatcaccattaccatagtgattcgccacgtcaaaatgaaagacaccatgatcaaaagcgtctaaaataaccgaacggcgtgggccaaatggatcaagattgccataatgctgccacaagccaagtgaaattgccggtagcatcaaaccggttttcccggcatgacgaacaggcatcttgtcataacgatcagttgctgcataatacatgacttttccccctctacacgttcacgagtgcagaaacctgcatacaagcgccttgaacgcttatacgccagtttcgaccgcaccagctcacgctttgacttaaacgcgctcaccgacccaggaatcatgtatacaagccctgaacgctatggtcaaaattcaaccatcgtattcaagccaatttgcataaggatttctaaccgggctgtctcacgctcacgaaaacgtttaccatcttctatggtggcaaacgttggcccaacaagcaacctaaaaagtcaattttttaatataaaactacttatttttcaaaaaaatcgttcaaaaagttagctacaccatcatccacattggcatctgtcatatagcgggcagtctgcttaacctgtggcacagcattttccatcgccacactaataccagtagccttcagcatgccaagatcgttgagaccatcgccaaaggcaatcgtttgctccggaccgattcctgtgagcgtctgcaactccttgacggccgtggccttatcaatatgtttaggaatgagttcaaggttagtatgttcagaggctgaaacatgtaaaacatcctgtgcttctaacgctgccttccccttagccaatgcttccgaatcatgcgggccaaaaatgatcccattcgtaattgcaggtgcatgtgctaacaaatcatcaactgaaggtaaggctacaacgtcaatgctcaccgagctgggggcaaacttgcgtgcagctgcttcaatggcaggcggcactttacctgtgtaataaacggtatcatcgctgaaatacaaggcgttcaggcccaactgatcggtcacagtttcaaccgccgtaagtgccccttgccccaaaacatgatgcacccgctcgccggaaaaatcgtagacagcaccattcgatgcaataatcgaagcttctggttcgaattgtttggccacaacctgcgctaaagcgtgcatgcgcccggtggcaacataaaaagaagcgccgctagcaacggcagctgcgatggccgctgccgtttttggcgtaacgtcatgatgattggcggttagtgtgccgtcaatatcactaataattaagtatcgcggcataaacgttcctttctaccctaaggacacaaatggcgaccgatcaccatcggccgccttatttgttaaagtccttgcggtaatccgtcaatttgatcagcgtaccaatcgttccatggtgtttcaggtgcgccttgcgcattaaaagttaccttaacttgcttcaaaaggtccaacaagttaccggatcggttagtcagaagaccggctgtcaattcctcgcgagtcagtggttgattatcaagcaagtaatgattaatatctgctagattcccctgcgtatcaatttgggaaaaaacatcgagaccggcgccgaagaagcgatccaagtagaactttgcaaaagtttccaatgctgtatgttgtgctgtttcatttaattgatcaatcgttgtgttgcttgctgccataactattttcgtcctttctgctttattccattataaccacttttggttgcgttttggaaaacatcgtcccacaacgatcacaagtttcacataaacttacacgttgccgtcgaccaccattttatgagtgctcctggtcatattcattaatgaaaagatagtgtttgatgacatttttataggaaatcaaaaatgccataaaatattcgtcttttttgaaattttacgactttggtctcttgctattatggaacggttgttatagtatgccaaatatgttggggatccgtgaaaggctggagattttatggaaaaagaaaaattacatctcggtgacgcggttgtttgtcatgtcaaagaagatatggaagcaccttttaccggaaaaatagaaaaggtttatgagaactcggcgctgttgagtattaccgattatgctgataaagaccggcagaatgccgcagagctcaactttaagattgtcgcaaatttccacgcgatgactcagaacctcggcggcggcactgtcttggcgttcccgccagaaccagccgaagagccaaaaaaataaacgttccaatcacattgtctcacaatatcactggcatctcgtgccagtgagtggttgttattatttacttagggatcttcaactcaaacaaacaaagtcaaaccggtcgacaggacagcctgctgatcggctttttttagttgatacccaagacaactttcatggtcattcatgaaaatcagcgtaaaatgagtcgcaaacgatctatcgcaagagcgcaagccagttaagctcgaagtcttatatgcaggtttctggcctgtaaacgcgtttaagggatcgaccaacatgaacgagaaaccctatccagtccacgaaagtcttttgatcggcacactgctcacagcagctgctggcagttttgatgctttcacctatctcttacacggtgaggtattcgttggcctgcaaaccgggaacgtcatcttgttgggtattcatctcggtcaggcgcaatggactaccgctgtccgttacatcgtaccgatcttcgctttcatgttcggcaccatggccgcccgcgcactgcgactgcaggctggcaaaaaatcacgacctttaaccgaacaacggtggctcattcaatacgaaatcactttgattcttatcgtgacattgtttggccactggctgcctgatctagccgccagtgctttggtttcactcatcgccgccgcgcagctacaggaatttcgccgtttaaaaggcggcccttttacttcactgatgatgaccggcaacctccgcaccgcggcgcaaagcctttatgatggcttcatccgcgggcagcaaaaaggccgcaaagacgcggccacaattgggacgattattttatcatttgctatcggtgctgccgtgacaggtattttaacgaccctgttcggaacttatgctttagtaggcgccgctttgtgcctcgtctggattgatatcattttttggcgtgatcaggttgagcttcactaagccacttaattagcggcttgacctgcatgcaagaaactaaggtcattgaaatccgtcacagtaaatcgatcattttcccacatcagtttcgtcacgctagcattgtctagcatttcgcgaccatcaatgttgtagtgaacataattcaaccacatgagcgccgctgtcccgtgtgagacgaccaatactcgctcccagtctttggcgactgcctctacagcaatcgcacgcaaagttcgattcaagcgttcctgcaccatgcggttcgtttccgccttgtttgggtgctgatccatattcgccgtaaaagctgcatctgccgtctgggccaacgttatttcttgattggccaatgcatcgtgaaagttagcaatccccatggtcgctaaggaaaaatcatttgccagttgaccttcgaacttgccgtaattttcttcacgcaaccccatcaaggtcgtcaccggtatcggttcatccaaaccgctcaaaacaaaatgggcagtatctaccgcgcgggttaaatcgctggcaaaagccgcgtcaaagtgaatgtttttagtcttaaagccttgacccaaagctttagcgtccgcaatgccttttggcgtcagtgccgaatcggccatgccttgcactcgtttttgtacattgaattctgtttgcccatgacggacaagataaagcgttgtcatgtctagttgactcccataattttcatttttcctgcgacaatggtttaagccagtttcaaataatctgccaaatagtttgccaccccatcatgctgattatcgttaggggtccgcgcatcggcgattgcaagaatcgcaggacgggcatttttcattgcaacaccatgacccgcaaactgcaacatatcaagatcattcatgtcatcgccaaacgcaatgatatgcttttgatcgattccgtataggcccgccacgtaggcaagtgcccgtgacttgctggtattcttacttgtcacttcaagcgcagtgtattcaccactccaagcaccccacgttttggccgccaaatgtggatacaatgcgttgacttgttttgaaactggatcaaaggttttagccgtcataaacatcgtgaccgaaataggcggctgccgcaaaccttgctcatctaacagcgccttaggatgcggacgatctggcaaaaacggaatgttcgcgtatggtcgatcagccaccagcaactgtttaccttctgccaccataactttaaaggaaaagtcgcgttttagctgccgtaacgacagtgccaccggaatgggaatggtgacctcttgctcataacgccagtgttggtgcgggatgtgaatcagcgcgccgttgaaattgatcatcgggccatgaagctgcaagtcgtcgtagaaatgttccgaaatcgaatccggacggccggttgtaatgacaacgagatgtcccgcggcttgtgcctcgcggaggacggcaatcgtgccagcgcttaattgtccatccgcattcaaagtcgtgccgtctagatccagtgcaataagatagcgttccatgcagcagcctcttttcaaaattttttcttagtgatgtgtctagccatctaaaacgcgttcccctacaatagatagcagttagaaagcgaggaaatcatggctgaatcaattgtactttatacagatggcggtaatcgcaatacaggaaatcaggcgggtggatcggttcgccccacggataaaagcgcatgggccgcattgctgatctacggagatcacgaaaaaatgctatctgacggcgactatggccgaacgaataattatatggaaattatggccgttattcaaggcttaaaagccctcaaacgcacagatattcccgtcgatgtttattccgactctgcttacgtcatcaacaccatgcagcaacgttggtgggtaaaatggcaacaaaacaattggcgcaaccatggcaaaccagttaaaaatgccgagctttggcaggccttgttgcaccaagtcaatcgctttgaaacgattacctttcacaaggtcaaaggccatgccaccaatcgcaacaacaatcgcgtcgatgcgaccttgaatcaaaccatggaccagcttgacgatcatgtttaactattttacccctgatggccgagaaatgcttcaccataagtctcagctaagaaactatgaatcacctgctgcatgcgctgcacagaaggtgatttttttatggtcggattaatcacgagacacagcgtccgctcaaagggctcagaaaatggatacatattgacatcgccaactaacttctgcaccgctagtttcggcaaaatgcccatccccaaacctgattccaccatcgacagaatgctttggtcatcaatagaataattaattgcattgcttgacacatggtagcggtccaacgcatttttggtatctcgatcatagtcaatctgctgcaaaatgaagttctgcttatcgacatcggcctgtgtcactgtgcggccgtttttaggcttgaattgcttgggcgtgatgcagtagatgggatcctttaataacggctccaccacgacgccagggccaactggtaaggaggaaaaaccaatgtcggcagttcccagtcggaccgcttcaacaatccggttaaaagtgccttgcaccacgctaatttcaatgtgcggatagcgctttttgaagcgacggataattgttggcagccaattcgtcgaaaccgacgagaacgcaccaatgcggatgcggccggtattaaccccattaatgttgtccgcaacctgcgtcagctgctcctcgagattctggatgctttgaataatcggcagcacctgcgccccgtcttcagttagcgccacccccgttcgattacgaatcaagagtgggaaacccagttctgtttccagctgactgacactatgactcacggcactcggcgttacattcagctccgccgccgctttcgctaatgtgccgcgctccacaaccttgctaaaaacttcataagaaaagttagccatttgcccctccttgatgtgacaccaactgtcacttcgttgtgataaatccttttagactaggaataacagctgttcgttccttttaaggtgaataaaattcatcataaactgaaatagttgagctttactcaatcatacaagccgttttacactagtgtcaataagaaaacgttggtacttcaccaaagcatcaacgtcataaagacgtcggcacccgttttaatcgcaaacgtcaaagggggattcatcatgaaattcgcaacacgtactcaaaaaactggtcattcaggtttagaagatctatttgctgcttctggtccaaatgtcatttcatttgccggtggttatccagatcgcgatttattcccgacaaaacaacttaatcaggcatttagtcaaaactttacaagtggcgatagggaattgcttcaatatgccagcacagaaggttacgaaccattacgtgccaagattgcagctcgtctgcagacgactgggatgcaggtcgacgccgatgacatcatgatgacccaaggcgctcaacaaggcattgatctagtggcacggttaatgttggatccaggcgacggtttggttgttgaagccccaacttacttaggtgcacttgctgcttttaacgcctatcaacccacctattacgaagtaccgatgccagctgatggcatggacatcaatgctttacaacgcattctaatgagtcgcaaagtcaagttcatctacaccgttcctgattttcaaaatcctactggggttgtgatgtccttggccaagcggcaggcaatcattcgcctcgccaaccagtatgatgtcatgattttggaagataatccgtatcgcgaccttcgttatactggcaaagccttgccgacgatcaagtcactcgacacagaaggacgcgttatctatcttggcagttttagtaaaatcctttctccaagcctgcgcatgggctggttggtcgctgcgcccaatcttttaaaagagttgctggccttaaaaggcggcagtgatctggaatccagcaatctggtaatgcacgggatcaatacctatatggaaaataacgatcttgatgcacatatcagggaaattcaggattgctatcgtgagaaaaagaatgccatggtggcggcgatgaagcgctatctgccagaagaagcgcacttcactaatcctgacggcggcttctttatctggctcaccatgccagccggcttcgatatgggcgcgttcatgaaagaacacctattaccggaagccaatatctcctatgtgccatcaaccaatctatatgcgacagcggctttgtccaacggcgcccggttgaacttcactggtcctagtctggcgcaaattgataccggcatgaaagctttgggtgcagcattaaaggttgctctgcaacacaatctggttgccgaacaagcctaggctataacgcgttcaaaaaaactcggttaaccttaacaaaatgacaacgtaacgatcacattttcgtcacactttgccggtagtattaacagcatagaagtgagccacccactcattcctaaaccccaacctaattttcatttttctcctccaaagaaaaatcggtgattggcccccatccgatcacccaataacaaaaacgcccgctgcgatggtagcgggcatttttgtgttttgaagacaaaaaatcgccgcacactttctcaaagtgtaaacggcgattaatcaaacatccatcagttgcttaaactaaccgatcaaccccgaagctggcagggtcatctttcttgtcggctttcttttcagtatcagtggtcgttgtcttttcggtctttttatcagcagatgcctgatcgtctttcttatcatcctgcttctcatcggtttcttcaggcttctttggcgcaacttgttcacgaatcttttcttcgatttccttagaaatttccggatgttcatccaagtagtgagatgcgttgacaagtccttggcccaaacgttccttgccatagttataccaagagccagacttggtgatgacgtcaatgtcattgtctttatcggttgccaagttaatcatatcggtattgtgttcaatcccgtgaccaaatgacatcgtggtttcaaccgatttaaacggcggtgcgaccttattcttagtgactttcagtttgctagcgaagccgacaacatctttgccgtctttcacctgctgcccacgcttgacttcaatccgtacagacgcatagaatttcaaggcacggccgcccggtgtcacttctgggttgccaaacatcacgccaactttttcacgcaattggttaatgaaaataaccagcgtattggtattattgatcgaaccggccatcttccgcagtgcctgcgacatcagccgggcttgcaagcccacatggctatccccgatggcaccttcaatttcagccttgggaaccaaggctgcgacagagtcaatgacaacaatatcaacagccgctgattcaatcagcatttcagcaatttcaagcccctgttccccagagtttggctgagacaacagtaagtcgtcaatatttacgccaagttccgccgcatacttcgggtccatcgcattttcggcgtcaatgtaagccgccttgccgcctgatttctgcaattcggcaatagtctgcaacgcaatcgttgttttcccagtactttcaggaccatagacttcaacgattcggccacgcggtaacccgccgacaccgagtgcaagatccaaggataaaatgcctgttgagacgacatcaaccttcagttccggtcgatcgcccatcttcatgacggcaccttcaccaaaggctttcttgatcttctgaagggctttttctagttcggtatcgcgatctgtagcatcggatttagtattatcattctttgcggtcgttttcttagccatacttgtctccttaaatgcgctcactggcgcaaaagtctgtatgtaagcaccttggtcacaatagctcaaccagaccacctatatcccagtctttaaccatgccagtgcacgctttgtcttataaaaatgcgccagcagttccaacaacctgtgcacgctattttaaacatatacatccgagtgtcaatttacgctgtctccattatcgaacatgcgtttgttttttgcaagcttttacgttaaaaaagtcatccccaaaaattgtttgcaggtgactgctttattttacctgatactgacacctttttggtaaaaatgacgcgttatttatggcacacaagcatggtatgatgagacgattggcttgatactacaaaaataggtaaatgaggaaaatgaaatgatgttcatgggttctattgtcaatgggttgacgattatcggtggcgggctcttgggcttgattctccacagtattagcgatcatgctaaagatactgtcaccaaaagtcttgggcttggtaccttcgcattgggcattcaaatggccttgcagacaaaaagttttattgttatggtcatcagcctttgccttggcggcttgatcggtgagtggttgcatattgaagatggcatgaaccacctcggtttgatgttggaacagcgctttgcccgcggcaatcagcattttgcggaagggttcgtgaccgccaccctgattgctgtcatcggtgccatgggtattttaggcgcgattcaggcgggcgtttctggagacaataccacgctatatactaaatccgtcatggacgggttcatggcgattatgctgaccgcgtcactcggggttggcgtgatcttttccgcgttgccagtgatcatttatcaaggcacaatcacactcttcgccagttttttagtccaattcgttcccaaggcattgatgacgaacgcactccgcgaaattggtgcagtcggcggcttaatgatcttggggattgggttaaacttgatgggcattaccaaaattcgtatttctaatctgctgcctggcttgctagtccttgttgcgatcctaactggtcagtattttctatgattaatgattgaaccatttaggaggaggctattggcagatcataaactgaccggtttgaacggttgtggtgataaatcagagcagatttttaccaaaaaaaacgaccccctgcttcactggcatgggtcgtttttttggtaaaagtgccgattatgattcagaaattcggaatgagccgctgcttttggcgatggaaacgatagtaaaccagtttgcaatgccaatcacgcacgacacccagcaagtgcgaattggcatcataataccagtagcgcagatcatcttttaggtactgctgattcaaccatgcatgatcgtgccgcaagaaagtataactttcaagcatgtcctgctctcgccaaacatcaggcaataagaattggctacgggtaaaccgttttaaaaaccgatctgaataataaacccgctcaatgcgaccgacaaacaatgccgtctcgcctttacccacatatggcgccatgggcacaacaatcaaaccaccgcgtaaacgttcaaaccagtctgtttgctgactgacgttaatggcacgtgtgacatccttgggtaaccgaaaatccaatactaaatcatccgggcgtcgaacccgagcaacgatgtgtcgttttttcatataaagttcccccaaaacaagtgagcgcgagccagcgtgggtgaaaccggagtgtaagcggccttgggcgtgatggtcgcactttgaccattgcgaccaaggtccttacacgcaggttgcagcgctggtgagcgcgttataacttggcctataggcgacttgtactaatggcaaaagtttaacactaaatgacctcatctgcattgaaaacgcttgtttcgacaaagtttttttaaacagttctgtctgtaaagcattgttctacgctcttttttaaatgtgaacaatgtcgccacaaaacgataaccaattgttggatttgtcttcacatttcgttcacaccctgccggtaatataggaaacatagaaatgagccacccactcattcctacaaaccccaacccaactttttcatttttactcctccaaagtagcaatcgtcgatcgtcccccaaacgatcgcaacaaaagggccgcccacccagcggtcctttttgttgcacccgatcacaagcaacgtgaaaaattcccaatcaaaaatggcctcctgaccgaacgtgtcagaaagccattttggttaattaacgattaaatagatcatacaatgcatccggtgtctgtgctgcttggaaactcttgacgaagtcttcgtgtgtcagcaactttgccgtattggacaagtacttcagatgactgccgctgtcatgttccgggatcaagaaggagatcacggcattgacaggcttgccgtcaaaggttttccactcaacaggttgcgccaagtgcaagatcaacatagccgatcgtttgatggtttcatcttgagcatgcggaatggcgatccctttttccatccctgttgatccttcctcttcacgggctacgtactttttaaaaatggcgtctgcgtcggtggcaagtccatccttgaccgccatgtcagctagataatgcaaaacatcatctcgcgtcttagcaggtacgttgacctcaataaattctttgttgagaatttcgccaggatcaaaactttgatcatcatcggtggttggtgcaggttgattgcgagcatcgtcgacagctattggggcagcagcgacatcgtcatcggcagcttcggttgctaacgccgcttcaacaacaccggtttttacaccacgttttctagccgaccgaccagcgatcatggcaagcagaacacctgatgctgcggcgcctaccagaatccatgcaacccagagaaatggcttattgaccaacggcaacacgatgaagccgccatgtggtgcaggcacctgaatgcgtgacatgtaagtcaaaacagccgcaattgccgaaccaaccatgaatgctggaatattcattaacggattcttcgcggcgaatggaatcgcgccttctgtgatatgcgtcgagccaagaagtgcattgacataaccagcactgcgttcatcgcggttataagctttcgggttgagcagaaccgaaatcgttgttgccaacggcggggcaatgcaggccgctgatacaccagccatgaagaagtaattgccttgtgccagtagtgccgtcccggtcagataagccgctttgttaatcggtccgccaaaatcagcggcacacataacgccaacgacaatacctagaatgatcgggctggagctttcaagtccttttaaccaagccattaagcctaagttcatcgccttcattggcgtattaatcaaaaacataattgatccggcaatgaaaacgcctaataccggatatagaaaaatagcttttaacccacggaactctctgtcaggcatgaaagcaaatgccttttgcaataataagatgaccaatccggccatgtagccaccaacaatagcgcctaagaaacctgacccgttgccgccgttataagcaatcatgccgactgccatcccaacgatcaagccggaacgcttagcaacagcttcaccaatataagcagccagcactggcaccatgagtcccattgctgcaccgccgactgcattcagcatggctgcaaactgattgtattgagcgttcttgggatcggcagaataaatgccccagaagaaggaaatcgcaatcaggacaccaccggcgaccactagtggcaacatgtgtgaaacaccattcatcaaactcgtataaattttgttcccgatacttgctgaactagtttcggtcttttcaccggcttcagccgtggctttgccacctttaggcatgaacaccgccgtatcgctgcttaacgcttcttgaatcagtttagccggttcgcgaatgccagcagcaactgggacattgaccagtggcttgccagcaaagcgatcggcgtcgacatcaatatctgatgcgatgacaacccctttagcgccgctgatttcttcttgtgtcaacggatcgtccaccccggtttgtccgtgggtttcgactttaattgtcaagcccattttcttagccgcttgttccaaggcttcctgcgccatgtacgtatgagcgataccagttgcacagcctgtcgcggcgattaaatcatactttgccattacttaaccctccatcttgcgaattttgatttgtcctaacaactcatcggtatttgaaaaatcagtgatccatgcctgtcgtgccgtgtcactgccagccgcaatcgccagtttcagcgtctctgccagatcatgatgctgatacaacccggctaaaaaggttccaagcatcgtgtcgcctgcaccagccgtgtttagaacggcaattttaggagcattgccaaccagcgttacatcctgattcatgaacaaggcacctgccgcaccaagtgacactaaaatgttctgtgccccagcttccaatgcccgatggcctagcgtaatcatggtcgttaaatcagcctccccggtctggtggaaccaattcatcaactcaacatcgttcggtttcaccaacagcggcttgtaagccaatgcctcaactgcttcaggatacgcactgtcaatgatcaactggaatccattttttgggctcaatgcacccagctttaataaaaaggctggcgcgatgccttgcgcaaaactaccagacacgcataaccaatcgtctgaccccagcgtggttaattgttggtataattgatttaatgtgtccgcgctaatctgcggccccggattgaccaacttatactccgtatcggttgtcacaacccgcgcaaagacattaatccgggtaaagccagcatccttataaaaatgatttggcacaccttgttgcgttaaaaagtcggcgatgtaatcaagcgtaaacccagcaccaacgccaagcgccgtattgtccacgccacgccgtttcaaaatgcaactgacattcacccctttaccattggcttgcacatcataactatcggttcgattaaccgtatttggcgccatctgttgggttttaataaatagatcaattgcgggatttaaagtcagggtataaatcaagttaagcgctcctttgtgtcgtttgttttgcttatccttatgttaaccgctttcagccgaaaacggttttcagtttcaggcgaatctacgccagtactgaaaatgcttttcaggaggtcaaattcatggctacactcagtcccaccgaagcgtacctttgggattacattgaaaatcatcagcaagccgtcgttaacgcatccatcacccaactcagtactgcggccaatgtctctcctgccaccgttgttcgcaccatgaagaaaaaggggtttaatggctataccgatttccgccacgatttgctaaaacgcacaggcgatgccgcaccgttcagcattcttgaccaagttgacgaccaaatcaaaaaagtcattatgcaaaaccaagtggaagtctataatacgctggaaaatttgaaggtttctgtcattgaagactcggttcaattgctagctaaggccgaaatcgtcctgattcttgcgcgcggcttatctgaatcaattgcgtcggaagtcactttgaaattgcagctcttaggtaaatacgccgagttttttagtgatccgaatatcattcaaacgattgccggtcaggtcagcccgaaggcagtcgccattactatcacgttgaatggcgaaaccccagagcttgttgctgcagcgaaaactttggcagcgcgcgacattccgcaaatcattttgacaaccaacgcagaagcgccaattgtccaatatgccgatgagttatttgtcgggtacaaatccaaagccgcttacttcgacaaatatgaggtggcatcacgcctgccgctgcaagttatgagccgtattttgctggatagttatgttgtgcggaaacgtgggcagaaaagttaacggtcactagcaggctttgataacttgctcgtaaccacataaaaaggcaatgatcacttgagaaaacagtgatcattgcctttttcacttcatccaaccatcaactatgcttttggtagcggccgatgtttaaatagttgtgtagcggcgaccgcttgttgccagccagcgtataaattctcgcgccgggcttctgacatctgcggttcaaaccgcttgccgatcttgaaaatctttttgagttcatccgtatcttgccagaagccaactgccaatccggccagaaaagcggcgcccattgccgttgtttccaaatttgccgctcgttccaacggcttacctaaaatatcggcttggaattgcatcaagtaatcatttttagcagcaccaccgtcaacacgcaaggcggggacagcgatttgggtatccttatacatggtatcgaccacgtcgcgcgtttgataggctagtgcctgcaaagtcgccttgatgaaatcggttttcgtcgtgccgcgtgtcagcccgaaaaccgcaccgcgggcttcagcatcccaatatggcgcccccaaacctgtgaaggcgggcaccacatagacttcatcattactggttgacgcattggcggccgcctccgtatctggtgactttgcaaccaaccccatttgatcccgcagccactgaatcgctgaaccggcgacaaacaccgagccttcaagtgcgtaattaattttgccgtcaatgccatacgcaatcgttgtcagcaaattgttcgcggacatggttggtttttcaccggtgttcatgacaataaatgagccggtgccataagtattcttaaccataccgggtgccagcgccaactgaccgaaaagcgcactctgctgatcaccggccatccccgcaatcggcacagcactgccaaagaagtgatatgccgccccttcgccgtaaatttcggagttactgtgcacttcaggcaggatcgcgcgcggaatattcagcagttgcaggatgtcgtcatcccaatccaacgtatgaatgttaaacaacatggttcgacttgcgttcgtataatcagtcacgtgaatagcgccaccagacaacttccagcttatccacgtatcgatcgtgccaaacaataattcgccattttctgcgcgctgctgggcaccgggaacatgatccaaaatccaacgaattttagtcgcagaaaaataggcatcaatcaagagaccggttttctcatgaatggcatccccatgccccgctttgcgcaactgttcagcaatgccattcgtttgccgtgactgccagacaatcgcgtgataaatcggcaaaccagtctttttatcccagaccaccgttgtttcacgttgattcgtgatcccaagtccggcaatttgactaggctgaatcccggtcgaaatgaaggtgtctgcgatcgttgacaacacggcttcccaaatttcattagcatcatgctcaacccaaccaggttcaggaaaatattgggtaaattctttttgcgcctcacccaccatgttgccggcgtgatcaacgataaccgcccgcgtgctggtggttccttcgtcgattgccatcatatacttgtctgccatttctgtatccccctgctaatgactgttgccgctttcaattcagtataccggatgtagcggaggaggttaaggttcagatggtttaaaaatcccaccgcctcaagtttagccttattgcaacgattagatccggcatgctataatgaagatacaaagaggggcgctggcctcaaacagcactccctaaaaagaccgtcaccaaaacttcgtcaaaaggtttggtgacggtcttgttgttgtctaagatttgaaattgacatcgttgcgacgccttgatactgcatgctataatgaagacacaaaagggagcaccggctaggaccagtactccccctgacaaggccgttgaagacggtcgacattcgtttaagcaatcaattaagaccgtcaaactcgtcaaaagtttagtgacggtcttttttctaccattagtcaagaaaaagctgatttgatcacaattctcttttctttgcactttgattttgaattgcacgctctacttgggtcggttctacctaagttttggcgtacactaaactaggcctcacagatattgactttctgaggcggtacaattcgtctaagcgagtggtgatttactattcgggcatgaatgttgttgaatcatacaactcgttgtttaaaatcaggtggtgcatgagccggttaaactgactcattgcggcgatggcaattttcttagtcccgtgggactgagcggattgcttttttcgtttgtagtttgcgctgatcagcgtcggttgatattgcgagacgctgataatgtttaggattgccctgtacaaaatctttcgggcatacgggttcccacgttttctaatgtgcatttttgcttcgtattgtcctgactcatagcgaatcaagtcaattccaatataagcattaatcgcattggcactgtgaaaacgtcgcacgtctcccagttctgcgatcaagcatagtgctgtttttataccgattcctgggatcgaaacaaggagcggcacttcgctgaggttttctcccaaagttgtcatttctacgattatctgggcctttaactgattgatgcgttcaacttctttagccaaggctataacagctctgacagcgtgtgactgtggctcttttgccgacgctgagttttgagctaaggccaataaacggttggccagtttcatagctcgcttgaggcctatctttttagaggtctcggttaagatgatttctgtcagttcattctcttcgtgagacagtacgatcgctgggtgcggaaatctttgaacgatgtgccagtagagaacaccgtcagtcgagctcataaaatgctcgatttccggaaaggttagctggagtgctctatgcagacgattcttgttggttacaatgtctttattaaactgctgatacgtccgctctagatcgtgtaactctgtataaactgggctttcctgataggttggcctgaagtgatttttgatcatcgctctggctaaacccaccgcatccagcgcatcagtttttgtatgcctgaattcttccatcactttctttgcggctaatggattgagttctgtatatttccagccgtctcgctgtagaaaggcacgcaaacgacgagagtacatcgcggtcgcctcgtatatgattaggggtgcgttgaagctattgagttcatcacttaatagcgaaaatcctaaccgatctaacccaattttaaattgcttgataacgacgttatcaacaagtaccgctacattggcgttctctttactgacatcaataccaaatacacattccatacaacaaacaccacctttgaagttgtttcaccgattcactcatcccaattttcaatacacggcgtcttgcgccaacagactgcgaacgagtttcttggtgggtcaagcgaagttgccagtttgatttacgacgtcaaagcgccaaaaagacctacggcatgtcaacttcaacaccactttatcaaaaaagaaaagtgacgaaccaagattccgtcgagtcttggttcgtcactcatgttagtctgtttgattgtcaagaattgcgcgaacaaggatcaccacggattttcgttttggttgtcttgtgctggtttttcgtgctaaaataaacacataaagaggcgcgcctgcaggtaatagacacgcccctagcagagccgtttaagacggctggcattgaataacaatcaggaaagaccgttagacttcggccagaaatctagtgacggtctttttgattgtcaagaattgcgcgaacaaggatcaccactgtgccaacgagtaacagtacaaaactgccaaacgctaacataatggttattgcatccgcaacggacaaccagacacctcccttcactggattttgtgcgtgactcataagcaccaactcctgtgattggatttgccaaccgtcattaacttctctgctgtcgctatcataccatacaattcgggtggacgcttagagccgtaaaggttacaggcgttttttattttccggtttgagcaccttctcggacacatggacaatcaataaacattacaaataatgactatccttccacgtcaccaacgaactgatgtcatgaaccgcaacagataccttggattgcctttccgataccgagataagcaaagaacccctttgtcttcctcacggcggtgccctttttacctttccgactcatttctacaagagtctatcattctggctggcaagtagttgtcgagatcaataatttttcctacttgttcgctacgtatttgcgccagccaataacgccaaagccacagacaattaacgctacgagcccaatgatcggcaaactgttcatcatcatctcgccagtttttggaaaagcctttgattgatctgtctctgaatgctgcttctttttgacgagcgtctctgacttcatcattttttcaggatcgggcttgtttggtgtaccgggtacatcgtccttcccatcaagtgcctctaacgcccttcgcaatgccgataccatgttattaaccgtgagttgatcagcaatttgattggttaataagctttgtgccttggcaagaatctgatcaaaagctgccttgttatctgaacttgccttaagatatttagccttctctttaaccgccagcgcttggtcaatgactgtctttaactcgcctttttgcacaggaatagttggcttggttgcctcaaaagctccaattgttggtctttcgaaattaattggtttccctgaaaaatcttgagtaatcggaaactttgcttgaatagctgcaggtgttagctccgccacgctgcggccagcattggcaacaggcgaacctgctatgggaataaagctgcccagcgattcaacagacatgctgcctgtattatgattgatcaggccactaggttttgctgttacatctcctaattgcggatcgacaaataagttgtcactcacatcaaccgcatcagtatgactctgatcaagtaatgcttgtgggtagaaaagattgtgatctacgttgccttctgcaaatagtggccgcttgtttccagcctgattaacaacaaatttaggggtattacctgctggtgcatagaccaagttattcacaaaacgaataccagtttggccattatttgaaaccattaaatttttcacagctttaccaacgataaaggtgttgttatgaaacaagggaaaaccagcaataccatcatttttccctgacaccacaaaaatcaggtgattgagcgcgggcgatggcaaatcgcttacatcattgacgctcaaattgtaccggaaaacattatctgtttgatggtcacccataaacaaagtgaaaccacccgaattatcatgggagtagttatattgatacacgcctttagatgcaaagccgtcaaagtcaaaagctgctccatcaagataatggttgggaatgccaaacacttcattatattgggccagattatattcaccacccataaaccacaatccagcaaagtttttgctcgcacctgattcgttcttagatccaggcatgctgttggctgcttctaccgtgttgtattccgcagtcccattctcgcttgaactgatgacaatgccatcaccggcactatttcgaatataattgttcctgaaggccgtatgtgcactcgctctaaaggaatattggtcccagcctccagggaggactgacgcattggcatcattacgtaatccttcatttgaaacatccgtaatcacgttattctcagcagtgacgtctgtattgccaacgataataatcccgccagagtttttgccagatggcaccatttttcccgtctgatctggaactggatcactttgataggcaccgtcgacatgatgaacattgttgtttctaatattaataccggtacgatgtgaggctttgaaaatcgctagcttctgttgaatagacgcagcatctgtcccacttggatatggtacattgatatccgacgctaccaaaataccaattcgcatcgcttgacgattgccatcattcgaaaaattggtcacctctatattcgagatcgtccaatgattcgcattccaaagttcaacagcccccgtcattaaattgatattacttaaattacggtgatggtatggactttgattcgcagttgttcccataccattaatgattgctttttttctgacatccccttggtgatagctgccgataacgattggctcggaagcggaaccttcaccattcttagtgccatcaagaatgagttgaccattccagataccattagcgtcaaatagaatttgatctcctggttgaaatttcgtggccatcacttttgctaatgatcgccacggatgatcaacggacatgccatcgttgttgtcattgccattgttggcaatataaaagactcgattttcagcagcgctcagtcgatttactttgccactagccgccacaaatagcccaacggacaatgccaacaaaaccagcaaaccaacgcggattgtctttgatgtcttcatcatactccccctcatagcgttatctttttaactcagcttttgttttgacaaggctgctttgtttacctgaagaacagcacgagcagcttttttggccaaattagcatttagccttcttcccaacaacttgactgctacatcttcctttaccgttgaaaaatcataataaccgccattggtaacagtaattggtctaacaaggctcatggtttcgttagatgtccatgcaataaaaatgatgccttgctgaacgtcaccactgttagatgcacgtaagtagttaccgtagtacttatccttatcatgactcgaatcggccatcacgaatgttcctgaaaaaccttttgacgcaaaatcattttgaatggttgataaatcgctacttttgccactgacttgctgtaccaaagccgtgaatctacccagatcattgatcttttctcgttcaaaggttaatgcctggtagttaactaagttgggctttccccaatacttatccttattttgagaatagaaattttccaattgttttgaagtgattgtttgccgatatttctttgcatactgagatctgagtctcatcatcagggcgctgtgtgttttttgcgctgcagccatgccagaaagacttgctcccgtttgatcagctttcttcaaatctgtgaaagctaccaatggcttttttatcagaccagccgtcacaagcgccttgtcctcaacaatatattgtttaagtgtcctcaatgccttgtcttgtgcaaactgctgtggtgtctttgaaccatacttcgtcagccagaagtgctcgttatatgttgtgtgatacttcgtcatatagtgactcactgtgctggctttttcgttctgcaagaaatattgatagaccctttgcgaaacaggaacaccggcaacttctaagaaagacagcgtgtcttttgcctggcaacctgcaagcatgaagaccaacgtcagtaatccgattagcaatttgttaacctttttcgttgtcatcacctcaactagttgtacgaacctcactatctcagcattttgcttgatccttttaacaactcgttttcactacaaaagctgaaagtgcttttccactcgttgaccctttcgcttaaaaagattgaagctcccataagcctcagtcccatcaaaccaatacagcttgcggccaacaatcgtattctctgactgtaaggtcaccaaataattcacatcccgacccagatcaacccgaaatccggttgctaactggtcatcaacgatctcatcatcgttaccagaatggcgcacttggaccggcgttaccgctatgtcaggattagccggtgaaaaaactgcgacttgtgcggtaaaatctttgaatagcgtttcagattccaatcgtgtcagatgatcaagagcattgtatcgtggtgagaacaactgccggcttttccatatatttctctcagtaacagcaaggctagctacgttgcctaactgatacccttccgcttgcttagtcactgtcaggtcaggcgcaatctgccagaaacgtttaagtgtgtgatagccagggtcgctaacaacgtccagtatcagccgcaatctctcctccgcaagattgattaaataccggacaaccatcactggtgtttgctgggcgcgatcaatatacactgccttaatcagctggccggcgctaaaatcaatcacctgattcataacaggtgtggcagcatactgatacttccatgagtcctttggcaaactgaaaggcttgtgatctagcatcacagtgttatgtgcttcaacggatttcagataacggcgttcggtgccatcaacgtacgtatatctaccgccgtcaacaagtacatcatgaccgtccatcacgagatcaagatgtcctagggccgcgtgaccatgaccactgccgagattgccgttaaataaatgccaataatcagcgttttcaccccagtctgagcgccaaaagtaattgccgctgatcggtgcagcaaattgttggggaagttcggtttttttggctgctagttgccacgcttgatgcgccagttctaataaaacaaagtcgaaaactggttctaatcgatcttgcaactgtgctggctgacttaagatagcggcggagctgttgaacaagctgtcaatccgaatggcatcggtatcaccttgctgtagcaatgtcagatcgggtttgacatattgcgccatcatccgctgcatggcacgggttttttgtaaaatattcggggccaccgtctgcttggctcgttgctgagcagcaatgaccgccaacgaactgcgccaaacttctaacaaatatagcggcgattgttcccactgcatgccttgcgtgtccacttgaagatccagttctacctcaaatcgctgttgcgcccaggtaaccgtgtcgcgatcaacgacgtcagggaatcttgccgcatacgttaaaatacctgacgtgattaagatgccccagttactgatatcaaacttttccgtgtagttttggcggagatagtcagcctgaaccttcaccgcatcatgaacagaaactgactccgatgcatttaattgctcactttccaccagattggcgacaacggatgtccaatttaataatcgaatgcctgtgtcaattgttcgccatgtttcgggtaacgccaaattctgatcgatccaagaaaaaagaagagctttcatttttgtttgatatttaacttgaccagtcgtatagaaagcttccaaaagatccaaaaggtactcttgacgttttaacatgtacagccattcaggatcgccattaggcgtctcctgccatttaattggatccatagtatagctgatttgggtgggttccatcgcataaggactatcgaacaaaaaagtattatctaatagccgatctgcattcgtctttgcgtctttagtgagatgttgttgctgcgctagttgctgaatgtaccttgcccaactctgctttgtcatgccctgacacctccttcaccaccccagcaattcccatccgcttaaccgttatcactgtcttttcagcgatttcaacctgaacatcttcttgattcaagctttgtatgttacctaagatgccatcaatcaggacaatttgatcgcctatttgtaaattagcgtgcatctgatcaacagcatcagcttgtttttgcatggcatggcgttttgccagaggaatggcaaccaaataaagcaggcaaacaaggacgaccatgatagctaaaataatttgccagaaggtcatcagataccatccccttcatcttgatgtgtcatatccggaactggcgccgttgctgaatttgtgttcatcctgtcgggcagaatctcaatcagttgttttgaaagcgtcaaggtgtgctgcagctcaccttcaatcgtgtcatcttcaaaccccgtcaagcttttggcatacaaatctaacatcaaattgagtggtgcacttgagatcacatattgatgtggctgattgccttcgagaaccaaacgcgacacaatctgatgtggcgcaccaccagtcatgtcggcaaaaactaaaacccgttcatgctcactgagcagctcggttaattgtttttcgaatttttcatgcgttgtttgttcatctaagttaaatgccttgatcccttcagttgtaccgatcaataactggagggcagacaagacaccatccggatagcggccatgacccacgatcactatttcgtaattcataaatgttgactccttttttagttattcggtcgtcaataaaatgttgatatttcttgtgtttgcctactcctgaaaacagccgtctacacagtatgtgacggctgtttggtatgagcatttcacttcaagatgcctaaaacggagagcaggacaccggcaacaaatagcagaatgacaattttataaatcgtccacttcttctttgtgatcagccaataaacaaaatacgtcagagcaattggcaacataaacggcataattttgtcgagaatcgtttgaacggccacaacctgtgttttccctttgataacttgcgagtattgccatgccaaattcacttttacaaaggacacagacaagccagcaataacggttagccccaacatgctcgcaacatcagcaatggcagccatccgatcagatagtgtatcaatgatgctcgtgccgactttccagccgaggtagcccattagcatacgaacgccgaaagtaataccaaacagacacaagataaacggaattggcgcccaagtcatgccctgcaatgcaagtgacgcaaagattgagctgaataacggtgccagtccaaactgcgacaaggcatctccaatcccggctaacggtcccatcaacgcgaacttgatcgcgcggacgtcgtcttcatcttgaccactgtcatacatggccaacataatactgctcacaaatggataaggttgcggattggtattgtaaaattctaagttagacgttgttacccgtttaaattcagcttcatcatttttatagatctttcgcagttgtggcatgatgctattggccatcccagttccttgcatcgtgccgtaattttgtccattttgcagaacataagatcgcaaaatggagtttaagtaatcttttttggttaaaaccggcttccgactagatgccatcttcaatacccccttcatccccgtcactaccaagatcatttgtgctagtactgccgcctttgttcttgtctgcccgccgaccattatagtaattgttgaaagccagaacggcacccgcgaaggctaaaccaataaccggcatcttgagataagccacacagacatacccaagaatcaaggccggaatatattccttcttagccattgtgctcataatcagcgcaaacccgacagcaggaagcaacccacccgcaacagttaaaccgctaattagccattgtggaattgcctgaacaaaaactttcaaagcacttgtacttaaggtagccgcaaagccaaaacagaaggcaaacaagatgaaccctaataatgttgtgtttgccaaaaagtggaatttacgatactttccctcttcaattgcttttcttgaccacgctaggttgttggcgttgaccgagaaaataaacgtaatcacaaatggaatcaaaattgcaaatggatatgatagcgataacgccgcagctggtttaagtccgctgattgagatcgccatgattgtaccaacaacacctggccccaatggattaggtggtgtagaaccaccgggcccaacgccgaatcccataaacgccaattcggcagtggctccaaaaacaacggctgtttgcaagtcgcctaggattaacccgatgccaaatgagataaataatgcccgattagtataaatgccccattgctggccggcaaaacagaaagccgcccacaggcctaccaaaagcgcctgaacgatagaatatgtcatgctctttcctccctaaacgtaaacgcgttcgcaggcgcaggaacctgcacataataaggacccccaagcctaaatggccaaagcccagccttttaggcttggggccacttaggctccggtttctaaccgcgcctgctcgcgctcttcaaatatcagtgtgtcgcaacataatcatttaaatcgaaatccgagccaacatcattgccaagcggtgttgtgcgggtgttcaaatttgcgtgatatttttcatgcaatgttcttaaagcattgagatcatccgcatcaactgaaataaaattcgttaagcgcgtcttaccatctttcatatggatattccccacatttagggccttaatcggcacaccgccttcagccagcttcaaggcatcttgcggggttttaacaatgatgaaaattgtttgccgcggcgctgctttgaaaatcttatcaatcgtttccgccagtgagaagaaacgaatgcccactgattctggcatcagtgaagccatcaattgttgttgaatatgactcttcgcaacctcgtcatttgcaacaatgacaaggttcacaccaagattcgaaatccataaacgcccttgtccgtgaatgagccgctcgtctaagcgaactgccttaatgtttggttctgccatcaacatttccctccataacgcgctattcagtctataaactgactggcttgcgctctgtctaaacgcgttcacctgcccaaaaaccggattggttcacgctcaccaatataattgccaatctttataaaatctgatcaacgcttccatgtaaaaatagtctccccagagattgccttcatcaacaccatggttggaatgccaagagtaaacgccgtggcgtaataacggttcaacggcctgaccgtccacgggcatcgcatatttttgaatcaacgactttaactgagcatgcatggccacttgataaacaaatttatcaggatcagcttctggcaaatacttcaacatttcgtgcataccgcacaccgcgatcgccgccgatgaagtgtcacgactttgaccgctgcctgcttgaaaaatgagatcccaataaggtacatgatcaggtggcaatcgattcaagaaaaagtgggtgaccgctttgaacgtctgaaaagcgccagcatcatgtgtatcgtaataatgcaacgcggtgccataaatcgcccatgcctgtcctcgcgcccaagccgaatcatccgaatatccctgacgtgtcgcaccgcgaacaggttcgcctaagtcattgaagaaatatgtgtgaaaggttgaaccgtctggccgaaaaacagtttgtaaagcggtttcataatgtcggtcagcgatttgctgatattgatgattacccgtgactcgagttgcccaataaagtaatggaatattgagcaaggcatcaacaatcaaccgattttcgtctttagcgcctttttgtccccacgcctgaataaaaccgcctttatcattaaatcgcgtcaataattgattggccgctttgatacccgcttctttagctagttggctccctgtcaattgataggcacttacaacggatggcgagtataagaagcctaggtcatggtgatcaacagcgattcgctggtcaattcggtttacaaaactttgaacatttttctcggcaagcgcacgatattggtccttacctgtatattcgtaagctagccaaagcatccccgtccaaaagccattcgtccattccgtgtttggcatagcggcatagcgctcttggactgtggaaggctccggacagctttcacccaacacctttatgttcaagtcgaggtgccgaacaacgttatctaaagcgttagtgaccgcatgaatgtcaactgcgccggcattaaagaaacgctgtgcattggttaaaggttcaattttcaatttgctatctcctcgacgagctcacaaccatacgcttctatttcgatcaacgccggaaacggtgaatcatcatccgctttaatcaaatccgacaattgaagctcgctgatcccttctttgttaatatcgaacatttgccgttgatctgttttagtaaagtgaagcagcatttgactgccgtctgagagtcgcaaggtgccttgtgtccaataactatcgtgaggaaaatccgcgcgtaatgtgatcgctaaacgcgttagcttgatcggacgcccaaatgtgagcgtgaaccttgccgttgggtcttgattgatcccccaagactgatacggaaattttccataatgatcattgagacgataaccgtcaatggcattacgcgcggcaaaagttgggtcatgccttgtttcgatattggcacttgcatgtgggtaagcaccggaatgtacagcctgatcgtgactattaaacgccacattgcgttcttctgatacttcgctcgcatctggcttccagatgcgaatgagatgtgttttaccggcaaaagctgtttctggatagatactttcgtgctccggatgggtcacggcaagctcgtcagttggaatgacataatgccatgttgactgggtaaaataaagcaagctgggcaccaatgcggcatcgacttggacccagaagaaaccaggcagaagctgacgctcaaactcaacttgcacataatcaccctctgcatagacatgatccaagcgcagataaccgtcagactcaccgtttcgacttgtatcaatcacttgatccgacgccgaaagcaacgcaatttccaaaatagccccctcctttatttccttataggaaaccctgtttctttttgtttacgagtgtatcttaacgtgcattattttccctgtcaacaaaaaaagtaaacgtattcacaaggcgattatccataatgtcggattagtattgatttttttgctgattgtgactaaaatgatcagtagtttccaaataataaactcttacaactggagggatacgcatgggcaccacaacaaatgagtcaaaaccttatgggaccgtgctgatcaaggctaaagatattttagatttcctacttgccactactgatccaccaaccttatctgacattagtcgcggactgcatgcttcgaaaccgaccattttaaagatcttaggaacacttgaatcgcttggctttgtttggcgggataccacgacaaaacaatattttctcggcacgcagtttgtgccatatgcgcagaaagcaattgccacttttaatattgtcagagtcgcacgtccttatctcgaagatttgcgggataagacgcaagaaaccattaacttagggattgtccgcgataataagatgatccttgttgaaaaattggaaagccccaccagcatcaagttgcaatcaactattggcggaagcatgaacatgtactcgtctgcaatgggaaaagccgttctagccacgtatgatgccaaggaactacaggcttacttcaagtctcacaaactcacgcccatgacaccgcatacgatcactacacccacaaaacttcagcaagatctaaaaacgattcaagagctcggtgtcgcgatcgataatgaggaaaacgaggaagaagtttattgtctcggtgctgcactacaaaaaaacggtgaactttatggtgccttcagcattagcacaccgaagtatcggcttcccaaggaacgtcgagctgcctttgtccgcttgctgttggacacacgccacgcaattgaaaataccctttaactttcaagatactttttgaaattgtttaccttacgcaatcaaaacaaacaggccccagaaagacattgcctcgtctctctggggcctgtttagtttgttcaatttctcctgattttttgttgaatcgattcttttcgttttggacactcacataaaaaatttgctttagtggcttgtgttctttttgaaaacgttttatattgatgaggtagcagaaaaggaaactatgtttctatataagaaatcatggaggggattattttggctttccacatggcaacacgatatgcgcacagtcccgaagacattaaacactttgatacaactaaattgcgccaagaatttttgatggagaagatttttaacgcgggtgatatcctgctcacctatacctataacgaccgaatgatctttgggggtgtggtccctactgaatcttcgctggaaatcaaattatcgaaagagctaggggttgatttctttctgcaacgccgtgaacttggggttattaatattggtggcccgggatctattatcgttgatggcgataaagcagcaatggtgaagcaggatggttattacattggcatgggaaccaaccaggttgtctttgcatcagacaatcctgccaacccagcaaaattctatgttgtatccacgccggcccacaaaacttatcctaacaaaaagctgccatttgcaaatgcgctggccaagccaatgggtgatcaacaacatctgaataagcggacgatctacaaatatattgacgcgtcacaaatggctacctgtcagctgcaaatgggctataccgttctcgaacccggctcatcttggaataccatgccagcccatacacatgcacgacgaatggaaacttatatgtattttgactttgccgaaccagacacccgtgtcttgcatctcttaggtgaaccaacggaaacccgacatatcgcattattcaacgagcaagccgtcgttaaccctagctggtcaattcattgcggtgttggcacgaccaactatgctttcatctgggcaatgtgtggcgaaaaccaaacctatgatgacatggatcaagtacccatgaatgaattacgttagcaacagataaccctatcaaaaaggagcaatacacatggctgaaattcatcaaactgaagaagaaatccggaaacacgagcaagaactggatcatttcaaaatgtcacaatttaatctcgcgggcagggttgcgattgtcactggcggtaacactggtttaggccaaggttacgctgttgctatggcggaagctggcgctgatatctttatcccaacctttggcaaggccgagtgggacaacacgcggcgtttaattgaaaagcgtgggcgtaaagtcgcattcatggacgtcaatctcaccgcgccaggaagtgcagaggcagttgttgcagaagccatcaagcagatgggccatattgatatcttagtgaacaatgcggggatgattcgccgcaatccactacttgaatccaaagataaagattgggatcaagtgattgcgattaatttaagcagcgtctatcacttgtccttagcagtttcaaaggaatatgccaaacaacgatctggcaagataatcaacatcggctccatgctctctttccaaggtggcaaatttattccttcttatgccgcaagcaaacacggcgtcgcaggtttaacgaaggcttttgcttcagaaatgggtgcgtataatgtccaaatcaatgcgattgctccaggctacattaaaacggaaaacaccgcaccgattcgcgcggacaaagcgcgtaacgatgaaattttggaacgaattccagctcgtcattgggcagaaccttacgaactaatgggcattgccgttttcttagcgagtgatgcttcaaactatatcaatggcgctattattccagttgacggtggttatttggttagctgaagtcgttttgaaccattttttcggttaagtgtattgacttcgattatgacgtatcgtcctgcttgaagctcttttgcgaaaaaaccatcctctggaaagaagaattcatcatgcaaaaatatgattttttgaatcggttaattgccactggctgtgttgccgttgttcgcggtgataacacccaaaccgctattaagacttgtgatgccgttattgctggcgggattaccggcattgaactaacttttacggtgccgcatgccaatgaagcgcttgagaccttaaccgaaaaatacgccggtcgtcaagatgtcgtcatcggtgcaggaaccgttcttgaccccgctactgcccgacttgccatcatcgctggtgccaagtttattgtgagtcccagttttaatcctgacgttgcaaaaatatgtaacctttacgctattccatatacccctggcgttttcaccccaaccgaaattcaaagtgcccttgaagtaggcgtcgatcttgtcaaaattttccctggcagtgtcgccgggatcaatatggtgaaagctttacacggcccattcccaaacttagccatgatgccaaccggtggcgtttcattagcaaacgtcactgactggtttgaagccggcgtgatgctggtgggtgctggttctaatctcgtagatgacgccagtcaaggcgactacgaaaaagtgaccgtcaccgcacaacaatatcgcgccaaaattgcccaaattaaggatacaaggagatgatggcatgccaacagtactgacactcggcgaaatgatgctgcgattaaagcccaccaatcaacaacgaatcctccaaacatcagcattcgcggctgattatggtggcgcagaggccaatgttgctgcgtcgctggctttacttggtgatcaagtacaatatttaaccaaactccccgaaaattcgctgggacacaccgcccgcaacacgattcgcggcctggatgttgatacccagaaaatcctttggggtggtcctcgactgggcatctatttctttgaaaaaggtgcaagtgtacggaatacaaatgttgtctatgatcgcgcgggcagttcttttgccacgatgaaagcagacgaatttgactggccagttttgctaaacgatatcaactatttttatttttccggcattaccccagccatcgggtcagaacaacaagcggccgtttttgctgcctgccagtattgttccgatcacaacatcacggttatttgtgacatgaactttcgtgaaaaaatgtggtcccctgaagcagcccaagcattcttcaaaactgtcatgccgtttattgatgtctgcattgctaacgatgaggactttgaagcaaccttgggcatcaaggcgtttgatgggaatatggcaaccggcattgaccaacttgcggattttaaagaaggtatgcttgaagttacccgacgctggccaaatgtccacacagtcgccagtgtcgttcgtaacattcattccgtcgaagaaagtcaatggaccgctctcctggttcaaaatgataaagtctaccaaggtcctacgtttgatatgcatatttttgagggcgttgcggctggcgatgcgtttggcgccggattagtctacgctctcattcatcattttgaaccacaacggaccattaactacgccatttcagcgagtgtcctaaagctgacaattggcggtgatctcaacttggtgacaaatgctgaagttgaggccagcatgaagactaatagcggagtcaatcgatagtgttttgcagtcattaaagaccggttagatttctggcagaagtctaccggtcttttttggtgcccaacgcacttcttcaagcagcttaccgatcaacgagctctacaaatacttactgccttcccgcattgccaatggtctgagcgaatgggcagccataaatgcgagcacccaatctgggtcaaacttactatactgccgcaaagaccacccgatggccttctgaatgaaaaattcattcgtatccaaatcagccaagatagccttgctaagcagcgccgtatccatcgtttctttttctagcagttgtaaattaatcccgatacgccgtaaccaaaaattcggttgatcgaaaaacaaattaaagacagccagtttctgatcagggtgcagcttcacatagtccgcaaaaaccttacgccaagcatccactgtatcccaccagcttttctgcacaacaagttgtcgaaaagcctgcatatccgaaaagtgccagcgcttgatgtgatcaagcgccaaatcaattgccacatattggtattcccgggcatcgcgttgatacaacgcatcaatccaaactcgaatcgttggtaagtcctcaccgcgactggctttaaacaacgttttcgtctgtgccttgcgttccggtgttttgagtcctaaaaatggaaattggttcttcatatacttcgccatttgcggcgcttgcgttggatcgccgtttagttcaaagtctaaagactgcatatgttttctccaaccatctacaaaaagtacgatgctctcgccaacgagaacatcgtactttttgaatgctatccacgatgtgcgtccagaatctctgggccatgtgttgtgccaacgaccacggttttgaccaaatctaagaacaagccatgctccacaataccgacctgcttattcagccattcagccagcagatgcgggtgctcgattttgcccagatgcaagtcaatgatatagttcttggaatctgtcaacgccttgctcccatcttcatttaagcggtatgccggtttaagtccttcgtcggccaaccgttgcaacagcttgccgctgccaaaagggatcacttcaagcggcagtggaaatttgccaagggtatcgaccaacttggtttcatccacgatccagatgttgcgggccgagttgatagcaacgatcttttcgattaagtgcgaccggccgccacccttgatgccctgaaagtgcttgtcgacttcatcggcaccatcaatcgtcaaatcaatctggccaacctcgtccagtgctttcattgggatgcccagcgattctgcttgtttgcgcgtacgaacactggtggcgacaccggttagattgagatgctcgtctttgattcgttgcgcaatcgcttcgaccaaataaaccactgtcgaacctgtccccaaaccaattgtcataccgtcttcaacaaactcagctgctctttgcgcggcttcctgcttcaacttattctggtccatggccaaccatccttttcgcttagttgccttcattataatatgaatcggtcgacagatggcgagttgtgtagaaaaagccaaattaatagatccgcaagtttggccacgcggcatcctgcttgttggccgcacgcctttacccaaaaggtacaaaagatcacgttggttgatacaaactcgtataaacaaacgatgccgtcgcgttcttgacgccattgacgaccaatggatactcggccaactgatatctctgggtgttcacaacatcgacttgctggccaatgccggaagtgtttttagccgtaattcgataatggccagcagcaatattggtttcgagtttataaacagcagcggctggtttcagcttgtacactttgccagtacttagacttgtcagcgttaccttcatgccagcggcttggtgaatttgaactgataggtaatttgatgcaccgttcaaactgatttcttcggacatcactgtatttggtgcaattagttgcggctttgcatgatattgcgtggagagttgggaacgttgcgccgccacaacgatcgtattcggatagtccttcgctaacaaccccgaaaacgtgctcagcccaagaatagcggccaaagcaaatccaactgccaaccgattgcgcgtccgtttaggaatgacaacacgtttgcgcgccgtattaggcaaagctcctagggcaaaaagaacaagcggcacgatcgcctggccgtatctttcttcagtttcccataacaaggtatggaaggcgagatatccaagtgcggtgacaatcgccaacagtcctatcaaggcagtttcatcacgtaaatctggccgccatgccagcaaccgaatgattaacgtcaaccaaagcacaatcgtgacaacttgataactcacggccgtaactgctctcagaaattgtgaatgctgatcgtaccaagtcggcgccgattgaaatccgccattgtaccagtcttggatggatctgacattaagtagaatccctattttgacaagccaaagcttcattaatccaaagacgccgagcttcttaactcgagtttgaatcgtttgaatgtcgtattgctcaactgcctgtttatcttttaaggtaatcgctttttcaatatccttggtgctatacatcccgtcagaatttgtattcacgcccattagcatccaagacgtaaccggcagttcatacgcagcatttggatagaaattagccgcagtatgaatcacctgtgtcgttggcacgctcaggccgaaaccagcaacaatcaaaagaaaaggcacagtcaacttagtagttcttagaagtttccgatgccacagaatcacaacgatgatgaaaagtgctggcaagagaacaatcaaatttggttttagcaattgaccgactaagacaagcatcgtcaagccgatgccagcacaaattcgttgcaggttactcttgattcgccatcgccataagatccgaaaaatcatgagtaaaatgagcatagaaggcagatcggaataaaagacctgtaaatagtaagtgtacgcgaagggacttaagactaggaatgtaaagccgcctaacacgatgctattgcgctcgctcaattgttgcaaagttactaaggtcatgatgataaatgtatctaacaaagtgatggtcaatatatgactcgcagcgttcgttgacatccccaccaagctcgtcaacctgaaccaaagcgagagcaagtaggtcagcgaaacattgttgggataacgccagaagtaagtcgtgttccaaatgttgtggcctgccgccatttgatcagcctgtgacaaaattcggtacggatcatggtaaatcgtgtctggcagaaagatcagaatcaaaacttgccccacgagcatcagggttaagccaattccgatcattatcctcatctgcctagcagtcaatcgattaaccaacggacctaagttgtgtgcagctgcgaaagtaacgacactgatgagcagaacaacgacaccccacaaaacagcaccagatttcattaaattgccgcaaatgccgataatcagacaaattgctaggaaaactgccatccatgaatgtttagccatttttgtcatttttatcacttctaatctaagcgggtttgaatcgtataccgtggtcgtcctttgacttcagtcatcattttaccaatatactcgccgatgacgcccagactcatcatctgcaaaccgcctagaaaccataaggaaaccatcaatgatgaccacccatgaacggtcaatccaaggactttcacgatgattgagtaaactgacatgccaaaagccagcatcacagcaagtgtcccaagcagaagaattaaccgcactggcgcaatggtgagtgaggtaatgccgtcccaagcgaaagcaagcatttttttaagcggatacttcgactccccggcgagccgcggggtgcgtctataatagacttttgctgtttgaaagccaagcttcgggatcaatccgcgaatgaacatgtttcgctcaggataagtgagtaacgtctgcgccgctcgtttggacattagacgaaagtcagcatgattgggtaccatctgaacacctagtagtctgagcagtttgtaatagccttgtgctgtcgtacgtttaaaccagctatcagtttcacgatgggtgcgcacaccatagacaatatctgcaccggcactgtatgcctgaaccatctccatgatcttctcagaatcatcttgcaagtcagcatcaatggtaatggtcatgtttgtggtcttaatcgcttccgtcaacccagcgatgagtgcagcttgatgcccaaaattgcgtgaaaaacgtaatccgcggatttttgagtgctgcttatggaaactttcaatgattgaccaagtgttgtccgatgatccgtcatccacaatcagcatatctgaatcttcggaaaggaaattttgggtaaccacctctcgttcaattgaccataatctcggcacagtgtcttttagcacttcttgttcattataggctggtatcacaattgttaacttttgcatgctacttatcctccctttgcggacgaaatgctgaacgttgtgctgcctgtttgacaatcaaagcatcaatgtatcttgcttgcggcagcataacgaaccaaagaccatttgcgagtaacaagctgccaagaatatcagaagcaaaatgatcgcgcagataaatccgactggtagcgaccatgccaatccagatcatactgagtaagattgccacaaattgattttcttgttctttaatttttggcagcatcagcattaacagactcagcatcagtaccattgagcacatgacgtgaccgcttgggaaactaaaacctgtgtcggcaacaagttgatgtatcggtcgcggacgttgaaccagcaacttaattagtaagagaaggcctgatccaagtaattgacacgcaccaatccagatgctgtcggatcgtcttcccttgacccatagatagccgcagatcgcggcggtcaaactgatcacaacaggcgggctgcccaacagcgccactacttcaaagatacgggtatccatttgagtatcatatttgatgatgccctgaacactgcgatccagctcaccgacccacgctgcctgcatcacaacagaccaagttagcaaggcaaacagcagtaataatccaccgcccaagaaatagtcttttttaatgttcatctgcagtcatcccccgttttcgtatggctatcacgatcatcgggaacaaggaaatgccgataattgcaagcatgatgagttcaaaatgtgctttaatgaatggcacatttccaaacaggtaccccgcgccagtggccagtgtcacccagctaaagccgccaagaatgttgtaaatggcaaaatctcgataatgcatttttccgatcccagctgtaaaagggacaaaggttcgcacgatcggtatcaatcggcctaagaaaatcgcaatatgaccgtactttttgaagaatgtttgactgcgttgaagatacgccggtttcataactcgtttaaacttttggctggtggtcaagtaagcgccaaaatgttcgccaatttcaaaattcaaggcatcgccgaggactgcagcgccagtcaaaagtccgactaacaacccgtagttaatggcgccattacctaacgccgctagcgagccacaaaggaaaagtagcgagtcgccgggtaagaatgggaatatgacaacgccagtctcgataaagataacgccaaacaaaatgacgtcaatccaattaccggtgtgggctattaatgacggtatcagctgattaagattggggataaagcttgtgagtaaaagcaatgccatttgaaatgccccctttggttggtgtttgctaacagcatctagcttaatcgtctaatcggttcatcactacctagacaaaataaatcatttctaaatttttttagttttctccatgctattaccgagaatagtgacatttttccttaactttttgacgcaaatcgttttgccaatcacgcaaaaacgccatctttttgcagatggcgtttcagctttcatttaattgatgccgttccttcgttgttgccagcggcaggataagttcggcaatcgttccataaggttggttgtcttgcaacttgattctgccattgttgatcgtggcgagctggttagcaatagcgagcccaaggccagttccgggaaccgtgcctcggacgttagcactacgataaaagcgctcaaagacatggcttttgtcttctgcactaatccccgcgccttgatcatgtactgccaatacagcattgccatcatcatcgcgcgtcaagttcaccgcaatgattgtatcagccggtgaatatttagcagcattcgtgacaaagttatccaaaatctgctcaatagccgactcattactttctacagacatattaggcgtcacgtgtacctcaatggtttgagaaaaagcactggccaatttttcagctaagtgttgaaccgtttcactcagatttaacaaatgcgtatcaagcgttaacctgtcagcgcgtgatagctgcagcaattcttcaatcagctgttgcatctgtctggattcttcagtgatatagttgaccgatttgagcacaatttcaggatgcgcccgcccatgccgctcaatcagttgcgcgtgactgcgaatcgtcgcaatcggtgtccgcagttcgtgggccgcgttcatgataaacaacttttgctgttcttgccgatcatgcagttgtttcaaaaggtcattgaagtcctttgccagatcagtaacctccgtcggtttatctggcacaggcaacatctccacaccagtctttgcgtgctccgctgcatgcttggtgctttgcgacaggtcactcaatggaccggtcaggcgatgtgccagtcgtcgaataaagatcggactgacgactaaggcaagtaccaaaacgatcatcgtgacaaccaaaactctgatcaggactgccagataactgttcatgctctgccagatctcataacggatacctttagcatgaacctcttggtagtagaacaatccttgattcgcttgatagcgcaactgcgtcaaaaacggaaatgatttcgccaattgaacttttttagtcgcaggcgagtaataatttttcaccttcgcatcttggcgcatattatgaacatgaacataagttgagctcgtatctaacgtgctgtttttgcgccaattttcccagtcatcatcaccgtcaatcacagtctgcttgaggcttgcagcaatatgatctgttgacaataccacttgctcataaagctgatggccaactgccgccacgataagcagacctagcgcaagggtcagcgtggccaccatactgactaacgaccgctgcatgatcgcagcacttgattgattctgctttctctttttcaatcaatcatcgcctcactaaatggatgcaacattagccgagagcatatagccgacgccgcgaacagtatgaatgagtttcttgctacctgaatgatcatcaattttatgacgtaagtttctgatatagacatccaatatattaggttgaccgtcaaaatcggttccccagacggcagcaagcaagtcatccctcgaacaagcttcgtcctgatgggcaacaagttcgacaagcaactcatattcccgctgtgtcaatggcataatcacttcaccgcgctgaacgcgtttgttatccgtatccaccagcagatcatcgacttgaaaaatagtcgctggtgagacagcctgccgattgtgacgcaaggcgacttcgacacgagcaaccagttcttccatttcaaaaggcttggtgatgtaatcatcggccccgccagtcagtccagccaccttgtcgccgatgtagtcacgagccgtcaacataataataggcacttggctggattgtctgattttccgcaaaacactaaacccgtctagtttaggcagcatccaatccaaaataatgacattgattttaccttcattgttcttaaacagcgtcaatgcctccgcgccgtcttttgcccaaataactgacatattctctaactcgaactctgttgttaatgaatctgccaaagcagcttcgtcttccactagaagcaatgttgatttcaactgatttcctcctaacgcggtcatttgaattataagcgcaagcacataaaaattgacactgctttaaaaaataagaaaaaatgagttctcgtcataattttcttccctgactcgtgactcattttaattgattgctgataccatggtcacccatccaaactttctgtacactgaatgaacagtgaagttcttgataaatcagccgattgtcattcctttgctgattcctataaacgttatgagtgtgctggaatctaagacaaaaggcgctaaagttccgaacatacaaactttcagtgccttttgtccatggagctttccgcgacctaagccggctaatcgcttatcaaattcgcataattacctttactttaatatgaatcgaccaactgatggcaagttgtggagaaaaaagtaaataaatatacgcccacaccagccacaccataactggattgttagcttgccaagatgactaattcttaataaataaagctcaaaaccattgaaagcgttttcaccacttgatacaatcacttctggcaactgcctcgtttggaggtgatcctatgctgcgtgatttcttcttccagattatcgccccgcttcttgtgggtgtgatggtcacactggtcgatcattggttagatggtggccagtaagccaactgcagttgcttactaacccacacgcctgattaggcccgcttctaaacaggtgaaaaaaatagccgcttccctggcaggggaagcggctattgtgcgtgatcctatattgctgatttcttttccaacacgaatgtatcattattttttctttttgtccatagggtctttcgtgatgtatcaacacctacctacaaagctcgcgatcaccgtaaaacacccaactattcaaacaccatctcaccaacactatcctcaaggctgtcaaatatctcgttttcttcaataaagctgatccagttctcgcgcgagctcgactggtcttctttaatattgaggccaattttctcgtaaacactttcgatgaactggtcaaccattttttctgctgcattcgcgaccatcgtcttgtttagtcgcttagctggtgcccgttgcttgttcttatcttcctgaaagtccacggctttctcgcggaacatatccacggcattgctgttctcgctaaaatacgtactgaattcttcgttatccatcctgactcaccttctattgttagttaattgactcggctttcaaatacgccctgaagcagctttaaccaagatgaatgcaaagagtgttgcgctatcactgtcttagtcaaaataacctctttgtcatctattatacgaacatttgtttgtaaaagctaggcttgtttgtccagtgaactagactttttcgttgaaaccgctttcgccatttttgagaatggattatactgattttaggagcttagactcctcaaaaatattggacttcgagtccgtgtatcggtaacgatacttggtgtctgtcatgttgatggcaggcacttttttagttgatgcttgtgctcacgctgcatggcatttcgaccattatggcgacagtatttgccacgcgaccgttgcttactaacccacacgcctggttagacccgctactaaacaggtgaaaaaaatagccgcttccctggcaggggaagcggctattgtgcgtgatccagtatgcaatgaaactgattttttctataaccgaaaactaccatcaattttgctttttgtccatagtatttctagcaaccttagagaaggaatcacaccgaagcaagtaggagtttacgataaaacacacgctcacagaaaggccgtcaatcccttgacctgaaaggagttgacggccttcatcctgcgttaaagtgtctaataatatttttgtacagtattcttcaaaatcgccaaaccctaaatttcgctcactgcgctctcactaatcaagtgcacctcatgttcatcatgcttcaactcaggccaatattcccgattggcctcgatgagatcatccaagacttccttcgccacttgggcgcttggcaagttttggataaggtcaaggcttgccacagttcttaataatcatgattaatccacgcatcaacgactaatttttcgaccatcgcttgattgaggatcatcccccgttgaaacatcgggattttgccttgcgtcagcggttcggcaccgtctttaccaacgatgcacggtacttcgaccataatgttgtcgtcaatatttgccacggcaccgttattttccacgattagcaacatgcgttcatgcgtgttgaaggcaatggcacaggcaagatcgacgatgaaagaggcgtggctgtcgatcgggaaggagccaacgtcactggtaccggcatcgataattttctgggcggcactgaagacgcacttttcacggccatcttcgacttcattggcgcgcgtatagtcaggatcagagtgagccaccacgtaatccggatagagataatatttcagatacgtgtttggcagataatgtgggtccactgccaacagatcctgcgcctttttgtgagttgcttgccagctggcatccatgtgctgggtgtcgacttcgatctgggtcaagtagccatgatgagccacataatcccgaatctgtggcagatattcattgcccgctttgtccttaacgctggtccaccagccaaaatgattcatcccaaagtaacgcacttccagatctttgggctgcaagccgatgatctgtgacatccgccgctgcgtaccaaccggcatgtcgcaaatattgagaatcttagcatcaggccgtaatcgccgacatgcctccgcaacgatagatgctgggttggagtagttgagcatccagcagtctggcgaatacttttccataaaatcaatcagttcgataatatcgccaatactgcgcatcccgtaagcgataccgccagagccgcaagtttcttgaccgaccacgtgatgtttaagtggaatcttttcatcttgctcacgcatcttatagccgccggaacgaatgtgggcaaaacagaaatcaacatcagtgaaggcggtctgcggatcagtggtccaagtgaagtcaatcgctggcgccttttcttttagctcaatagcaattgcctcagcaatcgtcgcctgtcgctcttcatcgatatcataaagtttcaatgctcgcagtggaaaacgttccgcattttccagtagcatcatcacgatccctgctgtgtacgtactgccgccacctgcaatgacaatggaaaattgtttgttctgattcattatattgtcccccctaaacgcgctcactgccacagaaacctgcgtgtaaggaccttgaccgcaatggcccaagcccggccatcacggtcaaggcacttacacttcgatttctaaacgggctggttcacgctctttctactcaacttctgccgcatcaaagcctaatgcttcatccaccgccgcgcgaactttcgtaacggcaaggccataaacaacatgcacattgttgccttttttgatgacaccactggcaccggtttcattttttaagactgtttcgtttaccaattccggattcttcaaaacagttcttaagcgtgtgtagcagttcgtgacactttcaaaattgtcggcaccgcctagcgcctcaataatcgttgccaccggtacctccgtcgcacctttaggaacactgaccggcggagcttgtttcttttcttgatactcggctttgctgtacagcttagtctcttctgcatcagcttcacggccaatcgttttcaaattgaacctgccgattaagaatctgaaggtgaagtaatagataaagaagaacatgatgccgacaacgatatacattggccaatgggttttaccgacccccagcggcacattgtagagcagaaaatcgaggaagccattcggaccaatcgcccgaacgttcagaaggttcaaaaccaccatgcttaacccgcttaacgctgcatgaacaacaaacagcaatggtgcgatgaacatgaaggaaaattcaatcggttccgtgacccctgctaaaaaggaggtcacaacggctggaatcaaaatggctttcactttgttcttgttttcaggttttgccatttgatacattgccaagcaagcaccgatcagaccaaacatttttgagatgcctcgcgcgtcccagataaccgaacgtgacaacagatgaatattggggttagccatttcggcgtagtagatgttccgtgcgccttcaaaaatgtgcccgccaatttcttcaaccccaccaagcgaggtatacaggaatggcgtgtaaatgaggtgatgcaacccagttggaatgagtaatcgttctagcgacccgtagaggaagaggccaaaattgcctgtttgattaatcacgtgcccccaaactggaaatgcccatttgaataaacggccagacatacgtcagcaagactgctaacatgacagtaactggaatcaaaacaatgaagacaaaccggctgccaccataaatttgaaaggcactgcgaaattcagtatccacaaatttgttatgaatgaagccaaccgttaaccctaaaataatacctaggaagacccccatatcgagaatttgaacgccaagaaccgatgcttgaccggtaccttgaagattctcggcctttgataaaatcccgcgcagttccataaacttgttcatcgcgttaatgaagaccaagaatgtcagcagcgccgtaaacccagcctctgcctttttcttcttcgctaacccaacagccaagcccacacagaaaatcaccccaaggttggttaaaattgacaccaacgatcctgacaaaatcaagccgaagccttttgtcaccggattattcatgaacggcaccacttcaagcagcttctgattggtaaagatgttcccaatggcaatcagaatccccgcaatcggcaggatcagcacgggcacgaacatggccttggaaaaacgctgcaaaccgtccataaccttctgtttcatctttgtcacctcttctagtaatagcaaaatattttcttgttgatctaaacataacagacaagttttatcgtgaaaaccctttcaagaaaacaagaaacgtgttccgctgattcggaacacgtttcttgttgtgtggttgttttggtttgtctttagctgctagcacaaaagaggtgctactaagcatacaaactattcatcttcgtttggcagttataaattttagttctaaccgcttgtgttgtaacccgtctgactattgctcacgccgtttacgccaaatcattaagccgccaatcagcaaaagcatgcccacgcctgccaaacttagccattgaatgaccttatcgccagtttgtggcatatctgcttgcgttttctgatgccggccgtttttatcagctggtaacggcttggtcggtggggttttgctgcttggatctgtctgtgatcgtttgacgagcgctttttgtgcagtaagtacggcctttgtggcgtgatccaccataacttgggtcggctcgtcaagcgtcagaacgtcttttgcagcatcaatcgctgcttgcaagtcccgccatgaagcatcggtataagttttcgcatcaagtttcgccgcagcagtcaaagcagcctgaagtgctttcgtatcagcagtttttaccagcccatcaatggctgccaccaacgctgtattagcatcatccactgtctgctggtcagtcgctaaattggcgatgactgcttttgcttccgtcagtgcctgtgttaaggtcgcgaaacttgctttcgtgtaatccttcgccttcaaatttcctgcagttttgatagtcgcagctaaggtagtacggtcaactggtacatcgagcttaaaggtgaccgctcgactggcgcctgccaaatcagccggattaaaggtcaaaacatggccgttcgttgaaaagagcgcctccgtctttccttgaagatgaactggattgttaaagctgaagttgattaggttaccggtttgacttggttcggcagccgtcagctgataaacattgttgccaagtgctttgatgatgaccgcggccggctgatcaattgaaacaaggccatccagttgatcggccttggtccaaacattggccatcacctgatcttttgtcttgattgcttgcaactcgccagtatttgcgagaaccatatagtctggtgactgcgctagctgggcgacttttgtatccgtcgcattcggcacagtgacatattcatacgatccgtttttaacggttgcgccatgcatggctgccaatgttgcataagtatgcttataaaccgtatcggatgggaaatacccattaatatctttgtaggtgcctgtccgcgtcgcctgattgatcgtaatgggcgcattgccttttgcgataatatagccaacattattttcgggatcggtggtgttaatatttgcccaccggctgactgtcttttggttcgtatatacctgaccatccaccgtgattttggtggttgccggatcaatttggcgttgatcgataatggtttcgatatcggcggcagttgtgccattaatattggcaccgagattaatgatttggtcgtttaataaaaaccaggatttcatcgcctgcagattctgaccttcattggctttgttcaatgccatgccaacactggcgatggttccatcggtcgcgccgccaacccaagcttgcggactttttgaagacgacttctcaccatccgtcagtgacaccgtgtcaactgtcgttccgggaaggcggtacggatcaaccgttgcccagtagccttcaccgaattgattcaaatcattgttatacagataaaccatcccgtcagccgtatgccaagcatggctattttcggtattaccatattcaaaattggcaattcgattggagtacatcgcgatgccaaccgcgtgcgtcggtgttttttgcatgacccgatccatcgccccataaatattcagcgaactgacgtcatctttctgagctgttgcctgatgcaaagccgttttgagaccatttaatgccacgtaatctcgtggcttgtcatagaaattgtagcgctcacccacctgtgcaacccaagtggcaacggcctgataaattttctgcttcaatgttgctggcgttgcctcggcaatcaaggtcagattggctaacgtctctttgccagtctccaactccgtggtttccgcattcgtccctggtgcgcgcgaaatactacgacccgaaagcatcgacggcatgcgtccattcaccatcaattgcaaaaagcctttgtcaattaagttaaaaacgttcgcgaactgaacttcactaatagcccaaggcgtaccaacgagggtcgatgaaacgcgcgcgatgcctttaatcatttcgttgccataactgccattgtacggaaaaaaggtgtgttgaacgaaggaaccatctgcatagataccatccttggcggtaacaagccccatcgctttaggcaaattctgttgaacaagggcaacccgcttgtcatcttctaacaacaacccactagccaaaaccgaaatcgaaatgtccgtcaagttagcccctgttgctgtgtaagctggccattgaatattaggatccttggcatagcccaacaatggttgaacaaacttaaccaacttttctggatcctgtcggtgcaagtcattgtataacaggatcaaagtatcatcgagctgttgtgccgaaacgatttgccaatcccaccaattgccggtggaatagctcccgttatattttttggccgtctccttaaaatcaatcgcatcaatgattgcctgatacacctcaggattttggtgctgttggcttacaggattatagtagccaatgttaacattttaatcctggattattcatagaatttcaaaaaagcagcgcaatcccacgattcacacgggactgcgctgctttggtgtttcaggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggagtcactgacaactatctgctacataaagttggataaaaacatccaccgataccgcttcgacgacggtattagcggtctgtggagggtttgtcatgaaaagaatcgctttgtttgcactaatggtgctagtcatcagtccatttctcattgcagcagggcaaaagactaccgcaacaacaccagagtttgctgttacgcctgtgctgccaagtaatcaaaaacaggcagacgcaggctattttgacttgcaggtcgatcctggccaacaagaaaatttgccacttcgcatcagcaacctatctgatcaggtgcaaacttatacaattgccgtgaaccctgcttataccaccgatagcggtgccatcgcctttgatcgcgctatgccgcctttgaaccaagatgcacgccgtttgaatacgctcattagcgggccggaaaaagtcagtgtaccagccaaaacagaaaaattggtcacttatatattaaaagcaccgagccagcattttattggcgttatttctggcggtttctatgtgtctcctgaaaatgactccagcaccaacaagtcggtaagcggcgttcgcttcacaaatcgttttgctatcgggatcaccactattttgcgccaagatttcaagacgcctaatccgccactactggcaatgacaaaagcaggcattggtacgattaaccactatgccgccgtccaagcaaccatcagcaatccttctggcaatcagttcggtgacatcacgagtgactatgccttaagcaaaacaggaacaaaaaaggccttgataaccggtcattttgtggggcaagccgtcgctccgcactcatttttcacccaaagcatcctgctcaatgaccgcaaactcatggctggtgactattccctcaaatggacagctaaatcaggcgacttttcttggacaaaaacacttgcctttcactatagcggtcatttaccaaaaaacaccctacaacctgttgtcaacaaaccaaagacaaaagcacctgacaatccacaactgccttggatcattactggtatcgccattgcgcttctcctcatcttgaccggtacatggggctggagcacttggcatcggcggcataaccagtagaaaaacgtgttgcctgctcacgattggcttatgataaagggagagcgtgaactgatgcggttagaaaccggaacataagtgggctgggacgcgatgactgcactttggtcattgtggccaaggtccttatgaggaggttcctgcgccagtgatcgcgtttaaaaagagcgtgaattggcgcggttagaaaccggcatataagtggcctcaaatgcaatgatgcgccgccatggtcattgtgctcgaggtccttgtgagacggtttaggcgtcagtgagcacgtttaaaggaggacttcccatgtcaaacaatcgcatgctcggaaatgagtttcaaacagcatatgaaagtgctggcggaacggatattttaaaatttttagcgaatgtcaagcaggcattccagtgcattacggatttaactgcacgaatcactggtatgcccgattcggttaaaagtgagtctgtctctcagttattagttcaacaattggatcagacaaccttcgccgaaagtgccgtgcgtcaatgggaagacgatttgcatcgctttgctgcttatctcacaccactagaaccacctatcgcaattcttgatagttgggatacattaaatgactttttggaagcgaatcaagcattgttgagttcattgcaaaatgtgcctctattgacccaagaaactcaagaagtcaaaacaacatcgcagttgttcgtctatccagcagaacccctattccaagtcgttcaggccgacactggcgaaagcgactcaattgatttggccggtttggcagatgctgatcctgaaggtgtcgctgaaattgcgcagaatcacggtgttacaccttttgcagcgtttaatgcccagccttgattttaggctgtcaatcctgtatgcttgacaggttaaattatgaaaaagtgaggtgctaaaacatgcggaataacatcatcttaggcaacaatgaaaccggcgaacggatctatttgacttccaagaacaagcggaatacacctgatcgtttgcaactcaagaagtattcaccgaagctgcgcaagcgcgtggttttcaccgaagttaagtaattattcaatgacttcatcagtctatatcgcctcctatcagtgtttatcattggtgggacgcgatattttttgtctttttatgactgctgatgagccaccactggcacaacattattattaacatgagcaagttattaggctggccattcttcaacatgctaaagttacttatagtaagtgtgtgacgctgtcctcaaacaagaaaggttgattcctatgacatttgttttgccagatttaccttttgactacgcagctcttgaaccttacattgacgcaacaacgatgcaccttcaccatgacaagcatcatcagacatacattgataaacttaatgccagtttagatggtgtccctcaggcggccggcaaatccattgagcaactattgacagggcttgatgcgctgccagaaagcgtgcgcgtttccgtccggaacaatggcggcggacactataatcactcattgttttggacgatgctgagtcctgaaagcaccatcaaaccggacggccaattattagcagatcttgaaagtaccttcgattcatttgacaagttcaaagccgaattcagtcaagcagctttatctgtttttggatcaggttgggcctggcttgtcaaagacaacgcgaccttaaaaattgtgacgacagcaaatcaagattcaccaatcacgtatcatcagtacccgctgctaggcttggatgtctgggagcacgcgtattacttgcattatcaaaatcgccgaccagaatatgtggacgccttcttcaaggtcatcaactggcagacggttgaaaatcgcctgatgcatcccgatacaaacgcctgacgatgtttggtcactaactttactaaaagccgaagtgcaaacacattttgcacttcggctttttttcatgtcttcgtctgaatctactgcacgtcatactaggtcagattgttggctcaatttggggtgcttctgtcagcagttggttaaacaaagccggcaccggcaattcagccgtaatccgcttttccgaaaaaggatccgtaaatttcaaccgcgtcgcctgcaaggcttgatacggtattcgcgcatctggctgaccataaaggtgatcgccaattaatggatgacctaaacttgcaaaatgaacgcgaatttgatgtgtccgaccggtcagcaactggacatcaaccaaagtattggttttttcttttaaaacccggtattttgtcagcgccgcctggccatcagctgccacaattcggtgaatgccatccgccgctaatttcagaggtgcatcaatttcaccttttggggatggcaatttaccgctgacaaccgccaagtaatgcttcgtcagtgtgcgttgatgtgcttgatcaaaccggccttgtgcgtatggatgttttgcagccagcaccagtccgacagtatcgcgatcaagtcgagtcatgatggctggttgtggtgcgtcaattttttgctcaaccaaatagcccgcaatacgattcaataaactcgaattcggtgtgtggggtccgggaacgcttgtcaatccagctggttttgagacaattagccaattagcatcttcataaatgacttctaaaggcgcaaactctggcgtcagcgttttgctagtcggaatttcaaagcggataatctggccagcttcaaccggaccattgccagatgcttgcccatcaacccagatcaaatgatctgccagcatttttttgaacaagcgatgactgacaccttgctctgctagccaacgtttgaccgttgtcgaccgtgtcacctttgacgtaaatgaatatcgcatacctatttcctttcgccatccctcttccgcacttaaaaccgaacgaatcggaatccagatttgcatttaaacgggttttgggactatggttagactatggttaatgtacaagaataaggaggaacaggcaaatatgcaagtggaaaaagacgtgatctacgatagcgcctataatttagccgccgatctctatgtacctgacgaagccaatggcggtgccatcgtgtatgcacacggcggtggctggtttcgcggcgataaggaaaatgaaagcgatttaggtaaatattttgccgatgccggctatctatttgcgattccgaactttcgcttagcccctaaatatttatatccaacagcacaaaacgatttcgatcatttcattaattggttacttgcttccccttacgattttgatcgtgagcgtttgggacttttgggggcaagttcaggcggcaccatggttctgcaaaacagtttagcttccggctatccgctcgttgcatggtcccctgttgttgattttgccaactgggttcaaaaaaatcaaatggtaaaggcttctgtggatgggaaaaaagaacttggtcttaccgagatccacgaaattcatgattcattttacaagtatttcgtgcagacttaccttggcggcttagacccgcgtttgttgaccgcggtcaatcccaccaaccatttaaccgatcaattaggtccggcattgttgttcaattcagctgatgaattgatgccactgccaagtgccttgcactttttacaacaagctgccatgtttggtcgcgatatcggactgcatgttgtacccggaaccggtcatgcccgcgactacacaagttttgccttgccagaaaccaagcgcttttttgatcatcacttgtttacgacggttgaagacaaaacgttgaacaaagcgacagactgagcttaacaacaaattcggtcagtaaaatagcgttgcgatcaaccttcattccgaatggtgatcgcaacgctatttttatgcgtcaattttaacaaacatcaaccgtcaccggctgcaaaggtcggttcacggttatcttaagtaaagaacttcatgcgtgatgcagaatcaatggcgatgcgacaccgggtgcgacccattcaaggccaccactaactggcaccaaataaatggcatcagcgccgacatctgtcgggatcaagacaaaaccattgccttctggcgttaccttatagccggtttttgttgttacgccagcctgaacaacggtcagctggtctgccgtaattgtcagcgtcacgtgctcattctgccatgtgccgagataaaccggtgcagtgttgctgacatcctcagctttgaccgaagaagttgcttgagtcgtacttgctgtcgaagctgtctcggtgtgcacagtcgcaaccgtgctcgaacggctgatctcttcagaaggttgtgttgttgccgctgaggaatttgttacagcgactgtcgaagaggcggtcgcattctcttttttaggttttactgttgcagctggttgctttttaggcgttgtgacagtgactgtttttgtgtcagtcccggcatttgcctgatgctgataaagagcagcaccggaaaccccactgaaggtcaaaatcgctgttgccaacaaaaaccactttttcatgtcattcactcccaaccagacatactgtcgtcgacaggtccgtttttcttattatctctagcctatcatgctgcctaatcaaatgttacaaaacgatgtcaacacaagcaaatcttaataattgcggcattctcgctgtcatctttttgtaatatttaaaaagcggtggtttcctcttgttggaacaaacatatgttcgtataatcgatttgaggtgatcatcatgacttatgaagaaaaaatcggcaccgaaagattcgatgccatggtggcggattttttcgcaaatcgttactttgatcgcggcatgcgtaaatggcaaggctactatctttctgatcatacagccgctttaaagaagcaatctaaaagtgaagcgctggtttatcccccgctgccccttcaggatcaagcggtcattcgcgcaatcttgctacaagcctatgcagaaggccaaacagtaacagcccagcttaacctgcaaacgcctagtggtcagatgctgccaccgattcgcggcaaggttggcggtttaactgacagtgacgtggttaatattgcggatcaaaatatggcaatcggatcaattcggcacatcgaactcatcccatttgctgcatcaacgcatcaaaaaaatacgccagactaaggtagtcggccgtaccgccggggctcaaatttcgtgcaatcatttcggcgtttaaagcgcgcaacccattaggtagccgggacgccggtacatgtaacaacgctttggccgcatcctgaacaaaccgtaacccagctggccccccacgatgcaacacattagcgtcttcaacttgtgccatcagatgaaccatcagctgcagatagcgcagatcgccgcgtgtcgtggtttgccgtaagtaaggcaggataaccgtccggatcgtcgggtagccggctaacgcctcaccacgcacgccagtcacaccatgcttcatatacaacgcctcgccatgactcaactgttttttttcactgagatcgcgaaaatcgccgctcacgccttgtgcaatttgcgccactgccggaaaaagcggggcaaaatcatgcatgactaactgcttaagactttgcttttgcaacaaccatcccaaagcacccagtaaaaacccaaaagaaaaattagccccgcgatgcgtattcacacctactgtaactgtcatcatcgctttttcagcctttaccccgatcgtccgcaattgctggtacaactgtggtaccgttgccgccgttaatccagcatgcagatactgaccaaaataaggagccagcgcatgaatgctggcctcaaaggtggtgacgttcatatcgcgatgagcgccattggactccggatcaactaagcccggcttcggcgcaagcaaaacctctgcccgcagactcgtgaccgctgcttgggcgattgtttgttcattcaatgttctttgccttcataactttcagaatatattgcaatgagtggcccaaatgttcacgcgtgatcagtttgatttgatcatcatcgcggtttaacatcccccgataaatcagccaatgttcctgaatcgcaagattacgccgatcatccccgttaatactgatatcacgaaaatagatcaagtaattttgtaattggttgacaatcattttcagccgcaacatatggctggcatcgtaaataaaattattaaactcggtaaatttggccatgacttcaggcacccgtccagcatcattcaaccgatccgtttcttccagaagcgcacgcatctgtttaaattgagccggcgtcattagccgcattgccttacgtgttgctaaaacatctaattccttgcgaatatcaaaaatctcgtaggcatcgttgatcgaaatgcccttcacaatgacaccgataccggttttacgttcgaccagatcttcttcatctaatcgttcaagcgcataccgaatcggtgtccgactgatattgagattctcggacaaattcttttcgttaatacgctcgccgctgggtatttcccctaacaaaatcgtcttgcgaagcgcttcgtacaccgcctctttaatcggccgattctccgaaagatccagattccttttgactgctggcaccacttgattcatcggtcgttccccctcgcttcgtggcctattatagcaaaaaagccgttaacgggggtgttaacggcttaaaggaaatgaagctaggaacaactggcaactagtgtagcaggctcacgcaacgacggtcaacatcagatcaatcatgcgtcggctcaaaacttagcgacaccttctgctccggcacatcataaaacggatcttcgcgtcggccaagaaaatctttagcttgatctgggaacaaagcatagcttaagacatcctcttcgtcgtgcgcatattgcgcaatcgcttgacggaattcaggcatttgcggcttgattaaatccgcgggacgttgtgtgacaaccgatgcatcaccaatgatctttttcaccatttcgggtgcaattgccactggcggccgaccataaaggccgcgcacgtaatccttaatttcatttggaatcaacttataacgctcaccgctcatgacattcatcaaactttgtgtgcccaccatctgcgacagcggtgtaaccaacggcggatagcctaagtcagctcggacacgcggcacttccttcaaaacatcgccataaagcgcttcttgtccttgatcttttagttgcgccaacaggttagacaacatcccgcctggcacctgatagatcaaggatttaggctcaacatctttcacgcgcggattcagttgaccggactcgcggaatcgatcgcgaatcggcgcaaagtaagtggcgatgtcactgaccgtgcttaaatcaacatcagtcggatagccaagatcttgcaacgcaaccagcatggattctgttgctggctgactggtgccgccagcaaatggcgaaaccgcggtatcaatgatatcagcaccggcacgaactgcttccagataggtcatctcagccataccagcggtggcgtgcgtatgcacttccagtggcacgctgatttcctgtttaatgccggtaaccagatcaaacgccttctgtggggttaaaatgcctgccatgtctttgattgcaatcgaatccgcacccatgtcagccatgtctttggctaacttgatgaagtaatcgatcgtatggaaatcactggttgtgtaacaaatagcaagttgggcatgcccgcctgcttgcttcgtcgcttcaagcgccgttcgcaagttgcgtgtatcattcaacgcatcgaaaatacgaatgatatcaatcccgttttcaactgactttgtgacaaagtcagtgaccacatcgtcggcatagttcttgtaacctaacaaattttgcccgcgcaagagcatttgcaatttggtgtgcttgaccgccttacgaatcttgcgcaaccgttcccacggatcttcattcagataacggagacaggcatcaaaagttgccccgccccacatttccaaagatgcatagccggcagcatccattttatcgagaatcggcaaaatatcactgagcggcatccgcgtggcaatcaggctttgttgcccgtcacgcaaaacggtttccatgaattggactttctgtttaggcatggggtgtcctccttttaaaacgcattcactgacccagaaacctttgtgtaaggaccacaagtgcaatggccaaagcccggccatcacacttgtgcccacttatgctccggtttctaagcggtctggctcgcgctctcttttacgattgtttccaccacttgttgtacctctggcaaaccgtgccgccgtgatcgggcacaggccttggcgtcgccgccgcaaaccagacaggcacgtggtggcaaggcaagatccgtgcgagaaacttgatacagttccgcatcgcgtaacgtgataacatcaagatccagcaggtcacagaaccgttgctgattttcaaacgcgaccatgagccgcttgagtgacaaaggtgacaacgtggtcaaaaaataagcttccggtccagttggcaataagtcaatgtccgaagatcgaacggcctcgccaagttgctgcgtcaaggtctgcatgaccgccgaaaaaacggcttcaattcgagtaccggttttaaccggtccaggaatgcgcaaagtcacgtgcaagagcgtattggttggtgcagtcaccaacaacgctcgctctttaaccacgcgagcatctttggcagccagcatttgaccaagatcaacttgtggaccatctaaaatggttaatttaaacattgtgaaccacatcaatcaaggtgccatcacgatattcgatcaaagcgaccactttatcgccatactcgatggcttccggtgtaccagtaatttgataggccatctttttcagatcttcaattgaaaacagcggcactttcagatttttaaacatttcaatcaaatcagtccgtgctggattaatagcgacgccgacttcggtcacgacaacgtcaacactggcacccggtgtcacaacagtattgacattttcaacaatcgttgggatccgaccgcgaaccagtggcgcaatcaccatgctcattttgcaggcagcacttgtgtcactatggccaccagaagcgccacggataatgccgtcagaacccgtgatcacgttaacgttaaagttagtatcaatttccagtgccgataaaatcgcaatatctaactgattgataactgcacctttgcttaacggtgacgcgtacatattagcatcaatctcgtaatgatctgcgttctcgcctaatgaaaccgcagagggatggtcaaagtcctgcacatcgataatcttttcgacaaggccttccttcaacaattcaaccattgaattggtaatgccacccaaagcaaaactagctttgatgtcttgatccaacatcgcttgccgcagaaaacgtgcaacagccagcgaagagccgccagtaccggtctggaatgagaacccatttttgaagtaggccgatttggtaatgacctctgccgcatactccgcaatttttaattccttcgggttcttcgtgaaacgggtcgcacctttggcaatcccagttggatcgccaatcgcatcaacttgcacgacatagtcaacgtcggtttgcggaatgctgattggcgtattcggatatggcattaaactgtcagtaatggcaacaacttgatccgcatatttcgcgtcaatcatggcataacctaacgagccacaggtcgccttaccttttgtgccgttaatgttgccgtactcatcactgctaggggcaccaagaaaggcaacgtcaatatgaatatcgccacgagcaatggctcgggcccggccaccatgtgagcgaatcacaactggattcttcatgatgccgcttgaaattgctgcccccactttgtcgcgcaagccggaactggtgatgttggtcaccacaccgtttttgatgtgctcaatcaatggttcatgtacattggcaatcgaacttggcgcaattgacaggttcttgatccccattttggcaatctcagctaggaccatgttcatcacatagtccccttcacgaaaatgatggtgaaaagaaatggtcatgccgtccttcagcccagttgctacaatggcatcgtgaattgacgccacgagtttgctgtgatccggcttaaccgggttgatgtggcgggcatgttcatcataaggcttaatgttggcaaactcgccgccataaacaccgtattgatccgcatatggttctgggatatcacggttgagtgtattcttgaccatcagtctacctccattcctgatgcctttgcgagcgcgatggtatactgtgcccgttcgacaactggcttatcaaccatctgcccgttcacagaaacaacccccgcgcccttagcttcggcttctttcaagccagcaacaatctcacgtgctttttgaacttccgccaaagcaggggcaaaaaccccattaatgactggaatttgccgtggattgatgacggacttgccatcaaagccaagctgtttgattaaggcggtttcgtggcgcaaaccttcttcgttgtccacttgtgtatagaccgtatcaatcgccgcgatgccagcttctcgcgcagcatgcaggatatagttacgggcaaaagacaattcagcgccatccgtcgagcggtgggtatgttgactcgtcagataatcttctgcacccagcgcaatcccaatcatacgtgatgaagcttgtgcgatttcgcgagcattcaaaaccccttcagccgactcaattgcagccatcatgtgcgtggtgccattttgaatgccgtacttctcttcaactgctgtgatgacagcatcaacatcaataatgtcttgagcagtttcggtctttggcagacgcaccacattaatgccgccaagaaccatcgcttcaatatcttgatccccgcctgcatctaacgcatttacccgcacaactgtttccacgctactgtaatcaaaggtcttcagggctgaataaaccagcattcgcgccgtgtctttttccttcaaagaaacagcatcttcaaggtcaaacatgatcgcatcagcaccataaatcggagcatcacgtaacatgcccggattggcaccaggcacaaacatcatggttcttcttaatttatccatgcgttgatctcctcccagtcaaacgtcttattgtcagacgcacgataaacagcggcgatcgtccgcgccttgatggtacaatccaaggcgcctttgtcattcgcgtcaacggcaacattttcgatccctaacttggccaaggtggcctcaatgactgatcgaatttgatgaccaaactgtttttctacactgctttgcagttgaatggcgaccccactggtagccggtgacaaggtgatttgaatatcacttgattccagcgtaccagcagtcgcaggatgcttaatttccatgtgtcgatcgctcctttatttcttgataaacttctggataaaccaattgctgcacggttttccaatcttgttgtgccattgccgcgcgaacacgggtagcactaacaacatcgccgtcaatcatgagccgcggcacgacgatcagttcaatcgccgaaccaaatgttgccgctagttcccgattgtaaatggccgttaccggcgacagcggttcctcaccgacatagcgacgagtaatccccaatacgggtgcaattgcttgtttaaaaagcgcggcatccagccgagcttggacagcagccacatcggcatctgcccgttctttgagaaaataactcggaaaagtagtatttgagaccatatagtcgttggttggcaacaccacgacgtttggccagcgagcggcaacttttctaactagcgccaaccgttcatcggctgtgaacagagaccgttccgctgataggacgaaaacgtaaacgaccgggttgactttggccgctgtctcaatcagataggcatggccacgcgtaatcggattggcattcatgacaatcgctgccgctggtttttctggccgccgctgcttttctaacgaagcaacataatcggtcaagttgggataaccgcgttcaagtaacacaacagcatcggttgctgccagttgcttgaagcccaatgacaggaaaaatttaacggtggtcggtttggtatagacaaagctatgggtcacaccatcatcgtcaagccgatccagtaatgcctgaattacctgtgccaacaagttttcatgctgggttgctggtgtaactgccacttccttgatgatgttaccggaaagcgaaccagttgccagtaacgtttctccttcaaaaataccaactgtatagtcaacctgacgatccgcagctaacccggcagtcgtcagcaaggcttgccatgctgctgcttcttgcggattcaatgccagccaaattcgttttaaagttgccatgttacttcgccgcttttttagctggggcaaatttcagtaataacttcgccacgatataaataatgaataatacgatgaaaacgccgcccataccgatcagcatcaattcacccgcttgttcaacggcaactgggtcaattttcatggaagtacctccctttttaacgtgctcaccagcgcaataacctgcgtgggtctaaacgcgatctccagcccagaaacctgcacataaggacctcaagccaaactggccaagacccagccagtttggcttgaggccacttatgctccggtttctaaccgggctggctcacgctcttatgcgccaaagaatgatagtaacagtccgccggcaatgacagagccgatttggccggaaacattagcgccaacggcatacatcaaaacaaaattctgtggatcttcatcggttgccattttttgaatcactcggctcgacattgggaaagcggaaatgccggccgccccgatcattgggttaatcttatctttacggaaaagattcaataatttggcgaacaatacacccccgacagagtccatgatgaaggcgaataatccaaaagcaatgatcatcaacgtttgaatgttcaagaattgatcagcttgcaatttaacggaaatcgttagcccaagcagaatcgacacaatattgaccaattcgttttgcgcggtgttagacagccgatcgagcaccccacattctcgcagcaggttaccaaacatcaggaacccaactaacggtaaggaaatcggggcaataaacccggcaataatcgtgataatgattggaaacagaatttttgtcgtctttgaaacgccttctgccttataagtcatccgaatccggcgttcatgctttgtggtcactgccttgatggccattggctggatgatcggcaccaatgccatatacgaatacgcagcgactgtgatggcccctaacagatttggcgcaagttggttcgaaacgaaaatcgaagtcgggccgtctgcggcaccgatgataccaattgaagccgcttctttgatattgaaaccgaagaagacagcaacaaaaacggtggcaaagatcccgaactgtgctgctgcaccgaacagtagcataaatgggttttgtaataacggtccaaaatcgatcatggcgccgatcccgatgaaaattagcagtgggaacagttccgtattgataccggctttgaataaaacatcaagcaccccttctgctttggtgccgccaacaacttgggtcaagacgcctgttcctggaaagttgaccagaatggcgcccaagcccatgggaactaaaagggttggttcatattcttttttgattcccagatacatcaggagcgcgccgatcagcatcatggcgatttgacctaatgtgatcgtggtgattccgtgaatgagcgcttccatgccatccctcctccttaaataatgctgatgagattgtcgccggaattgacattctggttaagtgttgcaaacacctggccgatggtacctgccttaggcgccacaatttcgttttccatcttcatggcttccagaatcatcagcggctgattttccgtgactgcatcaccgtctttaaccaaaatcttagtgaccttgcctggcattggtgcagtgacaacttcaccttccccagtcggcgcaaccggagctgcaggtgctggcgcagctggtgcggccggtgccggtgtcggcgttgccgctggtgcggccggcgcaggctgggcggctggcgcaccgccaatttcttccatttcgaccaaataggttttcccatcaatcgtgatcttgaattttctcaacatcttcttcattccacctttttcttgattgacttgaccacataattggcatggccatcaccagccgcaatggcgctggcgatcaagccgacgcgttttgcttcaggattctcgacatacagatgcctcagcactaactgcgcatcaggagctgtatcggctgtgactgctgcggcaatcagactgacgggcagttctgatgccggatcaacagctaaatagtttgggacatcaatccaatcatcatcaaccggcgcggccggtgctgacatttggggtggcacttgttcttttgtagacggtgtttgctttcgtcgccgcagccaattaaacatctggacacctcctcgcaatattttcttgttgataagttatatagtacggggaaaagccaatcatgattggcttttcggtgtatttttcagttaggatgttatttttgcggcaggtagaatggcacgtgaccgaataacatcaccgtgacaacgaagatagcgaacacacctaacgcatatttaccagcttcgcgctgccatttacccatgtccaaaccggttaaccggagtaatagatagatgaaggcaactaatggtgacagtaagtggaacgcctgacccatcaaggaagccagcgccatctgcatgttggtaaacccatatgctcgaccggctgtagccagaaccggcatcactccgaagtagaagccgtcgttactcaggaagaaggtccctggtgctgaaatcaaagcaatgacaagtccccagaagccagccaatgaatcaggaataatggaagtgaaactcttggccagcgcttcggccatcccagtaccttggaacagacccatgaagacaccagcagcgaaaacaagaataacaacttggacagcatcgccaccgttggcaccgatccgcttgctttgatcgcccagtttcggatagttgaccattaaagcgatacaggttccaactaagaacaacaacaatggtggcattgcaatggctttaatgaaggaacttgcaaccaaccaagcaatcaagacgattgtcaaaataccattgaaaaggaataagtttgggcgccgaatttcagcaacttctgggtcgacaacggaagtcatttcatcgatttcagcatccgttaactctcggacacccaaccgtttccgttctgctcggcccatgcgcggtgcaacgtagaaaacaacatacgctaaggcaagaatcatacctggcaacagataggtcagaatatcagcgtcaactttcaacacggccattgctcgggcagttgggccgccccaaggcagtaagttcatgatggtgttctgcaaaataatcaaaacacctaagttcatcatgttcatgttgagctttttatagattggaataaatgcggaacagcagatcaaagttgtcgtcgtaccgtccccgttcagtgacacggccatcgcaacaatcgcggttgccatcaggactttcatcggatcgcccttcgcgattttgatcatccgggcagtaattggatcaaacaaaccagcgtctaacataattgagaagtacagaattgcgaataagagcatgatccccgtgttggcagttgttgtgagtcccttcaacacgaaatcgccgatcgtacctttattagccaccccggccaccatcgcaataatcgcaaacagcagggggatcataaccaaggaagtaaatggtgaaagtttcttagtcatgatgacatacataaagaccacgatcatggcgtaagcaatgacggtgagtaacatagtcccaacctcttttcataagtttttgtctctaccgtcatagtacgtgattatcgtcacgaaatcgcctctttagcccgtttagaacactaaaagaacaatcactgatcttccgataagaaaaatgtcaagaaaaatagaaaacgcctccattggcttaaaattagctttttaagtcaatggaggcgtccatcagttatgaatcatctttggaaaaagataatgctggcgtgatgttcatatattcacatactactaatacaggcgcgtaattctgtatcagtctaccagtcttggaaacgttcttcttcgagcttttttaacaactcctggtaatttttccgcgatggtgcatggctcaaggtcgtctgttgcagctcattaaatcgctctgctaagtaatatgcagtcagatagagcgtcagttttcgcttgacgatcgtctctggatctttgtcgtcaggcacttggtgcgattcaacaacaaggttcgcgaactgtttcggatttaaccgtaaatcatcgggttcatcggctttcatcgtgatacctccttttttaagtatgcctaatactaacataaaaaaacgaccgtaatctgtcattgaaaaacattttacggtcttcgaaagtatgaagttagatgatgtaaaaatcttgctggcagctcagaaacaagccacacacgactgctcgtgggataaaagaggatcccgtttttggctgcatcacgggcggcaatgcgataaataactggatgagtgtcatgacgggcaccgacttgccgagcagtggcgacatcttcagacagatgcacaaaatcccgattcatcggcagtaagccttccttagcaatcacagtagccgcctgatgtgaggtaccatgatacagccactgcggtggttcagttgctggtgtgagcggcatgactggcacactgtgaccgtaaaccgcccgaatcgttgttccttccaatgcaaatcgctttttagtgctttgtgccataatagcttgtaagacttggcgatcaagatgcatttgataatgcgcattgaagcgtcgcaccaatgttttccaatctgtccgaccatactgatctaacaccaagcccaacttttctggatggtggcgcaagagcatgcttaacgtcttgctaatcttgactaatcgcttatccatcattgtccgttcccttttacaccctttaaccttaactaggagagaaaacgatgaaactgcatttttcaaaagcacaattgaacgaccttgatacgatcatgactatcgaaacagcaggatttacgccacaagaggccgccactagaacctgcatggcatcacgcattaccaactatccggacaccttcattgttgcccgcgctggtggcacgattgttggttacgtagtcgggccagcaactgatcaaccaacgattacagatgatcttttcagtactagtcagcccaatcggcccgatgatccgtacatcgctgtcttaagcctcgctgtatccccgcgccatcgtcatcaaaatgtcggctctcaattacttgagcaactaacccagatcgcacgtacacaaaaccgccaagcgatcaccttaacctgtctacaacggttgatccctttttacgaacatcaaggctttcaaaatgaaggtcgtgctgcctctactcatgctggcgaagtctggtacaacatggttaaaaagatgctctactgacagccttcctcagcttattcgggattcagatgttggcgcaacaccggggcggtttcgttgaccagaaaaagcgggccatctgcctgcgccggaaaactcgtagccaaaccgcctagatcaaacggttcaaaaccaatcgtccagattaacgacgccaccacttttttcgcctgttcatcgtcaccagcgtacggtaccgcaatccgatcaactggttgttcaggttgtgccagcctagcgagaacggtcatcccaattgtattaaacgctttgaccactttacttgattgaaaatgctcggcgacgatctgagacgtcgtttttttatgacgttcaatctcagcaatccacgcatcgcgatcaggaaaataattggttgcatcaatgatgatcggatcttgagccaatggttccggtaaagccttaatagccaaaaaaggcactgccaagacgacaatttcttgtgcttcggcttgttcaactgtgccagcttctgctcctagaacgcgcgctaaatcctctagcgcatcgactgaaccccgatgtgcgatgacaacttcattgcctgcttgcacgaaaagttgcgtcagaacctgtccgacattgcctgatccgatcataccaattttcatccgatatcactccaccctgttattattttcattatatcgcgacacctcttttcagggcaaataagccttgttttttttatgtatcggcttttccggtttggctttgactggatgtcaaacgatgctcatgctggtgacgctgagccaatcacttaagatcagttaacaaatagttttcaggcttcaactattttgctttacatactagtcaacgctctttatactactagtaggcaatacatattagttgggaggtacatgtgatggcaacagataccaatagccaaatgctcaaggggattcttcaaggttgcctgttaattctgctttcccgagaagagctttacggctatgccatcagtgaggcgcttaacgattttggctttgttgatattcccaaaggcacgatttacccactcctgatgacaatggagagaaaagggttgttaatcagtcatctgcgtccctcacctgacggccccagccgcaagtactacgccgtcacagcagagggtatggctgcgcgtcaaacttttcaacagcagtggtcacaactgaaggaccatgtcgatcagctcatcaacgaggaggacaagccatgaaacaacggaagcaggaaacacagcgattaattgatgaaaatgaccaattgcgaaaacagcttaatgtggaaagtcgccattattatgaagacttaatcgtctatatgcgtgctcatacgctgtttcgcgatgatcatattgttgaagaaaacttaatggccattcttcaagacttgattgatgcacaacagaatggcatggatgctgaaacgtattttgggaaagatcccgcgcaaacggggacagagatgctgaaagcaattcccataaatattgttgactttgtttggtttaatttgaagttaatgatgatgttaatccttctcacgctgctgcctagcctgacgacttccgaggtaaagcttgatggtggtaatcttctatttgtgagcatcatcattttgatagcgacatggagccttctctggatagtcggcagtaacgcattcaccacaccatcacgcactcaaaaagtaggctttttcattggtggtggtgccatttttgctggcacagtgggattgcttttcttttttaaaacaagttggcaactcacaatttcaccgcaaatttcgttcattctaattgtcagtggcttgattgttggtgcgttgctaccgttcttctctcgccccactggaatcaagttgttcctctacttttattcgatgggttatttactactgggtctgctcgtccatttaccattcacccgcaaaattatgacggcaaaaattcatttaggtgcttggcagtggttgctctgggttggtctggcaatttttgcaattttgataggactagtttcttggtggttcattcgccgagagcgtaggcatgacccagatagataagatgccgtgattaatttcgtgacgaggcaagttgcctcgttttttaatgtaaaatagccttaatcccaatcaacccaaaggagtgacccccacttggatctcaatgacacccttcgtcaccaactgcaccatcgttccatccgccagttcaagccgcagcatttaagcagcgccactattcgaacattgctggatgtggcgcaacatacagcgacctcaatgtacttgcagttgttttcggttattcacattatcaatcctgaaattcgtgcacaaattgctaaaatcagcacgcagacctatttgaacggcaatggtgaactgttcattttcatcgcagacctcaatcgcgttgcgaaactgacagcagctgctggtcaatcactggatcgtcttggccgaatggataagtttctgcaggcgagtgccgatgctacacttgccttacaaaatatggttgtcgcttccgagagtcttggcctcggaacggtaacccttggcagtattcaaaatgatgcgcaggccctgattgagttgctgcatctgcctaaatacacctttccactacttggtctggcgattggttttcccgacgatgatcccgacgaaaagccacggatgccacagcaattggttgctttcacagaccactatgatgaacctgtcccttcaccgacagccatgactgactttgaccgcactgttagccactactacaccactcgccgcggcgatccgcgcgaagaaagctataccgatctttcgattggcgctgccaggaccacaccggcaaaacgcggcgatctcttcaaagtcttgaaacaccaaggctttttcccggaaagttgatcttaaacttatcccactgccgataaaatcctgccgcagaggctgatacataattctcagccaaacaaaaaaaggaacactttttcctgcaaaatcggaaagttgttcctttttgacttctcgtggcatatttagtgcgactttaaagaacgtagtgccaaggcggagcaatcgtaggccagatggggctcagccgtgcaaacaacacagcgacggtctgtggagctgatgttgttaggcgacttcgagaccgcgggctttgcgggctcgaagcgccgtctccgctctagctacgcgtcgccaccccagctggccggagattgcggagtttggcacggcaagtatattttagcctagaaccttcctagcgactattcggaatttaatgaatcacaagtcttgtgagagaattatggctcacacttttcgttgttagcaatcacctagcttgtaccgattttcagctcctctcgtcctctcaatcaccacaccaaaaaattgactgacgagtcaatattccgttgactagccagtcaatcgcgactatactgcaggcgaaaaggttgatcagacaccgacatattaaaacgtgtttcaagtttgaccttaaggaggatgacaaaaatgacaacagctattatcgaacttgaccatcttcaaaaaaactttggcaagtttgccgcattaaaagatgtcagtttcacgttggcacccggtcaggttctgggttttctaggacctaatggggccggcaaatccacgaccattcgagttattttaggcttattaaaaaagagtggcggctcagtgaccgtcttcggcaaagatgcctggcgggatgatgcggcgattcatccacgcatcgcctatattcctggggacgtttatttatggccaaatctttctggcggcgaaattatcgacctattgctacgtttaaatggccgccagcataatcaaaagaccgatgaactaatcaaggcctttgaatttgatccgaagaaaaaagctcgtacctattcaaaaggcaatcgtcaaaaagtagcgttaattgctgcgttgtcgcaagatgccgatttgtatatttttgatgaacccacttctgggcttgatccattaaatgaacagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattacggcatctatcgcggatcaaaattgaagtcaccaccgctaccccaatgactgctttggcaaagcaagctggcgttcacgacctcacttatcgcgattccgagcacaccaaggcggttttcaccgctgatcgagacgcgcttggcaccatcatgaccacactggccgccaacaccgtggtcgacatgcaatcaacgccgcctacgcttgaagatttgtttctgcgttattatggaaagcaaggtgagactcatgcggcacagtaatcggaacgcaggttatctgcttcgggcaaacctcaaacaaaatctaaaattttcactcatctggcttgtcattttgatcatgatgattgccagtggtgctggcaaattggaagcagcctttgcaggcggggcctcgggctctaaagagattgtcaaaatgctgcgagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggagccattgcgttgctattcgcgcaactaaccaataacacacgtacagccaatatgttgagctacatggtactgactgccgcttatttggttcggctggtcaccgatatccagcatcaaaatctgacgtggttatcaccaattggttggttcgaaaaagcaaacttctatactgataacaacgtctgggctttaggtttggccttactggtcagcattctgcttgcggccagcgccaccatgattgcccgcaaccgcgatctgggcgccgggattattgctgaacgcaccggccgagccaaagctgccggctggcttcgctcgatccctgccttactgtggcgaactgagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtagcattccgactcaaacgcgatgacaaccttggttacttgagcgtcattcatgccgaaaagccaacgcgaaccacgatcagtgtcagctattattgctttggtctgctggcaggcgtgttcgtcctttctgccgggctgctggccttgttcttcactgggaacactgttctcagtcacccgttgccgctcaagtacctcggtcgcctatttgcggctagcgttccggctgtgatatcgtttatcgcccttggcatcgcactagtcggtctgtggccacgcttaagcagtttattctggctgtatatgggagccggtctgattgttcaaattttccggggattgtttgatttgccaaaacacgcaggcaacttcacaccttttggctggattgccaatgtaccggttgaaaacgttgatcaaacatggctaatcgtgatggttgttagcgctatagtattatttattcttggtattgccggttatcgtcgtcaggatctgagcttatgaaaaatgttgtgacagatcccgaaaaagtcacccgtatactcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcggatttatgatcacatggaccccaaaaagtggcagaatgcccctggcttggctgccatgatgaccactgcagttaagtatgagttgaaactgcaattcaaattcccggctgaataccgcttgatgatgcaagcctatgctgatttaccgcattttcccgaaccgttgcgacaacaagtgcagcaagaaacaactgccatatccgctgaagccgatcgcattttccgcgagaaaattgaacagctgcctcgtcgtgagggcctgtcagtcgatgacgttttcggtgtcgtttctgccttaatcgcccaacaaacagcggtcaccaccagactcattgccagtggccattatcgcaagtttgaagatctgcagtccgtggttgagacgatggcacgccagttattgattgtcgaacacggctttttaccagatgaaagttgacgtcagctgatagattaaaaaaaccgcctgcactgatctgattcagtacaggcggttttttagatcataaaccagaaatgccttaccttattcaaccttttttgtacttgtcagcttgaacagacgagcatacaaccagaagtttaagatgccaatcgctagtagcaggccaaaagccagctgactgccaatcccaacattttgggcgtgagacaagcctgggacagtaacagccgtcatcatgccagctaaaacggtagtccccattgaacctgtcacttgctgccctgtgctatataaggcatttgcgtcgctttgatcatcaggttggatgactttcaagccatatgctgtactgttgccaaaagccatggaacggccgatggcaaaaatcagatacaagatcgtgacccaaagtacgctgatgtggcggccaaaaatcgtaaagccgagcacgccgagcgtaaatagcgtgttgccaagaaataacggcaaccgtccaccaaaatggtctaacatccaaccgtaaaccggctgaccaaggccattgaagacactgccaggcaagagaattaacccgccaataaaagcagttgccccgtcaacagtttgcacatagtttggcagcaaaaaattaattccaacattcgaaaactgcaagagaatatatggcagaaaactgtataggaaccctggatcgtggaaaacatccaacttaaacaaagttttggcgtgatgatttgacaaccaaacgaaaactgtcatggctgcaaccacgatcaataaacccacacacgcagttaaccatttccgatcactgacaccattcaatgcaacggtcaaactgatcaaggccacaccgagagccgtaaaacgcagccaatcaaaagcaaaatctgaagttggcgtgtattgtttgattcttccctgtcccagcacaagtaacaaaattgcaaacggcaaggtgctccagaaaatcattcgccaatcaaagaagtttgccacggcaccgccaaaggttggtccaagcgccggtccaatcagaataatgaggttcgcgacgcccatgtaggtaccaagtttacttgtcggtaccgtatccaaaataatattgaccatcagaggactacacaaaccgacacaacctgcttgaaccagccggcccgcaagcaacacccagaacactggtgccagtgcgcacatcaagtcgccaataatgaacagcaatgctgccgtcacaaacagctgtcggttggtaaatcttcttttcatgtaagcagaactcagcatgattagcgccgcggccaaaagatagcccgaagtcacccactggacggtcgtcaaagacacattaaaatcatgcatcaaagttggaaaagtgacattcattgaagtttccgttaacacccccaaaaatgacatgagcgctacaatgctgatcacaagcaatgcgtgccgagcattagtttcttttacttcaatcgttgtcttcgccatgatcaatccccttcggtttctatcataagacgcaatattttcagtaacaacgtcgaattttaaaagggcttatgaaagcggcctgaaatagcagccattttaacaatctttccatccataaatgcgatacgatagaagcattagttaacggaggaatcacacatgacaatcatcttgcttttcctcggctttttggtcggggcttttattatgacaatgggcggcggtggcggtgctttttaccttggcatcatgaccggcgtcgcgcatctgtcacccggcaccgctgcggcgacatcgctatttaccgccattccggccttggcggttgggtgttacagccattatcgtacagggaatatgcgttttcacgcgggtaacgaaatcctgatgaccgccgtgcctgccacgattattggcagtcttgcagcgccacatattcccgaagtcgtctattcatgggcgatcgcggtcatttttgtagtgctcggtgtccaaatgttacgtcaatcgttcgcgcgcaaagtcaaaaaagccacccaacctgcgtggttcgcctatgtcctcggcgcaattagtggcctcatggttggtgttgccggattaagcggtggcggcccgatcatggccggtctcatgttaatggggctcgacatgccacatgcggcagcgacttcttcgtacgctttagttgctttgtcagtcattggctgtcttttgcacgccacccaaggcacgattgcctggcaggtcggcggcttattgatgttaggatcgctggttggtgccgcgattaccccgcgtattctcaatcgcttcgatccgcgcctgctgacagctatcttgcggccaattcttgggatcatgctcctgataatggcggtggcccaggtttggtaacgcaattcaactaacttaaccaacagttattttttctgtgtcaaacttgaaaacagcgcgattgttttccttcaccttggcaacgataatgaaggtgaataaggaaggggtgaacgatcatgcatattgatcaagtgattcgcgaacggcgcctagctttaggactcacgcaagaggaactcgccaacaaaattggcgtttcggccccagctgttagtaaatgggaaaaaggggtgtcatatcctgacattaccttgctgccagcgttggctcgcattttaggcacggatgttaatacgctgcttactttcagtgtcacgatggatccagaagagagtcgccacctgtacgaaaaactgatgacgactgccaaagatgccggatggcaagcggccgttgatctcgccgaagcgcagattgcacattacccgtcaatgaatagtttgcagttgatgattgcggcttttttacaaagtctgaaaagtcaaatacctgaagcagactggccttcagtgtatcaacaaattgttgccatttatcaaactgcggaaaagagcactgatctgccacaggcacaagtagcggcccaaagtctcttttacctgtacctcaaggaaaaagattttgatgctgccgagaagcaattgacgctgttacctcctgaagtggtcgcctataacgccatggagccaaaattgaaattacagcgcggtcaactcatggatgcttacattagcggcgaaaagttgcttggtactggcttgggggccgtctcgcttattctgaatgtactcactcaagttggtcttgctgatcaccagcttgctgttgccaaacggtatgctgacatgagccaaaaaatagacaacctgatccctatctccaatccttatacgctcgaagctcagttgaaagttgcagaagctagtaatgacccaaatcaagctgttacgatcattaaagaggtgttggccaatctcaatcaaccgcagccactggtattgcagcatttgaccccagccaaaagcaaggaacaggtctcgctcaaggaagctcaacggcaactgttgcaaatcttcaccgccgatcccgaaatggcttttctccaaaaaagtcccagcttccaacagctactccatgaatacaatctctaacaaaatgacatcatgactaaaacacgaaaggccttcgacaggtagcaagttgtcgaaggccttttaatgtctcattcaattaaatcagttcgtaattttcccattattcagaaattcatacagataccgattcaccaatgggttgtgcccaggtagctggctatgctgcgccttgctattggtaatctcgcgctcagtataacttttcgcccgcccggcaacaacataccgcaaggaacgtgctgaattgactggcactcggccatctgtgcccttgcctaggttgccaaatagattcaaaacggcggcagttttgggaaaatacctgcgattgtcatacaacggtttgtaccgatccgacataacgttaggccgcccatctttagcaagggtaatatgctgtccgccgttcattcccggcataccgggaaacccgttaaacggcccggcaatcgtgattagtcgccgcaattgcggcatcccctgcttatctggcgtcactgcccagtttgcccaagcagccgaaccggccgagtgcccgacagcgttgaagttcttgataccataacgtttcttcagttgtttgagaattttacctaaggttggcgcatctggtcggccgctgctgaagacaacggcaatcagtgggtgtttcacactggcagaccaagaaccgctcacggacaactgcccagtgttggtgacggtatagcgtaatacttgctgatacccgggatgtttgctgagatcagcaatcatatctttttccgatccatagccaccaccaaaaccatgaacaaacaatgttggcgtttggtacgtacctgctgctcgcgcagtggacggtgccgacccgcgattcatccaaaaccacgcaccgccactaatgatgagtacgatgaccactgccagtatgactttgatccattttttcatgagcataagccctcgccttcatttgaagcttcatgctttgcattctaacacgatctcactaaattaaaaccacaaacgctcttgcttcgtctatcaactatttaagtgaattaacttgccaaaacacaagatcctcggtatagtgtattagtaatctaatacactagtaaggaggcacaccgtggaatttgacgataagatcccaatctattatcagatcaaacaatacttgtatcaggaaatcatcaccgatcgacttaaatcaggcgatcaactaccggctgttcggcaacttgccgcagacctaaccgtcaatgtcaacacggttcagcgcgccttgactgacctcattcaggaaggcgtccttgaaacaaaacggggacgcggcaatttcgtcacaaatgatatgaaagtgctaattgatatgaaaaaacgcgtcattgcgacagaattagatcgcctttatcaccaactatcagaattgaatttaagtgatgaggaaatgaaagacgcattcgccgcttatgttgatgagcaggaggtaaaacatgacaactaacatgatcacagtcaaacaattgacttataaacgcaatcgtaaagtgattctagacgacttgaatcttgacctcgttcaaggtcacttcatcggcttattaggtgcaaacggtgccggcaaaaccacattgatgcgactgttaaacggggtcgcgaccacttttcatggcaccattcaaattggctcatcagaaagtattgttgaacggaaacaactaagcagcttcagtgagtcgttaaatggcgtcaacccaaatcgaacgatcaagcaaattgccacttattatgccgacatgtatcttgatttttctgaagccgagtttgctaactttctgaagacatttgatcttgattcccaccagaagctggcggccctgtcaaaaggtaatcgcaaaaaattgatcgctgcactgacccttgcccgccaaactcaactttatctgctagatgaaccttttgaaggtatcgatagcatgacgcgcaaacggatcatcagtaacttgattgcgtggaaaccggcagcggcaactgtgattatttcggatcatcacgtaagcgacgttgccaatgtgttggatgaggttgtcatcattaaagacaagcacgtggtggcacaaaaaaatgccgaagagttgcgagaaaaaaccggcatgagtattgaaaactattatgaaagtttctatgaaggaagtgaccaacaatgactaatacatggacaatgatgcgaaccttgacccggcaacgttcactaacagcatttaaaacattcatcgtgactttggttgcgaccgttgtatcaatcctactagcgatgttcactggtgaagcaaaaatcaccgtcgattttg

SEQ ID NO: 48 - DNA, 2682251 bp, Lactobacillus paracasei (residues 1,341,127-2,682,251 of 2,682,251)
  modified_base (2389101)..(2389198): a, c, t, g, unknown or other
  modified_base (2582402)..(2582637): a, c, t, g, unknown or other
tcttaacccttctctttgcttatgctgtaattggcggtttggtgttttttgttagattggcgatcattcaagagcgtgtttgggtcaataactactatcgatcagtgccaaccaccaaccttaaactttatactgctaatctgctggcaacctgcctatcatttctgatatatgctgccttcgaaggtgttgttttactagcacttgcagtgacgcgttggggtatcaacttaccaacgggtgatcccatgaccgtgttagtcgaaatggggatattcctgattgtcttagggatatttatctgggcatttatcagtcttgttcacttgttatcagtgaccattatggcgttcctgccagaaactcgaattcgccttgttcaatggattatctatctggtggttatcattgttgcttcgttcatattcgatcaggtccaacgcctgttcttactaccctttggtggttatgacagcaatactttgacaggttcttcaagcgttctcgtcggcatcgggatcttcatcgtcaccatcctgctgatctctgcagtgaatgtttacctgcttgaaaagtgggttgaaactaaataatgcgccctaaacgatgaaacctattgacaaaaaaatggggaaaatatgcttaaaatcatagctaaacaatttttacaaaactggaagatatggctggccctcttaccgattttcattgtttccggcatcgtcttcagtacatctctaattttactgacggcgatggcaaccattcctgtcgcttcaggcactgattatggtgtttttatgcaaacgccgatcatcattggtggggtcgttttgtgcttattaacgaacaatgccatgaaacagtgtatcgatttctttgatgacacgaatgatgtgatgctcttgctaggggcatcccctgtccagttaagttttctgatgactgggcaagtgctcctgactggtgtccttggcgcggttatcggcatgcttttcgcaatcccagctggccgcggttttttaagcctcttacccgtgagtgcttcttctgagtctttagtcaggctacctctgagcttctcatggcaaatggttcgaaccgttttaattcttcaggctttgttgatcgtgatgacttgtatgcgttactgccttaagacttaccaacgaagaaagggcgcgttagttgcgagtctgcacaagcatcgaaaaatcgtcggtagttttctaggaatcgtcacccttatagcaagtttggttgtgacaatcctcctatttttaaaacccgtgcctgatccaacttcagccaatgcgtataacaacagtatgaagggttcaatgaattttttactgttgctatggcctttagtgattatcagcatgaacttcctgatcagaccgttgtttatcaaaatggttcgcgtcattgttcatataccgtccatggccaaacagccgatgatccgttccgcctttcatgacttgcaacaccacgaggaggcggtcattaaattaattcgcccggtcagtgtcatcgtgttacttgccggaaacttcatcgctttgtttcttaatacgaagctgctagtggatggcaacaatggcggcgcggttatctatgatctggcagtgagtctgatttttgtatttggggcacctatcatgattagtcttgccagtattttgacatcaattagtctttttaaaatgaaaacggcagcagaatctgatcattactttttctctgggtgcaccccaagctggatcatcaatttaaaactgaccgaaatcggtgctgcaactattctcgcaatcttaataacatttcttggaacaagcctattcgctattccgctgttgcgagttgcgtttttaggcggcggtgatctttctaaggcaaactggaccgtcaatatcctcctgacttttggggtattcggaatatttttcctttgtttgacgctggtctattggtcagaacggacgcaccgcaaagcttatgtcaatgaataagcatacgaggaggaaaagagatgaatgatgtagtcgtttccgtcaaacatttaacaaaagaggttgcgttagctcagggaaatacgctgaaggtgcttgatgatatttcttttgacgtcaatcaaggcgtatttgtgtcgattgttggtccatccggatcaggaaaatcgacactgctctactgtatttctagtctattaccaccttctaaaggcaaaatcctgattaaaggaaaatcaccatacgagtggcgtgcttcaaagttggcaaaatttcgtcggaaagagataggttttatttttcaggactttcagttagtcagctctttatctgcttatgacaatttactgcttccgggtattctaaatggtcagaaaattaaaccgccaatggttgacgcattagcagcgaaactcgaattgacagccgagttacaccagtcgattgacgcgctttctggcggagaacaacagcgcgtcgccattgcgcgaactgtgcttgctgacccagatatcatttttctagatgaaccgacaagtgcactagacacgcattcacgtcagttagtcatgaagctatttcaagaactggtcaatcaaggcaagactttgatcatggtcacccatgatttagaactcgctggggaaacttcacggtcgattgtgctacgagatggccgaattgaaagggagattcaaatgcccgcggctgaaactgtgcgtatctgaatcattggcaggcagtttctgtttagctaatgattgaagtgatattacaattttccagttcatttccacgtcctcttcgcgtcaacaatgaaacagcgtccctcagcctttttaaggcatgagaggcgctgtttgtgttagacctttctgttcatttgtaaccactcgctgcgtaataaggagtattcattttcatcatggaaaccatctgctagtttttccccggcgcgatgagtgccatcgtgatgaaaaccggcctttttggcgacggcattgcttggtgcattgtcgacagcagcgcgaatgatcactttgttgaccccgtactcttcaaaaccgatctggcacattgctttcaccgcccgatgcatcagcccgtgaccacgcacagcttgtttaagccagtaaccaatatcaccactttcatcactcgggcgaaaatgattgaagctgatcatcccaaccggctcatcccgataccataaaaccaagttcattgactcctcacggccaaaatgatcattgacgctccgcaaaaatgctgcttcctcggcctccgtttttaatccattcgcccaaggtaaaaatcgaccgatatcatcgcgttcttgatcgataattgcaaagagcggtgctgaatccagccgcggacgcggtaatgccaacttaaaatcgtcatcaatcacataacttaacatgctaaacaccttcatctcgcgtttattgcgctaacacccaatgcgccggtgctgcttcgaccagtgaggcagtcggatcaagcgcctgccggtcaaagtgcaacaccggtttttgctgctcaagcattggatcagcctgcggaaccgatgacagcagcgtctgcgtgtaaggatgcagcggatggtgataaattgcatctgtatcgcccgcctcaacgatgcgaccttgatacatgaccacaattttatcactaatgtagtgaaccatcgatagatcatgggcaataaaaagataggttaagtgttgttcatactgaatttgccgcaacaaattgacaatctgtgcctgaatcgacacgtccaacgctgaaatcggctcatcaagcactaaaaacttaggctgtaccgccaaagctcgagcaatgcctattcgttgccgttgtccaccagaaaattcatggggaaaacgattaatcgcgtctgcaggtaaaccaacctgcgtcaacagtcgtaaaacttgcgcaagccttgcttccctcgaggtggccaaatgaaaattgtcgatgccttcagcaatgatatcgaccactttttgccgcggattcaagtattcgaacggatcttgaaacaccatctggacctgacggcgaaagcctttgcgcgccgcatgtgaaaaatgacggatcgactgaccgccaaaaagaacatcaccaccggaaatcggaccaatcccagcgatagcgcgtccagttgttgtcttacctgacccagactcgccaaccaaaccgactgtggttccggcattgatcgtgaagttaatttgatcaacggctttgattgcttgccgccctttataaaaagtgacacttagatcgttcatcgtcaataacggttctgtcaaactggcacacctcccgcttgctggctttcaactactggatcgtttgtctgttcagcatgcaactgagcaaatcgcgcccaacgtttctgaatagtgactggtggctgatagtgtggggttcgcggatctaataaccacgaacgtacaaaatgtgtcggcgatacttgaaacaacggcggttcttttttaaagtcgattggcattgcgtaaggattgcgcggagcaaaagcatcccccttaataggttgatgcaaatcaggtggcgttcccggcaaggtaaacaattggtcacgttgatcatctgaactaggaacggcatctagcaatccccaagtatagggatgctggggatgatagaaaatctcgttagctgtccccacttcgacaattttgcccgcatacataatcgccacacgatccgcaatgttggcgactacgcctaagtcatgggtgatgaaaatgacactcaaatcatgtttggctttttgcgctttaatcaacgccaaaatttgtgcctgcaacgtcacgtccaacgcagtggtcggttcatcagcaatcagaactttgggctgcatcaccagcgccatggcgatcatcgcgcgttgacgctgaccgccagaaagttcatgcggatatttgcgggcaatcaaagctgggtcagctaatccgacatcttcaatcgccgcaaacactgcctgcttcaaggcctgaccgtgaacatggcgatgcaccttcaagccttcgccaatctggcggccaatgcgcatcgtcggattcaaaccgctaagtggatcttgaaaaatcagccccagctcttgcccgcgcagatgggtgtactgacgccgactcgtctgcaataaatccgtctcgccatacagcatctcgtcagcagtcaccacagcatccttgcccaacaaccccagcaaagcatgggttgccaccgacttgcctgatcccgattcgcctaccaacgctaacgtttcgccttgacgcaaatttaaatccacgccgttaacagcataaacttgttcattaccttcattaaaaatgacctttaaatttttaactgtgacgatgtccgtcatatgttcacttccttcaatcgcattttgaacttaacaatgccgctaaccacttacttttcatatagaaatagatcgacgataatgccgccaaacaaattgatcgccgttagcacactcatctctaaatttgtcggtaagtgtttgataaactgtgcagtcagatggccatgcggtcgttcagtatgccaaatcaatctcatagccagcaagaacaccgtcacgcctgcaagaagccaaaaggtttgatgaagcccccacaacaaggctagcaggaaatggttttggcgcagtgcaaggcctgttgtcaccaacaaaaggccagcaaacgcacctgcgacaatttgccaatgatgtttctgcatcactcaaaaaacctccttttcttcgcattgatttcaggcacataccagtagcttttgggtgagacaaaggtcgtctcttactgtcatgtgcgctaaaattagcctagctttggaatttagggtcaagcgcatcccgcaagccgtccccgacaatgttgaaagcaaaaacaattgcaaccaacactagaatcggcacataaagctgcatggggtgctgcaacatctgatcctgaccatttgaaatcaaaatccctaagctggtattgggtgcctgaatgcccattcccaagaaacttagacttgcttcaccaaaaatattctgcggaatgctttgaccgatgtccaaaatcaaaatgctcatcatgttgggtacgagatgtcgtgtcataatccgccatagcggggtgtctaacatcactgcggccgtcacgtaatccaatccgcgtaattgcatcaccaaaccgcgcgcctgccgtgctgaactcgaccaactagtcactgccagcgcaaataacatcgtccaaacgccgtcgcctagcacgatcatcagcagcatcgtaatcaacaaactcggaagtgaattgaaaacttcaataatccgcatcatcacttcatccacccagccgccaaaaaatgccatagtcatgccgtagatcgttccgaacccaatcgccaagatcgtacttaaaatagcgaccaataaggacacttgaaccccaaggcatagacgggtaaaaagatctcgtcccagtcgatcggtccccagccaatgcgcagtactcggaccaatattccgactgtcaactcggattagatttggatcatagtgttgtatttttggcccaataagcgcaaccatgacaattaaaatcaaaatcacggtccagaacatggctaaccgatctttgaatagcttgtgacgcgctgaggcccagaaaccaacacttttaggcacaccctcgtggacattgatttctggcgttgcccctgactgatcaaaagttgcgtcagagccaaccgatgcagcttcactaccaactgtcggttcttttttgaaaaattgaaaatcctgattgcttgcggccatgtgttgattagcctccttaatggcactttgtttaaacgcgttcgctgacccagaaacctccgtgtaaggacctcaagcgcaatggcccaagtgcggcccatcacgcccaaggcctcttacactccggtttctaaccgggtcagctcacgctcttctttaaacgcgttcaccagcccagaaacctccgtgtaaggacctcaagcgcaatggccaaagtacggccatcacgcttgaggcctcttacactccggtttctaacccggctggctcacgctctgtcatataatttaatgcgtgggtctgccaaggtgtatagcatatcggtgatgaacattgtgacgatgtagaggatggccagtaggacggtttcgcccatgatgataggcacatcgcggttgtttaaggcggtaacgaagtattggccgacaccagggatcacaaaaatgctttcgatgaaaattgaacccgtgatgccgaatgccaaggtcaccggcaaagaagtgatgatgggaattgaagcattgcgaacaatgtggtgcaacactatctgcgattctgatagtccttttgcccgagccgtcatgacatattcactagaggcaacatccaccatcgaattttttaaaaggcgggcatagattgcgatgtaagtcacgccgccagcaatggttggcaaaatcgtataaatccagccgccccaccaagtttggtcgccgctgggccaaccaatgattggaaaccagccaagtttgcctccaaagtagctttgcaacaacaatcccagcacgaggcttgggattgacatcagaaaaagcgctacaatggtgaccgtccgatcaagccatgtatttttatacacggctgctaaaatacctagtaacaaccccagtggaatgccaaacagcatctgttgaatgcccaatcgagccgatgcgggcaagcgatcccgaatcaagctgctaatcgtcactgacggatcagaaattgattcaccaaattgaccatgaagcatgttgttcatcgtgataccatgacgttccaaaactggcttatctaagcccgtattttgatacacctgtgctctggtagctgctggcagtttgtcggtttgcgcactcaacgcatctcccggaactgctgcgaccataaaaaatgtggccgttgcaattaaaaaagtagcaatcagcaattcaacaaatcgtcgaacaatcaatttgaccatggtgctaattgcccccttttgacatcgtcatgccgcataaactgacatctcctttaaaaccctatggacaccaaccgccaacatcaatcagcatcaaaaagtcatcattcttttgatgcgtaagtgtaattaaacgtaccgccgaagaccgtcgtttgaagattcttgacagacttattgatataaatccgcgattgcgggttggtcaatggtacgacaccgaagtccttggcaaccaactgattttcaagctgcttgtagagcgttaatcgttgtgccgccgtgaggttaccgtttaattggtcgtccagatcatcaaaagtcttgctgttatagccaccaaagaatttttggaatccattgccagaattccataggctcaagtaggcgttcggatcagccgttgctaaccagccattagccagcagatcgtattgattgtcatttcgcatttggataaagctggcagtatcaggtgctgttttgacggtcactttgacaccaagattttcctgaatcgtttgcttcaaccacgtggccgtatcatcactgccaagcgtcaaataaacaaagttgagtttagtcaaatcagtcgacttccctaattcttgtaaaccttctttcaacaatgcttgtcgcttcgccttcgtgttgtactgtgcctgtgccgttttcaacggattgccgacgtactcgccataattggtcccgctcacatccaacgactgcggcaccatcgtgtatgttggcttgtcccgaccatcattcactgccttgttatagctcgttcgatcaattgacaaggaaaaagcttcacgaaccttcacatttttgaaaagtccttgggttccaccgttgtgttgattcatgatcaacactttcgttgtcgaaccgttctgttttcgagagacgagtttgctgcttttggcgagttgattaaaatcgctgatcagcttgcctgaggcagatagtgcgtccaactgaccactttgcatgagcgaaagaaccgttgatggttttttcaccgttgtgtaattcacggtctggagcttcactttcttagcgttccagtatgttttatttttcttgagcgtgatcttgtcgtcctttttccaagacgtcaatttaaacgggccattgaaaacttgatcttgcacgtcggttttccactttttgttgccgactttgttaatcttgtccaagcgcaccgggtaataaatcacggttgccatatctgacaaaagtgatggataagcataggccagcctgatttgcagtgttttcgcatccaaggctttcacccctaaagcggtcacactgcctttgccggtgttataggcttcggcccctttgataaagtacgcgctcgaagcctgcgcaaaagcattttccttcttcagcagacgctgaaacgaatcaacatactgctgggcagtcacggcttttccgtctgaccattttgcatcgcgcaacttgaacgtataggtcaacccatcggccgacttggtataagatttggcgccggtcagcaccaccctatccttgccattcgtcgattcaatggtcgtcagcccttcttgcacctcagacaaaatgtcattttcgttcgagttccgcatatcattcacatcgagtgtggttggatcatctgtttctgacaaattcaaagtctgccttgaacccgacgccgaagtgtttttactgccgcaagcgacgagaatggtggcgagtgccaagccggtgataagtgctgttaccaagtggttcttctgcataaaaaattcatctcccaaaacaaaataaaactggcgatgcatctagagttctagatacaccgccagttttgtccttcgttcaagtcaagtaatcccgtcacccaaaccaaaccctagccatgtaaatagaactgctgtgtgattcacagcagcagcacattgacatggacatggcttggttaaactttgtcatcacggcgactccttccgaagaaattagcaacagcatacttttaaaaaaatagttcgtcaatgtgaaaatttaaaaaattgactcattggcattgcatcatcgtcatcatttggcaacaaaagttcgatgtatcagtgcttataggcaacataaaaacagcattaaaaaactaatgtttgagttgcggtaccagtaaatcagtcagtgctttgacagaaaatgggttttgtccggtaattagctgaccgtcttgaactgcgaacgacttatatgctcttttttgtacaaaatgagcattgtgtctatttgcaaccgttttgtttaaaaaaggaacaactttttgtttaccggctaaaatctcttcagcatgtgtaaaacctgtgatcttcttaccagcaatcaaatactgaccagcttggtctttgatatttagcaaaccagcgacgccatgacaaactgatgtcacgtatccttgatgctgataaattgccagcgctattgcttgaagtgcctgattgtctggaaaatcccacataacgccatggcccccagtgaaataaatggcgtcatattcagctggattgacttgctctggccgtaatgatgctgtcaaagcgcgttcttgaaaatcgtgatcttcatatattttcatgattgctgggttcgtatatttcatgcttcgtggatcaagggggacaaagccgcctttcggactcacatagtcaaccgcgatgttggcttgctgcatcgcatcaacaaattctgctgcttctcccaaccacaatccggttggttcatctgtatgctgataacgggttgtattcgttaacacaacaagtacttttgtcattttgctgcctcctgaatcacggatgtcacatcatccaaaacttgtttcagctgattaattgagcttgtatcatgggataaataataataattccgcgttccctcgcgccggtatgccactaatcccgcctgctttaagattttcaggtgatgtgaaaccgcaggccgcgataacgcagtcgccgtcgtcagttcacttacgcgttttccctgacaaggttgatccgctaacaaagcgatgataatcgcttgacgcttttcatcgcccagcgcgacaagaaaatcaccaacatcagatagttctttttgcaactgttttaggcttgacatttctttgccctttcgtttaattatttaaaccattaaagcatgtaatgttgttaaagtcaataaatcgacacttggaggtgagaccacgattactgggattttccttccacagaaatgcgcttgtctactcctgaccggcaacaaaaaagctgatcacagcgtgttgccgcaaccagctaaactgaaccaaaaataccatctgacttgacgcctatgcgtgcgctgatttgcgcatcaaaacggctaacaagacgatccctgcaagtgtgaacaaaattgccggcatcaaattagcggccgtaaacatcacgaaggccatcgtggcgaacaagccgccgatcgacaaaccaatgccccatttttgaacggctgtcaagctatggaaagaggtgcggaaacctagcgccagcaacaatgaaccagcaaaagcaacgagtccaaaaataatgtggcctaaaatcaaccagttgaacatatgtgtctcccccttatcgtttgcggacaaatgccaactgcaaaagcccgtgtgtcatttaaaagtatgacgtcttaactatacgtgagactatcacccctgccaactaaatctttcgagaataatcacccggtaacatttcgcccgccacatggagttggccgtccttcaacacgactgcatgatcccaaaaacggccaatatcatgccgatgtgaaatgacaatcatcgccaccggcaactgccgcaggaggatgccaagcgtctgtgccgaggccgcatcaagatttgcgaacggtttcatccaaaagtaacatcggccgctgagccagcaaagcgcgggcaatcccgattttttgcaattccccagccgacacattgacaccatcttggccatgcacaagcgtggccagtccttgcgggagacgcgcaataaaatcggttagcccaacttggtgtaggacaagcgtcagttgctgatccgatacttgccggccaagcgtgacattattggccaatgtgtcctcaaataatgcaacaacctgcgggacaaagctcatgctgtttgctgatgccgccagatcgcgcttgtctgtatcttcaaactgaatcgttccagcttgtggcaccaataaacctagcatgaggcgaagcaaagttgatttgccgccaccacttggaccagttatcaacatcttcgcgtgtgcagtcacgtcgagctttaactgtagctggttcaaagtcggttgcgtagcatcaggataagtgtaagagacattgcgaagaacaaatttagctggtttttgtcgcgactgtccacctgccaactcctctttatgcagcgattggatcaacggcaacaaccgtttggcagacaccaagttgcgcgtcaattcagcatactgacttggcatactgtaaaacaaccaagtaaaactcggtgtcaacatggaaaatgcagcaaattgaccaatggtgatgaccttgaagccaacaaatagcagctcaatgcctaaaatcgcaatgtcaaaaacgagccccaacgaaaatcccaacacaactgttttaacttgttgcatccccatctgatactgtgcctgagaaaacttctgataggcgccgttgaatagttgcataccaaactgttctttttgatagcttttttaacaattcgcgaccgttcaaaatttgcaagaggctttcctgcatctgactattctcaatctgtcgctgattttgcgctgtttgtaagcgaccggacatcatcttcggaatcaaaagtgccgttgcacacagaccgatgatcaatagcgttagttgccaagagctgaatagaccaaatgttccagcagctaaaaaggaaaaaccaccaaccaccaaagccgtcatggagcgcatcaacaacggcgcagcagtctgcgcatccgtggtgaacccgttgaaccgccgcccgctagcttgattgtcagttgcaatcggcccattcatcaaagctgccatcaattgcgtttgaattctttgaatcaattgatactgaccgcgcgtttgcagctttgccatcacaaagcgacctaaccctatcaccaaagctgtagctgcagctaacgtgatcatgctgactgtaaaagcagcatgttgcatcacactttgaatcacttgtgccagtaataactcaagaccagcacaccccaaggccagcaaccataaaatcgagacaagtggactgtcaacaagccgccaaatttttttcaaatcagttatcatggtgatcacccaccttcaacacctgatcggccgcagtcacaaaatcaaacgtgtgcgtaatgatcacaaccccgcgcttcttagcttcctgccgcagcagttgcatgactgtttgttgattaaccgcatcaatgtccgaaaatggttcatccaaaacaataaatggacgatctgcggcaataccgcgaataattcctaatcggcgctgttcacccggagacaattgattaggttgtaacgtctggtcaagatcggcagcataccggtcaagttgcagttgctttaataatgctgacaactttgtcggatcagcctgagaagccaatagcaaattagccatcacggatgccgtaaacatcacactccgctgcggcacaaacgcaaacaacgatgctgacttgattttagcaggcacaccctgaatctcgattttgccagtcgttggctgcaattcgttgagaatcagcttcagtaaggtggttttcccagcaccatttgcgccgatcaaaaaggtgatgccttgattatgaatctgaaaatccaaatgttgtaaaatttcccgattcgtttgcggataatggaaactcacctttgtgccgcgaattttaatcgtatccgcctgatagtcccccttcataggcgaaaatgctggcattacctgctgtgtcagtcgtggcaatacgcgatcaatagaggttcgttgctgagccaagaaaccaatcgtcggcgccaatcccaaaaatggccataggattgaacccacgccagcattccaggcacctaacagaccggcaactgaactaccagtgacggttaacatggcaaaccccaccatcaacgttaagacctcagccaaatagacgccaccattgaaaataccggcaagcgcgccagaggccgttgccatttgcctcatgcttggcgccgcttgctgaaaataatcagcgtgtcgttgacaactgtaagcaaacacattcagattgcgaaccacagcgacatttgccaaaaaatcattgaaaaacgctttgtgcttgtcatcaatttgaataaaagtcgtttgcgcttgattttgttgacaaaacaagccccgcgaaacaccggcaaataaaccgccgaatgctacaaacatcagtgccaactgccaagactgcgtcacgacataaatgacgccaagaaaaaccgtgatcccaaaatcgaccagtggcaaaaccccctgcatccagaaattgcatgatatgctgcgtgtccgttacgatcaaattagtggcagttccattatcgtgcacctgtgtcgcgtcgtcttgcaaaaagttagccatcaaagcggtcgcaatgtcaccactgactcgtcgtttgagacgttctgtgacaacgcctgacaaaaaataaatcccagtgtagacaaccgctgccgctaacatcccggcaaaaatggccacaagcaagttgacctgtcctgaaagtgcaacggtcaaaccaagctgtaccagcatcgaaattaaaacgttaaaaccatcaatcagcactcgtagtgtcagtaagccaagcaaccagcgatatcggatagaagtgattcgtaaaatagtttgcatgctttaagtccccttcaagcgattgttctggccaatcgctaactgttgggactgcgcttttggcaacatcatgcacctacgcaacagcttcaaaacacacttgctcgcggccacacaaaaagacggcttcgcagccgcctttaatcaacgcaaataaaacaatacacatgattaacgaccagaagcatccccgcgaaccgcaaccaaaaaactgattgccaacgcagtccctgcgttcaaatttgatagggtaaagcgtccattgatccgcattggaaaatgcctccgttctgtttcaaattttattagccgtagtttagtaaacgacaaaaccatcgtcaattaatttgcctcatcagcaacacaaaaagtgtacccatttcattttcactaatgcgctaaatcatcacagcaccaattttgctaacaagttgcgccgctaaccatgattccctttttgaaggctgccaacacatctgcaccattggcaattcgaacactgccatccaaataagcgtgagcatcatccttaatgctgatcgctccattttgaaaattcatcgctaaaccgctggcaaagaaaatcatgtcatagtcagacgtatatagatccagaccggcatcattttccaatttcacctgatagcccgaatccggttgatcaagcacaatcaacgtaaatttcgtcccgatactgcaggcgccgccttgcaacgaataccgcccgccaccatcatctgtaatcagcaacaacgtcttctgatcaagatgcttcttcttcatcaaatcaacaaaagcctgcgataatttgatcgttgccattgtatcgtcacctttcttgttacttacttttagtgtgacactttcaggtggaaaaatcaattgtgcgcgagtgaattaaccattcatttgatcataccagtgatgaaacaagttcgattgcattttgaaaaacgcctgcaagactagcttgctcattgatgacaatcaacaaccccttcaccaaccaaagctgaaccgtcatcagaaaaagatggcggtcagtaatttgaatcccagataaagccaagaattcattcaaatatgccgtcagatcctgtttatttttcggcataaaaccttgaaacaacgccgcaaagtccaacaacttcgggccaaaccgagcttcaccaaagtcgatgacaacgacttgccctgagttagtcaccagtaaattccaatcctgttttttggagaaagaattctaagattatccatccagatgtttgatactttagaaccaccgcaggaatcgaacccgcgtgcgaaagagattccgcagcaccagcgtggttgaagatcattttaggcaaacattaattgccgttgtaagtcccatcattacctgtagcgacggcggttgacgctgcgtagtagtcaccctgatcaacgacataaactccgataacaatattcttgaagccagaattaatgatgttttcgtagtgaccgcctgttacgccgtgattgttttctggacgttcatcaacaatgtactgttggaacatcgcattggcaatcagtgtgctgagtttatcagcactaccgtcaacatcctttttccagagcgaagaagtcgagatgttttcagtgctgcgattcatgtagacttcacccttttgataggtgacattttgcgagccagttgctggtggattgactggacgggtgtggctgaatttatacatgacttcgaccgcgcgcggcgcttccatcttgtaggcttttggatcagatgtcagcacagtctgagtacgaccagttcttgcttgctcgccattaaccagcacattgaacttcttggcaactgctagcgtcaaatcggcgtcagtgtaggcttcagcttgttcaatggagaccttctgatcgtttgtctgaatctgtttttctatgagtttcgttgtcgcatcgttgacactcttgatggcgccgatgatggttccggcagcctcaacgttgcgccaaatgttagtcgtggtgactgtcgtgacagtgtccccgtatccttcaattgctgttgtagacgtcggtgttgacgaaaccttgacgtaaccagtcttatcagtcaaggtatagccgccttcatccacgtcaacttctttgtaaaccgttttggcttgcgtcttatggtacttgtttgtggttgtcacaaccttcgatacaacattaccgttaccatcaaggccaaagttcgttactgtcgtatttccaataaagtaataaccatccgttgaagtcaacaccttgtcattttcatcaacattaacagttttattagttatagtgacgcctgtcgtatccttcttccagataatcgtagtcgtgaaggtggtcgtcacatctccagttacagggtccgtgacatccgttgtcttgacagaactggagtcctgattgtaaccattcgtgttggtcaaaaccttccctgattcatccaggttcacggtttggttcttgatcaaacgctgcggcgtcttttcccaaacaacggttgtggtaacagttgtggtaatgttaccggtcttaggatccgttgcatcaaccgactctttagagctggatacaattgaatagccgtctgtatttgttaaaacatgacccgatttgtcttcattaactgtcttaaggtcgtacgtgtgtgttggcgctggggtctcgttcttcttccaaacaacggttgtcgtaatggtcgtggttatattgccggtcgtaggatcggtggtatcaacagatttcttggaactggatacctgcgtgtaaccgtccgtactcgtcaaaacgttacctgactcatccacattaactgtcttattaacagtgacgtgcgtcggtgtctcagtcttcttccagacaaccgttgtcgtaatggtggtggttatattgccggtcgtaggatcggtggtatcaacagatttcttggaactggatacctgcgtgtaaccgtccgtactcgtcaaaacattgccggcttcatccacgttcacagtcttattgacagtcacatgagtcggcgtctcagtcttcttccagacaaccgttgtcgtgactgtggttgtgatgtcaccagtcttaggatcagtggtgtcaacggatttatccgaactggagacctttgtgtaaccgtctgtgctggtcaaaatattgccggcttcatccacgttcacggttttattgacaacttgatgcgcaatcttgtgatagatattggtcgtagtataagtcgtaatggtatcaccattagccaatgtttcaaccgttttaactggggtgccagccgtgagcaacttgtaaccagtaagatcgattaggacctgaccattttcatctttgttaatcgtaacctgcttttcggtatcctgtggtacatggattgttggaattgtcttttctgcatcagcaactgtttgctgaactgctggcaatgtctgttgatggtctgtcgtatcaaccttggatgcttgtgtttcagcagttgttatattggccttggctgcttccacattggtttgggctgtggtcaactgatcctgccatgtagctatctgggtatctaaagtcttaatcttttgatcaagctggttgatcttcgtattcagatcagcgagttgtgctttgactgcttgcgcgacttgactattttggctggcaaccgatgtcggaagtgcctttaacgtcgtttgtgcctgtacaaaatcgttttgggccgccttggcctcattgtcaacgctgatcagtgcctgattagccgtgttgagattttgaaccgcttggtttgcagcctgtttggcttctgccaaggcagccgttgcatcagctaattggccttcataactagtcagcttgccttgtgcaacagctagctgagctttaacagtcgtaatcgttgcttgtgagtccggattatctttggtttgctcggtcaacgtgttcagttgattctgtaaatctgtcatctgagcagaaagcgttttaacctgcgcagatgcttgatcaacagcagcctgcttagcattcacagctgcattggcggtgtcaaaagtggcttgcgcttgggccactgcagtttgggctgctggcaattttgcttgggccgcatcaaccttggttttggctgcgtcagcagcagcttgggcagctgtccgcttggcttgaagatcggtcaatgtttgagcattctcagtattgagcaaagccgtcaatttcgcttcagcttctactttggctttttcggccgctgctttttcagcttctgctttcgccttggctgccgcagctgccttaatggcggcgtcattatctttggcaatctgatcaatacctgctcctgaggtaattccttgctgcccagatccagaacctgagccaccaatagttgtgtatttcacttcagcttgttgtgcaggtgtcgaaatcgctggtttagcagggttcaaattaaatgtctgattcgtgccagcagcattttgcgtcgttactgttgcgttgtcgccactgccttgcagagaaagcttagcgccagcataaatcaagttcacgttagcaatgcggttaatggctgccaaacgatcaactgaggttgtgaaacctgtatgattcagcgcctcgctgatcgtcgaaagtgtgtcaccccactgaatatcataaaccgtgctattcgacgccttaatctgcgcctcaatctgactgactgggcgcagggtccaaactcgtccattatttgtctgtgattgttgcgaggttgctggttgatcacttgcatgcacaacctggccactagtcgccaaactaatgcctgctgtccccaatgcaaaagcggtcaaaccaatggccaaccaaccatgatgtttgctgtgaaccaaggtgaccttgtgttccttatctgtaagtactgaccaaagctgtcgtctcattgctctcatcgttactcctccacgttcttttatgaaattacaaatgttattatacttcgttattaacaaagcttgtatttattaccccaaatcaaagcgtattctcataattttcttttttattgaagcatcacctttttgaattgatacgtaaacgtgaattgtacttcccaatttgaacaaaaccatttgtcgaagcaactaaagccgtcttttataaccttaacctaccgtttcgtcacacgaccaagttcctgcgatatccttaaaaattcagtccagagctgcatgacaaactgcgataaggtaacatacaataacagtatgcttttgcaaactcattttggaaacgaggccactcatgaaacatcgcaaccgtttattttggctgattatgcttgtggctgggatctttttgatctatagcactgaaagtccggtgccgatcgctgctcgcaacaccgtcaagcaaggcattagcaatgtctggaccgccacaactgataccgtcagcacttggctaaacggcggtccgcgatctgtcgcaaaaaatggtgcgtcaattgccagcaccgcgccaagtcaagcgagtcaggtaccttcagccacaccgagtcaagcggtcgatgccacaccagccttgagtattgttcaagggcaccaacttcgaagtgtctattactaccattttgatgacgacttgccacagtctgaacacgatgtctttttaaaagccgtcaaagcgtataacgcaacgggcatcgtcaaactggttgccggtcaaggtaaaaaatccgataaccagatcacgttttccagttataaaaaagaaatgtcagcagagagttttggctcaacggaactcggtgctggcggcccgacaattattgttgaaacctatggcagccaagtcactgtcatcaaccacgcccgcgccagtctgaatctttcttatcctttacaatcggtcaacgatgcagtcgcgatgcacgagctcggccatgcgttgggactcgatcacagtcagtcaaaagcatccgttatgtatccaattacgcaaggtgttagtcagctgtcggcaggcgatattgcgggactgaaggcgatttatggcagtcgataaaactgttttatttaaaacagttattcttggtactatctgcatttttgtaaaaactgcgttactcaaatcagcatcattatttttaaatgggaaatcattaaatactaccaaaaacctcgggcaaaatttgaaaattttgcccgaggtttttattatttgtcaaactaatttcccttaccaaacggtcacttgaatgacgttgataccttttctgcgcgcttgctgcaacaccgcttcatctgcaaaactatctgtgattaaaacatccaccatgccaagatcagcaatgtgatactgctgagtagcaccgatttttcgataatctgctaggcagatgacacattttttcgcctttgtaaccatcattgaatcgatcgctgccgcctctgcattacttgaagttaggccaccgtcaaccgagataccatcacagccgatcacggtgacatcggctatccttgacgacaaaaagttcagcgttacactgccagccagcacacttttctttgtactgaccctaccgcctgtaatcataatcttagtgccctcatgccgcgcacaagcagttgcacacggattgttggtgataacggtcactggtattttagccagttcattgatgacttgcagacacaacgaatttgcgttcatgaaaagggtgctgtaccgcgcaatgtaattgggaacagccgccgcaatcctttgggcaatcaccgccaaagttctctgctcacccccaccttgtccggcaatcgcttcaacaagaccgttgtgccatttaacccgccccatggcatgcaatattttcaggtcccgcctgatcgtgatttcggaaaccttgagccgaagtgccaatcctttcacagttgcaattccgtgccgatcaaccagtcgttcaatgtcagctcgccgcgcttgaacgttggccagtgaatttttcattaagcttgctcctatattgtgactattgaagttcctgtcatattggtaacccaccacaattgtttgcatgtttgattgccaaataccctaaaaatgtgcaatcccactttagactcaagtcacttttcgcttcaacgccatccgactcgttgtctatcaaaaccagcctttcactttcaaaaaactgaaaaataatcataaaacctgcaaatgatcttataccgcaattgtgttaactaggacggtcagcgtacacttttgtatgttaatcgtaatgattactcttttcgacttcgaaaggatgtgttttttatgtctagttcctcgcatctgccactcacaagtaccctcataattgtagctgcccttgccggtggtggtattgccaccagtacgctggtcacgttgccggctaccgtcaacgcagccagtgacgctgacgcaacgcaggtttacactgacttttcaacttttaagccaatcgccggacccatcacggtggtcacccccggcgcaacgccaacggctccgccagaaaaaatcagcgccaatggccatgattatttttataattatacgtccggaaaacggttgctctacttaccgattgcgcaagcctatcagccaaacttagcgcacatcaaatcactcgttgacgccgccctccaacaaaaaggtagtcagcatgatgatacagtcgctcgaattgccgcatctgatcttgccaaggccatccaagccgactcagtgctccggcccgataacactgcgaataacaaagctttcacggacgccggattagtagctaagggcggttcggtcgaaacctttaatgccgaccccagtgccgtgaagtggacagacgaagtggtggcgaatcgcatcaccgcctcattccctaaaggtgccaccagttacggtctcgcaattggtcggctgccaagtggcgaatttgttgcctacatcaactacgcagcaaaacctcccgtctcgagtcaggacacctacaccgtttcctacaaaaccctcgatggcaagtcgctcaagccagacgatcaagtagccagtgacaaaatcgccgtcctgccattcccagacttttcatacatctactggaaaaaagacgatgctgcccacactgtcaccatgtactatcaacctgccgatggcgcctatcaacctgagatgagcgatgtcaccgacacattctaccggctactaaacaaggagcgagccaacaaaggtttagcccccactcaatctagacccgcagctccaaaacgccgcgcaacaaacggccagtgccaacgctaatcagctggcctaccctcagaatccacgaaccgtcacgccagcagatccgtcatcccctgatacaaacctcatcacattatcgagtgacaccattccattcgaacacgacgaaggcgaaggtgcagaagatttagtcgcaaccggcatcctgcaactcgatgatcgtccgggcacactcaacctcggcgacctttatcaaccagatgtaaccgcagtcggttttggcgcgacgatgggccaagacgggcacatgtactactcgattcgactctcggagaagaaaaacgcgtcaacgaatgaaaattcagctgatgatccctcacagtcagcttctgatcctgccacaaagaacgatcaggcaggtgttcctccaacggctgacaaacaagcgaatgctccgagctcaccaacaccccaaaagacgaatgcgactccttcagctgataacgccaaacatgaagagcagaaagcttccaaagatttacctgagactggtaatcgcgttttcgaaaaaggcggcattgtaggcttcctaatgttgttagcgacattggggcttgggatggttcagaagatgcgatcgaagcggttttaattctggcaatctttgagagagaatccttctgatccttttattaaccccttcaccaaaaacaacgttgggaatgtaccccagcgttgtttttggtgctcggtcaaattttttaactagtttaactggtccacctactacaatctaaaaaagcaccccatcaagttgatgaagtactactgctgtgaaaaacagccaaatccaagtcggcaagttataaactgctgactatttaagtcctgtttatcgtcgaaaacacgccaccccaaatgaccgcattcaacttttctaaacagaacctcttttatttaattgtgagtcatgataagcgccccacgcacttttcaagctcacaaaacgataaccggccaccatctcaccagccacaccgttatatcaattcggttgactaccccgcacaagacctactagcattgaaggctgttggccctgatgctttctagatatcgattttcctagcgatatctgtttttattatgagctatcgtcgcagtggctaacttaatgtcattagcctacgtgcaacttttatgcaatggctatccatcacacgtgttattataaaccgccatggtctaataagtccatatatatttaaaaagtgtttcaattagcactaatccttcaatcctgagtcaggtagcgttgatactatgacgaatgcctgatagggggttaaacggtgtcattacaagaaaaaattgcgcatcgaattcacgacctgcgcctcagcaaatcaatgacgcaagaacaattagccgaaaaagccaacatggacgtctccatgttggccagaattgaacgcggcagtcgcggcgatatacgaatcagtacattggaacgcatcgtgaaaggcttggatgtcagtttgcaggaattttttacgtttggtgatgaccaagatgaagtcatgacgctggctgcttctgttactttgatcaaggatccggagatgattcgggcattgcagaagattgttgatgcggcgctgggcaaaactatgaagcgttaaaacttcgtgcctgcctctatctcactcaactaatactttaaagttcagtcaataaaaagcaaaactctaaattgacacaacattcttttcaacatgtgacttcttattcccaggtagcaaatagaccaattcgatcacggttcatcgtattagaactagcttttttggccggccccgcctctcgtcgctcaatcatagattgtcattctgtcatttagttagtgtgcaaacgacatgtgccttctcttgctgcaaaataacgttctcttctctttgctgtgttcagaacttgctattttcagcacaggtcagttaaagcattatcccgttcatgtataatagcttctggaaagtcattactttggaggtctattatgcaaaaaacattcattgctgtttgtacgctttttcttggattaggattggtcgggtgtggtcatcagcaacaggcaagtccttcaagcagtccaaagaaaactagtcagcagacttcaagcaatcaggcttcgcaatcatcctcccgctcaagcaagatcgcttcgagtaccagcgatgccagccactcaaccaccaagcaccccctctggtctaacgccaaaagcgcgaagctagctactttcacggccagctggagcaaaacaatgggtcagcaatacgaaagttactggcaaggacacagtgttgatatgtacgggttgaagattcccgatgaattaggtcaagctggcaccaaccaccccggctccatggcaatggcagttggtgataaggcggtcacctgggcactgagcaccagtggtgaaagcaatgctgaatatacaattgtcgcaatctattcagatgcggcccatgaaccttacctagggaaacatgtttatctttttacgttacacaatggtcagccagaggtgctcgtgactcagcagaatcagggtaatgacaataactggttgtattttagtgagacgcagaatcaggagttgcggctggggtttgcgaagattgttcagggtgattaatggtttaagggtaagagtacataacagtccagggttctctcggcagagaaatacgggtctacgctttctggtgttgagaaataatcagcactgaacgtgtaggccctttttggataacgcaaaaagacacctactcagtgtccatgctatgcttgttagcgtcgatcgaatcgatcagcatttcctccaaatgacgaactttgctgttagcgcgtcctcaataattgaacagaagtaacccaaaaactaggcgcgtggcacatacagcgcctagtttttctatttctggtttcggcgacaattgatgaccagtttggcttagtgtccgttaagtactgagcgggatagcaaagcggaatgcaaaacgctcaaatgttttagtaaaagaaaaaagctttgaattcgacagttgttagaggatcgataaaacaaaacaaaaaaatttggctatagcgcttccaatccgtcattatttttagtaaaataaaaacggttacaaaaatcagcagcggataaataagcttaacttcaattaggaggtattgacggtgaatagtacagatgtcacgaaaggttttacggaacaatttggtaagcagacggagcacaccttcttcgcaccaggacgcattaatttaattggtgaacataccgattacaatggtggccacgttttcccgtgtgccatttcgctgggcacttatgcagcggttggcaccaatgaggacaacgcttttcggttatactcggccaacttcccaaaggttggcattattgacatcccattctcggatcttttccaagataagcgcggcttgtggacagattacttccaaggtatggcgcgggtgatgaagacggcgggtgcgaacttcacgcatggcctcaatgtttacatcaacggcaacttacctgatggcgctgggttatcaagttctgcttctctggaaatgctggtcggaacgattctgaacaatctttttgatggcggctttgaaccgttggagctggttcagttcggcgttaaagtcgaaaacgactatatcggcgtgaactccggtgtgatggatcagttcgcgattgaaatgggtcgcgcaaatcaagcaacgctgttggatacaaacacgatgaaatacgagtacctgccagttgagatgggcgataacgtgattgtcatcatgaataccaacaagcgtcgtgagttggctgattccaagtacaacgaacgccgcagtgaatgcgaaaaagcactggcaatgctacaaaaaggtattgaagttaaaagtctgggccaactgagtgaagacgaattcgacgagaatacttatctcatttacgatccaatcctgatcaaacgcgcgcgccacgccgtctttgaaaatcagcggacattgaaggcttcgaaagcactgcaagatggcgatttgaagacctttggcaaactagtctctgcttctggagtttcgttggcttttgactacgaagtcactggcatcgagcttgatacccttgtgaccaatgccttgaagcaacggggtgtgctcggtgctcgcatgaccggtgctggctttggcggttgcgccattgcgattgtcaacagtgctgatgttgaagactttattgacaacgttggtaaggcctatcgagaaaagattggctatgacgcccatttctatgtggccgatattgccgatggtgctaagcaactgaactaactctgctaaaatagaaaaagtgttataaagtagagcgtgagccagaccgatttctagtctgacgaacacgttttaaaaaagggagatattttattatgacaattgcagttttaggcggcgctggttacatcggttcacatacggtaaaacaattactcgctgccggcgaggatgttgtggttttggataacttgattactgggcatcgtaaggcggttgatccacgcgcccgtttttatcaaggcgatatccgcgactatcattttctgagccaagtgttcagtcaggaaaagattgacgggattgtccattttgcggcgttctcaattgtgccggaatccatgaaagatccgttgaagtattttgataacaacactggcggcatgatcaccttgcttgaagccatgaatcaattcggcatcaagaaaattgtcttctcatcaacggcagcaacttatggcgaacctaagcaggtcccaattaaagaaactgatccgcaagtaccgaccaatccatacggtgaaagcaagttggccatggaaaagatcatgcattgggctgatgtggcttatggactgaagttcgtggctttgcgttacttcaatgttgcgggtgcaatgccagacggttccatcggtgaagaccatcatccagaaacgcatattgtgccaattatcttgcaggttgcagcaggtacgcgaactggtttgcaaatttatggtgacgactatccaaccaaggatggtaccaatgtgcgtgactatgttcatgtggtcgatcttgctgatgcccacattttggccttgaagtatctggatgccggcaataagtcatccgcgttcaacattggttctgcgcatggtttctccaaccttgaaattctaaatgcagcgcgtaaggtgactggccaagagattccagccacgatgggcccgcggcgtgccggtgatccaagcactttgattgctagctcagaaaaggctcgtgacattttaggctggaagccaaactatgacgatattgacaagattatcgaaaccgcatggaactggcacgaaaatcacccagaaggatttggtgaccggaattgaccgcgattagcaatcacgttggtaccattgtgaaactcaatcccgattacacccagatggatgcagtctatctgaccaacaaattgttgaacttgatcggagatgctgcccttgacctgtctggtgatgctgatccattgacgaaccttgatctgatggtgaaagctgcgcaggagaatggtaaaattccagattcacaggcagcacgtcagattttggaagcgcagctgatggaccttgctaccccgacaccaagtcggatcaatcaactgttttgggataagtatcaggcgggaccacgggttgcaacagactggttctttgctttgagtcgcgcgaataattatattcaaacgcgagcgattgctaagaacgttgtttttccagctaaaactgaatatggcgacctcgaaatcaccatcaacctgtctaaaccggaaaaagatccgaaagacattgctgctgcggcacatgccgcccagtctggctatccggcgtgtgccttgtgtttacaaacggaagggtatgccggtcgaactgactttgcggcgcgaaccaatcatcgcattattcgctttttgcttggcggtaaaacatggggattccaatattcgccatatgcttacttcaacgagcacgcgatttttctggatgctatccatgaacccatggtgatagaccaaagtaccttcagcaacttgttgtccatcgtttcaatgtttccaacttattttgttggctcaaatgctgacttgccaattgtcggcggttcgatgctgacgcatgaacattaccaaggcggtcgccatacatttccaatggccaaagcaccaattgagacgcaggttgaaattagcgggcatccgcatgttttcgctggcatcgtcaagtggccgatgagtgttattcgcttagtgagtgctgattcggacgagttgataaatgcagccgaacatgttcggcaggtttggaatcagtataccgatgaaacagttgacgtccgcgcatttgttgatggcaaaccgcatcatacggtgaccccaattgctcggcgtgttggttcggaattccagctggatttagtgctgcgcgacaatcaaactagtgcagagcatccggatggtattttccatccgcatcaggacgtgcaacatatcaagaaggaaaacattggcttgatcgaagtgatgggacgtgccattttaccggcacgattgaagtcggagttagctgaagtccagaaatatcttttgggtgaagccaacacgatgaaaccaatgcatcaagcatgggccgaccaactgaaagcaaaatatgattggacgccagcaaatgcagagatacaaatgcaggcagcggttggtcgtgtatttgcccgggtcttagaagatgctggtgtgttcaaacgcgatgaagttggtcaaaaagcatttgctcgcttctgtcgggaactgtagcaacaggctacgttgctgaagccggcaaggagtcaatggaaacggagaaaacgatgaccacgattacagatattgcgaaggcggcaggggtttcaattgcgactgtctcgcgtattttaaattatgatacgacgttggctgtcacgcccgaaacgcgccaacgcgtgttgaaaacagccgaaaagctggcgtacaaaccacgtcgacgtaaacgtgtgtccccgcaaaccaccgttgccttgattcaatggcgcagcgagcaagaagagttgaatgatctgtattatttacagattcaatatgctattgaggctcgggcggcctcagctggctatcatttgcagagcttgcatttggagcagttggcagctgagacgacacaaaacgtccaaggtgtgattgcgttgggtaagtacgacgctggcgaagtggcaacgatcaaagccttggcgcaaccagttgttttcgtggatcaaaatatgttggcatttgactgcgactcggtcaccagcgattatgctggtcctatcgagcaaattattcatcattttcaatcggtagggatcaacgacatcgggtttctcggtggcgttgaaacgagtcgcagcggacgcgagcagtttcaggacgtgcggacagccgcgtttgatcgggtgatgtacgcagagaatttgatgcagccagcgtttcgttttattggcgcgttcacgcctgattcaggttacgaactgatgaaacaagcgatcaccaaactcggtgacaccttaccgcacggtttcattgtggccaacgacacgatggcagtcggtgcgttgcgcgctttgaacgaggctaagatcgaggtgccgcaacgcgtctctgtgatcagcttcaacgatgtggcggtcgccaagttcacgaccccgccactttctacggtgcatgctgccactgaccaaatgggccaaaccgcggtcgaactattgcaggcacgcatcaaagatccgaaacgcgtaccacgtcaggttaacttcaaaagtgagcttattatgcgagccagcagcttgtaggaacggtatcataacgtgttcccccgcgaagaaacctgtccataatgacctcaagtgcaatgaccaaaagcgggtcatcatacttgagatcggctgatgctttggtttctaaccgcgctggcttacgctcgtttataaaggaggacaagatggacgtttcagttgaaccatacggtcagtatcaaggccataatttgtatgagctgaccttgaccaatgatcaaggcatggttgtgaagttgttgaattatggtgcaaccttggaaaaagtgttgttaccagaagctgatggcttgcacaacatgattctgtcgctgccaagtcgggaagattacgcaaaagagcgcaattttctcggcggtacggtcggtcgagtggtcggccggattcgtggtcatgtttggcagcatggggatgtgaaaattgatctgccaatgaacgaaggtaagaatcacattcacggcggggatgacggtctggatcggcaagtttataacttccgtattgaccagacagctaccacagctagtgctagttttacctttgttgatccagcagggcataatggctatccgggcaacgtcaagctgcaagtgacttataccttggagaatacgaataccttgcactatcgtctggatgcagttagtgatgaagaaacgctcttcaatccaactaaccatacctattttgcgattgaccagccaaacaaaattgatgccaccacgctgacgattccagccgacgattacaaaccgcttgatgcagaccatctgccagatcaaggctggcagccagttgccggaacggtctttgattttcggcaagggcaaaagcttggcgatgtcattcacactcgagcagcgcaaatcactgcagaacggggcattaatcacccattcctactgaaacacggtcaaaccctcgcggccaaactccagactgacaaacatactatgaccatggcaaccactgcgccgtccgtcatcgtgtacaccgccaaccactttgacggtaccggtattcctcacaacattgatcaatttgatggcgtggctcttgaatgccaatttgctccggtcagcggcgatgatctttcggcgatcacattattgccgggcgaaccatttacgttggtgaatagttgggcgtttgaataggcagcttaactttttaatgcctcgggatgttctgaacgaacctaatctttataaagaaagaagccttccaaatcattggaaggcttttttgacgcaacgagaaaagtttagaagttcttgtgttaagctgcttttttggttagcattgtgaacaaatagtttcaagttaatacataaatggttacgcggtcaaaagacatgcaatgtgacaaaaggagtcgatagcatgaagacaaagtttcttaagttgccggtctatcaacaaggacttttcttaacgttgatttggctaatggtcgggattggcgtgatgctatatcgctggccaacaagcgatcaggattttcaaacaaccgcctattggcttgcaccgaatttgattcatatgcaaggtgaggtgaccgctcaatggttcccgtttgcgtgtgcagtgacggccggtgtgagtctttatgtcgtcaagcatattaaaagtagaaactgtgacactaaagaaggcctttatgtacttcagaatttgtggcccatctggttggtgacaatcgtagtatttttcttattaaatctttggctaccacaaacagggatgactcgtttttcgagttttgatcgacaagtactcacgattgcaatactgtttcttgatattactttatttagttcttacatgctttggttaaacttctgggtgccggttggccgggtacataatgtcattaaggttctattttgggcagtgcttttccttggagctggatttattatgagccactttcaatttacgtttgccagcagctcctttagcttggacgatctaggacgacgtacatggttaacactgccattttggccaagctggtttttaggtttactattaacggcggttatttggtggcacacttttcgtcgacttcgaatgacggatgattctcactaaaatagagagaccggccgtgctcacacaactcagcaaaaagattgagggggtctaactgctgacaagcgtacaacctagtcgggcgaaccaactatccaagatgaacaatcaagccttaaaaaaacacgctttttgtgaaaataaacgctttcatctataatttagatagcgctatgaaccgtttacgtaactaatattgaacgcgtaaaaatgttaattgggcggcaattagggaaggagactttctcatgaaaatgaaattgcaacgcctaccaattgcactacaaggcatcgttctaggcgccatctggtttttgcttgctatagcattcatgctgtataacactccgactgcaaaaaatgaagtaccaatcccctttccaccacttgtaccgcagatgtttcgagtagatggtgttgtaacagctgactggttacagttcattttctggttcattctttttctcacgtggtacgcgatctatcgggttgtcagactaaatgaccaaactcatacgcttcaaccggtgctgcgagcggtcgtaccaatatgggtatttgcaattacaatcgtctttatcgcaactttctggacgccgataattgggctaaacggcttgtcggttgttgaacgatccttagtaacactggggttactagttttcacagttctatttgtgggtgcatttcggttgtatggtgagattttacgttacagttcgagacaaggaaaagttttcagaataatttgctggtttacacttctttgcgcgtcattctatgtcatatggcatctacagttcaccgttcaaggagcgcccattttaaaaaatacgttcttgttcggtggtctcagccaagacgcttgggtcgtacctttttggccaagttggctgattggcatggcgcttgtttccttaagcttgttaattatcagaaaaaaagcaatcaacattcagtaccccgaaaaaacaatgtagtcgataaaaattgcaatatatataaataaataggttccaaaacaaatagccggcaatctaattgctggctatttgtttagatttgttcttttatgttatatccaagagaaatattattgatagcgatttcgactttgcaaagtcatgttgctggtctaaaagtttgtagcaacgaggatgaggaggaggctgatgtcttataaattaatttgccaacctttcaaagattttcttgactactgaaagcgtttgaatataataaatagtgaacagaaacaaacattaattaacaggagctgagagaatggctaagacggttgagaatgacctttttgatgcagcgttagcatttgtcgaggatggtgatgatcaggatacagtctttaagcaagtttccgatcaattactagtagccggtgccgttaaaccggacttttatgaacatctaagcgaacgggaaaagaactatccgacaggcatcgatatgagcgttgtgaacgctgaatatccgaatgtagcgattccgcatacagaaggcgaattcgtcaatgttagaaaaattgttccgatccgcctcaaaaacccgatcgaatttgccaatatgattgcgccagatcaaaaactcaaagttagctttctgttcatgattttgaataatgatcccgagggccaggccaacgtcttggcacagatcatggattttctgacaacatcttctgctgaaacattagctaaattattcggagcagacgatgcggcaacaatttacaacgttttggcaaccagttttaaaaaataaggaggaagtttgttatgacagtcaagattttggcagcttgtggtgcgggtgttaattctagtcaccagatcaaagatgcaattgaaaaggaatttaagaagcgcggctatagcgttcaggcagatgccgtgatggtcaaggatgttaatgaagacatgatgaagaattatgacattttcactccaattgcaaagaccgatttaggctttacaccggcaattccagttattaacgcaggtccaatcttgtatcggatgccagcaatggcgaaacctgtttacgacaaaattgaaggcgttatcaagaaggaaaatctgaaatagtctcatggtctgatggcgatgaaccgtcagatacatataaggagtgagaaaattcatgcaaaccattattgatttggccaatgcggtcttcaagccagttattgatttaggggcagcaccgattatgctgatcgtgctgaccttaattgcttgggcggttggtgttaacttctttcatgcgttggaaggcggcatcaaacttgcgattgcgattaccgcgatcgggagtgttatcggtttattgacaaccacctaccagccggcgttaaatgctttcgttaagtctacagggatcaatctttcaattactgacttaggttgggcgccactcgcaacaattacttggggttcgccgtatacattattcttcttggcaattctggtcatcgtcaacttgattttgttattcttgaatcggacaaatacgttggatgttgatatttttgatatctggcacttatcatttactggtttactggctatttatttcggggctaacctctttattgctaccattttggttatctttatcggtattttgaagatcatcaattctgatctcatgaaaccaactttcaacgacttactggacgattgggaaaatccaatgacaaccacgcatttaaactacatgatgaatccagtcatcatggtgtttgataagttgtttgacaaactgttcccatggttagataaatatgattttgatgctgctaaattgaacgaaaagattggtttctggggcagtcgttttgccattgggatttatcttgggatctttattggtttgatctcccaccagagcgttaagtcaattgcgacactggcctttatggctgctacctgcttggagctgtttagtattatcggttcttggttcatcgctgctgttgaaccgctgtcacaaggtgttactgattttgccaataagcgtcttggcggacgtatgttgaatatcggacttgactggccattcttggcgggccgcgctgaaatctgggcagctgctaacgttttggcaccaatcatgttacttgaagcattgatattgcctggcaaccgtattctgcctttaggtgggatcattgccatgggtgttaccccagccctgctggttgtgactcgcggtaagattattcggatgatcgttatcggtgcgattgaactgccgctcttcctttgggcaggcactctctcggcaccatttatcacacacacagcgcgtgcattgcacgcacctggtattccggcaacagggctcttctcttcctcaactaaggaaggtccaatcgaacaattcatcgctgtgcttgttggtaaagcttctaaaggcgaaatgatgatggtgctttacgctgccctagcactgattgcatacaccgcattattcttctggtatcgtcatgaaatgatgaagcggaatcagaagtactctgatgaaggtaaagaagttgctgacgacgttaagttcgttgcaacacacggtgctgcaggatccgtggactaaaattcttaaatcttttaacttacagcttcatcatgagatgcataaagagcctccatcgtttttgatggggctctttttgtttcatcaatggtaaatagacgttattactttttgagaaacaagtagaaggacattttaaagaggcacaaaaaaagtcgcgatggccttcgcaactttacgtgatgattgaataaaaatggctgaattgatttaccggcttgcccgattctcacgacgctttttacgatcaaagacatggtccattttgagtagctgatagagggcatagcaggcggtgaccatcactaatacttgtgtcaatgagtttttaaaaataccgtttatgattgctacgaatgtcacaagggccaaccacagtaagtaagtttttctacgtgccgtcatcagattacctccattggcttttgaataactctattataccgcagctaaagcgctaacactagtcaaaaaagaactaaaattaacaatatcgaacaggcaacacagctcgtattattgaggctaaataaggttgcgggttaataggcatcacttgcattgaagtggtaaagcatggagaactaaaagcaaagaaaaataaaaaagctcccactgcatccacaaaacgcaatcggggcttctgtttacttgaaaaatataaagctgttacagtctaataaatcgaattacagtcttgctccattctcaatgggggactaaccacgttctttcgatgaagggcgtgagtgcgatgtcaacgtgggctggtggacacgttaaagtgacagggcacattttggatgctgtctgagttgttaacataggcgcattcggccactgtaacttagtctaaatgcttcacctgaacgagttcgccggtgacgccaacttgaataccttgcttgatcttgtctgtccgacttgcatggacgacttgaaacttattttgcttaacgattagcttgttatcagtgtgatagtcggctggcaatggttggttgctgccgcgcacgagcatcacgataaacttgaagccgctggcatgcgcttcgcaagggctgtagtgaagcgtgtcgctgaagaattccacaacggttccagccggtacgaaaaaaagcttcgcgtctttttcggcattgaattggccatcatgcatctgaccgcgtttgccgatcaccatgacaacatcggtgaagaaaacgttcacttcactgccttgatgaaattcaaccgcagtcaaagcgtcggcgtggccggcacattcgcctgcttcaattggcaggccagcgtagacatcgcgcccaatttgctggacgacgggaatcctttccatgtcgggatttgacgggatatagagattggcttcgctaggggcggggatggtgacgtgctgatccatgaaggttttgagctcactgacgtcatactgtgcgtaagtgacgccatagtcggcaaatgcagcctcatctaagctgtggatggttttatctggattcagggttctgagctgatcaatggttgacatagatggacttctttctgaatgttaataggattcaattgtgactttggcaaaatactcgtcaaacttagctggattgacgaagccggtttctgcttccatggtgttcaacatcccggttgtcatcgccgttttcatgatgtcttcatccgatttgccatcatgaatgcccatggctaagccagccaatgttgagtcgccggagcccacaggattgacaaccttaatctttggaatggcagcgtgatagaacttatccaaatgttttacgaaggcaccagccgcacctagggacacgacgatccaatcgacaccatcaaaaatcgggtccatcagatcgtgtttcaaggccgtgtagtcggttttgtcgacatcacggttgagcaggccgccaagttcttcttcgtttggcttaatcagcaacggtttcacaggtgcttctaaagcggattttaaagtggcacctgatgtatccagaagcactttgacgtttttttgacctgcatgggcaatcatctgggtgtaataatcagccggtaatccttgcggcatggaaccggagatggtgatcaaatcacttttgtctaacaggctgtcaaaatggctgagaaatttctcggcatcttcggcagcaattgttggtccggcttccagaatttcagtctgttcgccgccatcatgtaacatagcaatcgaactgcgggtttcggcatcaatcgggaagaagtcatggtcaatgccgtcgcgatcaagctgattttccaaccacttgccaaaatagccgccaataaagccggttgctgtaatctcgtgatttaacatatgaatgacgcgagatacattcaatcccttaccgccagcagttttccgtaccgttttcacccgattgacggtgtcgattttgagatgttcgagcgggtaggagacgtcaacggatgggtttaaagtcactgttaaaatcataagtattttcctccaaaaatgtgatgatgagctgggtcggatacaaacctaatcacggaagacgttataaaagccgattccctgaggagtcggcttttatcgtcttcacgcgaattaggcgtgttcgaccttgtccgtccaaggagttgccgtttcagctaagaccttgtttaagcgatcgatgtttgctttgccttcagtttgcagccatgctttaccagcagcttcgccttcagcagcaaatggtttcacgcctggtttccaagttgcccggccgcagagaacaccgttgaaggttgaacctgcttgctttgcaaatttcagttcttcgaggaacaattcgtttgaaacgccggcagacaggaaaatgaatggcaggtcggtggcgtcggattgggctttataatacttggcagcctcctccttggtgtaaaccggggtcatgccttcatctgtgaagccttcgacaaacttctgatcaactggaacctcgacttttagaacagagacattgtactgtggtttgctgaattccttggtgatcttgatcaccttatctggcttcacctttgcccatgcagccgtcccagtttcattgagggtgccatcgtaggaaaccagttccaagaacaatggcaaatcgttagcctttgcttcggcaccaacgcgttcaacgaaagcatacttgcgatcattgatggcgtcaggttcgtctggatcgatataaagcaagaatttaacggcatcgccgccttcattcttaatgcgcaacgcactttgatcatcaatcagatctggaaaacggccaggttcggtagcatcataaccggtcttttcatatgaaagcagcaggccagcttgaggggcacgaactttggcagccggcagaccatattccgggtcaagcagaatggagctggcatacttggttaattcttcggaaacagcctttttgaaatcaacaatggtggtttcatccgctggcttgttagccgctgctgcaagcatctttttcaaggaaccgcgttgatcaatggccagagcagagatgacgttgttgtcatcggacaattgttgcaaatgtttgtattggccagcagtaagggtgacagtcatgtagaaattcctcctaagaaatagtgtcgaagtgataattagtcgtggtagacgccttcagcccacttttcgagttcagtatcgaagaagtgtggattgtctttttgttctggatttggcttagcaatgttatcaattttatcgatgattttcttgttctcaggggtttctttataggtggcatccagataagctttgacaatatcttggatcatatggataccaactgtggcaccaccgatgcccaatacattggcatttaattgatcacgtgcataaacagccgaggtcacgtcatcacacatagctgcccggatgccctcgtttttgtcagcggcggttgaaataccgataccagtaccgcacatcacgatgcctaagtcagcgcggccgtcagcaacatcttcggcaactttcttaccgtaaataggatagtgggtacgatgggtgtcataggtaccttcatcaatgacggtatagcccatatcttttaacatgttcgaaatttcaattttctgcatcgtgacgatgtgatcgttaccaatagcaataatcataagtgtgaagcttcctttcttcttttaggctgagggcaaggggactaaatcattttttcaagcatgtcgaggcggatttggtgacggccgcctgcatattcggtgtccagataacgttggatgatcacaagtgcacgatcataacctgtgatgccagtgccaatagcaattgccttggcgccattgtgttcggcggtcatatgggcggtgttttcttcttcgacaaccgcggtgaccatgcccttaaccttatttgaagccattgctgagccaacgccgtaacggtcaaacatgatggctttatgtgcatcgccgctcaacagttcctttgtaacagccaaagatgaatcaacaaaatcttcagcaggttctggggtcatatccttaacccgatactgatgatcctctaaatactttttaacttgttccttcattgcgaatccatctttgtctgcgccaataatgacatccatgttcttattctcctttatttgttttatctgtgatgacatgtgtgaacgtgttgtaatgttgaagatcatcgcgactgatgcccggatcggtaatcaagccatctgtctgatcaagatcatagaagctatagaagtcttgccgattcaacttgaaatgatctgcgaccacaagtttcatgcccgcattgtctaaggcaatacgttgtgtctggccttcttcggggctagcattgctgatatgattgtccgcaataccgttgacactgataaatgctttcgtggtggtgagatgtgctagcatttcgtttgctaagctgccgataaatgcgccagatcgagcccgaagccgtccgccaattagttgcagtgaaaagaaatccgcgcgatcctgaaaactttgaaaaacagggagactattggtgatgatgcgcacatcgggttttttgagatattgtgcaatcatttcgttcgtggtcccagggccgatatagatcgtgtcacctggtatgatcagtgcggcaattgttgcggcgatttttcgcttttcattcacatgaattgatcgcttttcatttcgggataattcagtcagcggtttaaagttggtactttgggcgccgccatgaatgcggactaactctttttggtcggcaagctcttccaaatcccgtcgcaccgtcatcgttgaaacaccaaggctttccccgatttcgttgacagttacaatacccttgcggtcaactaaattacgtattgtcagtaagcgctcgtcttttaacatatcctcacctcgcacgtgtgttcattgttgtttgattttgtttcttattacattgttcaagttaccaccgacttcaatattcgtcaagcctataaatacgatgtctattaagatttcatttgccttgatgataattgatagagatcacaagaaaacggtttacaatgaacaaacaaatataatgcgacatttaaccaaacagaaaacaacatacacacacagaaatctgttttcacgaacggtttcacaaaaatgcttatgctgggtgacctgtgtcggatggctttttagctggtatagatgagaaattcatggcataaattcaaaaaataagtttaaaaaaaccgccaatagttgcatgtgcgcacgcaccctttggcggtttttggttggaaattgtggataaacgtcattttaacgtagtatataataggaacaacacgtcaagctaaggttggcaaagtcagcaaatcacttgcctgttgtagcaccgcaacccgaggcattacttcattacttggcggcgtggtccaacctgcaagtgcaaaagcaaccttggcgtcggcagctgcctgtgcatcagtcggtgtatcaccaatgtagatcgttgatgctggctcactgcccaaacgttcacgtgcgagggtgatgggatcgccaaagggtttgttgcgtttggcctcgccagcaaccacgatcgcgtcgaagtaaggactaaaatgaaactttttgtcttcttcaatgaactgcgtcttgtcttttgacgtcactaggccaagcttgtaggtttgtttgagctgattgagcgcatgctgcataccgggaaaccaagcaatgtcggtgaggaattccttcgaatcttctcgccattgctcatggacttcaggaatttctgcggcactgaatccgagttccgcgaggctgtcaacgcccgcacgcccattggtccaggttaattcatgaatggggacctctcggccatggcggcgtaatgttttttgtaagccatacaaatacgcctctacattgtcgagcagcgtaccatcgatgtcgaagataaaagtgttcatgatattcctcccaataaagataattgtagcaagtaagcgataacaaggaaaggcgtaacgatgagattcttacacacagccgattggcatattggcaaaaaactaaatgattttgatttgcttgaggatcaacaagctgtgtttgagcagctggtggaaacggctgagcagcataaagttgatgccattgtcattgcgggggatctctatgaccgcgccttgccaagcgaagctgctgtttccgttctggataacatgttgattaagttgaatcgtgaccacggctatccgttgttggtcatttcaggcaaccatgactcggcggtacgcctgcgcacaggtcgagcatggtatgcagctactaaaatgtttgttaatacccaagtagccgaagcttttgcacccattgagttggatggcgtccaattctttttgctgccgtattttgaaccctttgctgttcgtgactattttcaagataagacaatcacgaatgtggctcaggcaattcgcccgattgtcgtgaaaatgaagactttatttaagccaaatatgcgtcatattctggttagtcattttttcgctgctggaagtgaccatagtgcttcggaaacgaaagttaatgttggtggattggacgcggtaccgctggatgatttggcagcatttgattatgtggcactagggcatctgcacaaccatcatgctttgcatggtgaaccaaagattcaatatagcggtgctttgttaaaatacgcggtcagcgaggcccatcaagaaaaaggggtctatattgtcgatactgagaccatggatcgtgagtttgtgccgttgaagcctaagcacgatttaatcgagttaaaagctagttatgccgacttgacggctccagcatactatcagcagcaggatcgagacgcctatattgggattgatttgaccgatacgcaagtaattccgaatgtcatggcgcaattacgccagatttatccgcggattattagcctgcgccgtgagaacggcgtgaatgccgtcaagcctttgcaagagcggcagcgtgatttggatccgatgagtttgctgcagactttttttaaagatatgacacaagatgatttgtcggccgcccagattaagtgggcgaaggcagggttgacgacggctaaaaaggagcaggcataatgcaacttaaacaattacacatgcaattttttggtccgtatgcagatgcagtcgttgattttgacgattttcgcaccagtcccttattcttgatcagcgggccgaccggcagtggtaaaaccacgatttttgatgctttgatttatgccttgtatggtgaaacgtcaggtgagcgtgacggtgagcaaatgcgctcaaattttgcaggtaacagcgatttaacaaaggtgacactcacctttgatcatgatggcaaacattatttaatcgagcgccaaccgccgcaattgcaaagtaaaaaacgcggcgatggactaaccgaaatcaaagctaaggtgttgctagctatctcttcagatgaaaaacaggtggctgagtaccgtaagaaaaatcaagttcaggaacagctagacgccgttttacaccttgatgcttcgcagtttcgacagattgttttgttgccacaaggcgattttcgccggttcttagatgctgatagcaatgcgaaagaagatctactgcgtgacttgttcggtactcagttgattcaacgttggcaaaccgctatgttggcgcagatgaaggccaagggagcagccattcaggaccaagagcggatgttagacgttttgatgtcgcagtttgacttcgagacggctcctgacgagcatgctacgatggcggataagctgtcattgatgagagcaacggtggcgagtcaagcgaaagttgtgacagcaagacaagcgaccgcggcgcaaagtcaccaacgatatcaggaagcacaaacggcactgcaacaggggcaacaattggcgcaggcttttacagagcgagaacaagccgccacagctttagcaaaactggcggagcaaaaacaaacccatcagaagcaattaaaacaaattgaacaattgacatgggtacagcaacatgaaaatgctgctcaacgtgttcaaaaggctggacaagatcttaaagcggcaattgtgcagtctgaacaaacgcaagcagctgtaacgacgaccgaacagaaattttctctggacaagcaagctttagcacgcttgcaggccaaatcagaccagattgaggcccaaaagaaacaactgaatagtttacaggctgttcagcaacagttgacagccatcgccgaacaaaataaacaggtgattaaacaagcagcgattgttaatgaggctgagcttgcgttggcacacgcacaacagcagttgacagacgcccaaaccgttaaaacacagcagcaaacaagtctggataacttgcgcttggatgagctgataaccacggtcaatactcagcgcaacttattggctgccttagtgccacaggctgctaattatcaggaagcccaagctgatgttgcacagttgtctatggccatcaaaaaaaccaaagttacgctggaacaagccgaaacgcaggtagcagccaccgcctcgcatttgaacaagcttcagcagactcagattcgccaacaaattgcacatttggctgctaagctcgagcctgacagtccatgtcctgtttgcggcagtactagccatccgcacccggcgcttgtggttgacgaaccattggtgagcgaagcagcgttgaaacaagacgatcaggaacggcaaaaggctgccgcaagaaaaactatggtcgagacacaattggcgaatcttgaaacccaactgaaaactgcgaaggccaaaaccgcacaggcaatgcaggcttttactgagcattggcaagaacaggccaaactgattgcaggcgttgcggataaaactggtattttacaacaattaacggcgttgaaaacactggcggcaactaacgagcaccagttaacggaagcgcaaacggagcacgctgctttgcaagttgcgctaaaaaagagtgacaaggccatcactaccggtacgacaaaagttcagcaatgcgaagctagtttgaacacggctagaattgatgcggctgaagcgcaaagtgcgttgaagaccatgcaaaagaacctgcccgcggaagcgacggatttggcgacggtcgctgctcaagctacaaccctgcagacaaccattacaacgtatcaggctcaacttcaggaggcgcaggcaagggtcaatgctttggatcggcaattagccgggttgcaagcagacgagaaacacgccgcggcacaagtgactgctttgaccaaggaacaggcggaagcaaaagcaacctttacgatagcagtcacgcagtattttggtgctgatggcaagcaacggttcgccgagttgcaactgcgggtatcacaattaccgctattgaacgaacaggttcagacttatgagcatacacagctcaagcaacaaacgttattagatgccgccaataaaactattggtacccaagcacagccacagcttgatcagcttgaggccgaagcaacagcagcggaaacgacagcaacaaacgaccaaacggctttgattaagattagtcagacgcatgatgctgctgaaaaattggccaaacaagcggccactatctttacggccaatcaaacggcgcttgcagcctatgcggatttacaaacactggccactgtgatgaatggcaatggtcccaagaaactcagtctggagcgatacgttttgcaggcttatttgcaagaaattctgaatgtggccaatagccgtctgcaggttttgtccaataaccggtatcaatttgttttgcataccagcttggggacgcagaagatccactctgggttggaaattgatgtttacgatgatcaggttggtgagaaacgagctgtgcagacgctatcaggcggtgaaagcttcatcgctgcccttagcttggcgctggctttaggtgaagtgattcagcaggaaagcggcgggattaatattgatgcattgtttgttgatgaaggcttcggcagccttgatgccaatagtcttgatgtggcgatgaatgcgttagaatcattagaaggcgaatcgcggctaattggcatcatttcacatgtgaccgagctgcgggataatattcccgatcagttgcaagttgagccagcaggtacgggccgcagtcgcttaaagatccttcactcggcttagcacttttaaattgagtgtgccaagtctacgtgaaagtggtataacagagattgtaagggtcaatcctacgaactcacaccaaaaagaggcgacatcacatggcatcattgagcaaagaacagaaaaaagctttgatcgctaaagttgaaaaggagcgccaagaccatcccgaaaagaagtcaaagaagtctggcttcgaaacgattgacgaagaagcagaacgccttgaaagcgaaaattaatgttagttgagtcgctggtcctgaacagttaactgttcagggcttttttttgcagagcgcaaaccggcccagaaaccaaaacataagtggccccgaacctaaacgacagggctttggtcgtttaggttcggggtccttatgcgtaggtttctgggccggtttgcgcgtttcggagttcagcaatatcaggcagggctttggtcgtttaggttcgaagtccttatgcgtaggtttctggatcggtttgcgcgttttcaaagacctatagcccaatattcattttagagacagccggatctgcaacttttgcgccccagtgacagtaactgtctatgatggcaagaacggtatttatcgccattaagctagcgcttttacccatgacgccgcatactagtcgtgtccattgagcagttgccgcaatactaagacttttttaataatggtctacaaagaaattaaaagctataacgcatgtgagagtatgcaaagaagccgattaatcagcttttttcaaaaaatattagcacttagcatttacaagtgctagtttgtggtataactataggtggagcgagggagaaggaacaagagcttcagagcaaatgtgtttctcccgaatcgccaaagtctctatattgaaaggaagctatctgttatggctaatgaagttttgaatcgtcgtaataatgagttgatgaacaatgtgaatgatccgttctttgacaacttagcacgccggttcttcggcccggtatctgactggatggattgggcaacacctgccatcaccagcacggccgtcaacggattactaactgatgttaaggagaccaaggacgcttacgaagttcatgtggatgtacctgggattgataagaacaacatcaagatgaactaccacgatggtgttttgagtattaacgttcataaggacgatatcaccgaccacgctgataagaacggcaacgtcatgatgtctgaacgtaactacggcacaatgagtcggagctatcaactaccaaacgttgatgcaagcaacatcaaggcagcctatcaggatggtgtcctcaatatcaccatgcctaagctgactgaatctaaggagtctggtcacaacattgaaattcaataatgttcgtcatcagctgacccaagatttacggactgcattgcaagcatgaatagaagcggcacttctgccgttagtgggcagaacccatgagtaagcaaacaaaaaccgatgagaattgccgcagttgcagtgatcattgagtcgttaaagtcatcccagcgatacgtatggtcgttggggtgatttttttgtagagcgcgaaaaggcgcgattagaaaccggaacataagtggcctcgaacctaaacgacagggctttggtcgtttaggttcgaggtccttatgcacaggcttctcgaccttgctcgcgcgtttcagcttgcaacaaggattcccactcaccaactaaagcagttcaatatttcccgtttttcaagtccatggtaagctagtggttatgatgacaaacaaattaatgaactggccgccggaaaaagtggcggcttttcaaaaggccttattgaattggtatgatcaacatgcgcgtcaattgccgtggcgcgaggatcatgatccttatcatgtcatggttagtgagctcatgctgcagcaaacgcaagtgcagacggtgattccttattatgaacggtttatgaatcaattcccgaccgtgggagccttagcgaaggcgccagaagcagaggttctgaaggcgtgggagggcttgggttattattcccgcgcacgccgtctgcaacaggcagccaagcagattgttgccgattatggcggcgtttggccgcagacctcagaaacactgcagacattgtctggcatcgggccttacacagccggagcgattgcgtcaattagtttcggggaacctgtacctgccattgacggtaacgcttttcgagttttcgctcggttgtttaaagtggatgcggatattgcccggccacaaacgcgtcagctcttttttgacttgattcagccactgatgccaaaagatcgacctggtgattttaatcaggccgtcatggatcttggctcaagttacatgtcggcgaatcacccagaccctgcacattctccggtgcgagattttgatgccagttatcgagatggggtggtttcggcttatccggttaaaacgaaaaagccacgaccggtgttgcatcgttactttgcgttagtcatttgctcggagaaaggctatttacttgaacagcggccaagtactggcttgctggctgatttgtggatgtttccgctcgttgacatggcagatcttgaaagtaccatgatgagtgcgcagttagatgaggtcagcacgttgtttgcggcatcgtcagggatgcagctgacgtttgcggatcttggcgcgaaaacggttaagcatacttttacgcatcagcaatggcaattgacgttgattggggtcgagactgcggcgagcgatctcagctttttaccagcacggtgggtgaaagcggatcattttagtgagctggcgttgccgacggtgcagaagaagttgaatgcagcgctggggatgaattagaaattggtattgagtgagtggcttagtgattttgaaacatgttcatcagctcagaaactgggccgtctcacccgctggctgaaacgtgcgaacaggcgcagctcggctatgccgagctaaccactccgcttcacgccctgagtcaattgcttacatttcgccgttgagcgggttatactgagtgcaaatttgattggagaggtgagcgttttgacagttaatgtaacaagagatatcgcttacggtgacgcagcattacagaagcttgatttttatgaaccagagaagtcaaatggggcggcgatcctcgacattcacggtggcggttggtttcgcggtgagaagaataaagaaggcgagatggctgaacggtttgccgcacttggttatacggtggcggttccaaattaccggcttgcacctgaagccttcttcccagcagctcgtgatgacgttttagcagccttttcatggttgcgggagcatactaaagggttgcaacttggcgtttttgggtccagtgcaggtggttcgctgtcagttgacgttgggttagccgaaggggtaccgacagtttcttggtcgggcatcttcgacattcgtcagtggttcgcagatcatccagcagtcgttgcccagccggatacgaaaaccgattttgtgaaaacggcaagtgcgaaaattgaccaaggtggtcgtaatgatccattttacaaatggttcattttgaattatgttgattcagatgaaacaaagttccctgaagttgaaccgtttgaccgtttgaccgctcaggctggacctttgtatctggctaattcgcaggaagagattattccgattagcggcatctatcaattggcacatgccgctgaaaagcttggcttacctgtaaccttgcagtcgattccgggcggtcagcatgctgaaggctatcttgatgaagcgtggcagggtaccgttgcgttctttgcgcagtatttgttgaaaggataatcgtggaaacattagtcgttgtgagtcatcctgaaattgaaaaaagcgacactcagcagtttctaaaggcgagtgccgcttctttgtcacaagtcgtgtggcatcatttagatagtcggctaccctttgatgtgacggcggagcagcaagcaatcacgtctgctgatcgccttatttttcagtttccgctttattggtatatggcgccggcaagcttacatcagtggctgacagatgtttggctgaaacagtttgtttatgatgcgcgaggtggattgctacacggcaaatcacttggttttgtcgtgacattcagtcaaccggcgaccgcctatcagcttggcggtagcgttggttttagcatcagccaatttttgacaccatacgcggccttggcggctaaaaccggcttgacgttattgccgcctttgacaattgcccaatttgccaatcaaacagatcttgagcatcaacaattattggtgcgttatcagcaatatttgacgcttgaccatcctgaccgaccagatgaacaagcacagtggtttattgatcgattgagtggcaacgctgatacacaattgttggcggatcaattagcagcgcagacggatgacattgatcgcttacgtttgacattacacgaattaaaggcaggcgagtcggaatgacaacagatgaacaatggctagtgaacgctgctgcagtgcaggaaaaacaggcaacatcttatgaaaatgccgccttttttaaggcactacaggcattcgtcacccagcaggcaaaacgccgtgaaagtcttgaaggtgaaatcgatggccgcagttggaatcacgaacaatggtgaaagttcagtctgacgacggaggggaaataactcaccgtatgctatggttaagttagcaaaacaaaggagcctaaaaaatgcaaacaatgtttgatcgtcttcaacgttggtcatggctgcgcggtttgctgatgattttaatcggtgcctggattttaatcgcaccgcgccaagtctatcgcagttttctctggatcgtagctgcagtcttgattattgcggcaattccaaagctgattgacggcttttcagcccgcaaagcatcaggcacttacggtacatctctttttacagggggcttttacctgttattggcgctgatggtgccggtcatcgttcggccactgatgagtctcgggccattgctgctgggcattgtcttgatgatttatggcgtcaataaaattttaagtgctcgaaatcgacaacaatttgtgaacgtctcggtttggccgaccgtcatttatggtgtggtgttgctcatcatgggcttcattatggccttgaatccgttcagaactgtcatgatggtcttctcattctttggtggcttactcgttgtcatgggcattttgcaactctttacgcgaccacgtgcctaatcactaaaaaagcattcgacatctaaaaggtggggaatgctttttttctttgcctagatcttttgctggctgataggcagaataattgtattccaccgagtagatggctacactctgtgcaaaaggatctgacaacgcttaacatgcgtgcttagaaactggcctatacgcgatttaaggctgaagtcgtcgcctttctgggctggagaacacgttgaaggaggaaaaaatgatgcacaagtttgattggcgggaagttgaacgtgacgagtattcgcggtctgaggaacctagttttgtgaagttgacaacgcgcagctatatcacagcgatgggggtggcaccagatcgggtgacggatcaagccttcacgtcattggcagcagcggtcacccaaattgctgagcggatcagcgaaggaccagatgctggcattgatattccgaactttaaagcttaccatccctatccattgcaggcggtttggtcagggggcgataaaatcagtaagcgccacatttttcgactgtggttgaagcaaccgttgtttattcatgaagaccagtttgaggctgcactgacacagctgcattttgaaccagccattgcccagcagcttcacttagaacagttggcagaagggtttgaaattcaaagctttaattcaacaccactgacggatgaagcacctgcgattgcgcgtattcaaacagtgatcaatcgcgaccatctcgttccgaaatttgatgatcggcatcgcgaggtttatttggaaggctatcaaggagaagtaccggtactttaccgggtgccgcttgacgaaaacttcggtgaagttggcgatgagcaggttgcatataattaatctgaatcgatggcgccatgaaaaagcgatcagctctttttaaaatgagctgatcgcttttgttgtcttaattagaattgtgggtagacaatcttattggcccagtgattgatcgggccgtactgatgaccgactgcaattggatgaccaatggcttgattggtgaaacgcttagcaatgcgaatggcttcctcaactgagttgcctttgccaatttctgcggtgatgacggcggaaagcgtgtcacctgtaccgttaacccggtcggttgcatgataaggttcgcttaaccagaatgacttgccgctttccagcaaaacaaaatcacgcacagttggttgcgtaggatcatcatgggcaccttttaaaacaatgttcttggcaccggagtcttgtagttgatgtgcggccgcttcagtctgagcgtcggtgtcgagtttcataccggtcagatgctcggcctcgtaatgattgggggtgaccaccgttgctagggggatcagttcatttttgacagcatcataagcgtcttgttctagcaacatcgcgccgtgtttagtgataataacgggatcgacaactaaggcaccgaaatcatattgctgccagtttttgataatattttgcaccagtgcgcgatcggcaagcatgcccgttttagcagcgcgaatatgcaaatcagcagcgagtgacttgaactgggcatcaatgaacggtaatggcatgaccatactatcctgaatcccgtaagaattgcctgcaacagccgcggttaaaatagtagcaccataaacgccgcgcatgaagaaactatgcaaatcggcttggacaccggcactgccgtcactgtccgtaccgccgattgtcatcacttgtggaaactcattagccacgtgattccctcctcgtaaacgtgttcactggtgcagaagccggcacatcaggatctgaagcacactggccaaagctcagtcaatgcgcttgaggtcgcttatgctccggattctaaccgcatcagtttacgctcttcctgataaaagactgtcatgactcgccaatactgttactaattaaacgcccgtttttgcggcaagacagctttaagccattcgccgataaatggatactgatggttaagttcgatgatctgcgtttctggatcaggatacttcagataaaccatattattagccggattgatcatcactgtaaagatcttttgatttggtagtggcaactcgtaaacgccagctttggcaccttgtcgcatgaggatagcgttgttggatgcaatgacgaataattcatccaatgctggtgaattactgcctgccgaaacacgaataatgagcttgagacggtgattgaccaattcttgcggcacagtggttgatgcccactcaaagcggtcatttttgacttcttcagagccaagatcttgccagtcgtggccatcttcgtctaggacttgatacccaagtacttttgcatcctgatctaatgacgtaccaatgctaaagtcgccggctttgatgactgccttttttgcaacgagtggtttgaggttatcaaaccgtgtcttgaaacttagtccgttaacgggttgcaagacagtttcatcaacagtggtgaagcgatagccgccttgattgagcgccttggctaaggcagacagtgccttaacggtttcggcatcgtaggtcatggcattgctgtcagcagcggtgatctgcaaaagtgtcggtaggttgaccgcttttaatttggcatcgtcactcaagggatccacaatcgttaacaatgtgttgttgtcgtcctgcgtcgtctgaatcaccgcaatttcgctgtggtgagcatctgccgttgtatcctgcagccacaatgtctgcaaaaatggggtagggattgacgtcaagttttgcaatgcctgatataatttattgcccaagagattcgtgtagcttgccaataaggcggtcaatgcctcatcatttgatccccacaatggcgagtttgctaaacgatcggcttcttgctgatatgctgtgccaatttgttggcgtgcctgagcaacggtgagtggttttgtaatcagggcagccaaatgtgcatcattaagattaagcatgcgtgcgccctccttcaagctttaatgactgcatgaaatcatccttcaagttagctaagatattttcaaattcagcgactgagctgtaagtccccatcactgcttggaattcatagcgcgtgatggctgcggaaacttcgagttcgcgtttgcgcttgtcgaaaatatcatcggcggtaagcttttccttgtcgaactgtgctttcagtcgcgaggcatctcctgaaggttgtgaaggcgatgcttggtcatcatcactcggatcaataaagtttttcaacaagccgcggaaaccgctgttgccttgggttgcttggccgcgctctggggcgttttcggcttccaagttgtcgatttgggtgtgcaatgaatcgacgtcacggtaaacctctttgcgcatcgcatccaactggcggtctagataatggtcgggatcgtcagaaaaagcttcgagttgtggtaggattcggcgctgttcgtcagctgactgcgtgattgctcgcaagatgacgttaatatggccaaactcgcgtcggtggtaccaattaccaaagtagacggttccttgatcattaacttcaaaaaaggggatgtgctggcgcagaaaatcaataagaccgatctgcagaaaatcatgcagttccgcctgtgcgtttttgtcataagccaaaatataaccaggcgtttcttcgatgtctagccgcagattttcagcggttgcatccagtccctgataaaggcgataacgtgactttttatgccaagcatcggtaaaatcgttgaagaatttcttttgataagtaaggctagcttcaattgacatttaatatcctctcacattctatactaatgatttaagtgtaccgcataactggcaatataaggaagttttcttgtctttttcaagcccagaaggcagattcagccgtaaatgctggatacatgctagaatatggacgagaggtcgttgcttcctataaaacgcgctcgtcaatccagcaagttgcatgtaggcggattgacctgcgctcaatatgaaatgaggtaggcaaaatgaaaattgctgttttgggtgctactggtcgcgcgggcagtgccattgtcgctgaagctcggcgacgcggacatgaggtgctggcagttgtgcgtgatccgcagaaggccgctgatcggcttggtgcaacggttgccacgttggtgaaggaaccgttggtattgactgaagccgacttggaaagcgttgatgcagtggtagatgctttgagtgtgccgtggggttcgggccgtggttatttacatctggactttgccacgcacttagttagtctcttgcgcaacagcgatacactggctgtctttattttgggaagtgctagcttggcgatgccgggtgcggatcaccccatgattcttgactttccagaaagtgccgcaagtcaaccatggtatgatggcgccctttaccaatattacgaatatcagtttttacaaatgaacgcgaatgtgaactggattggcatttcaccaagcgaagcctttccaagtggaccagcaacgagttatgttgccggcaaggatacattgctggtgggcgaagatggacaaagccacattacgaccggcaacatggccttggcaattctggatcagttggaacatccaacagcaattcgagatcgaatcgttgtccgcgatgcggattagatgcttgtgcagcgattaaaaaaggcaactttgcaacttcccgaggcgatgttaggaaggtcaaagttgccttttgccatttttgcttggtggactattaaagacggtaagcgagcctgctttcgctgaaacgggtaaattagcccagaaatctgcacataaggacattgaacctaaacaaccaaaactccgccaattttgcaggtcctcgcaaacgcgttcgcagtcgcagaaacctgctttcgcgctacacaaaaaaacccgcgtattgggggtacgcggggtttcctgtcaacaccattgggggtggtgccgacttctttttactttggaggagtaaaaatgaaaaaaagttgggttggggtagtagtaagaagggggtaaacttccttgctacatagaaaagaataatctgtaattgtgaattttttatgacgttctggaagaaaaattttgaatgtggttttttaatgttctttgctactttttgatattgtgagcaaatgttattgaattttaaatggtcaaaatgtcaattagttgaaaatatgtttatataaattgacaaaagctgttgtgattgaagccttgatttctcgggcgaaacttaaatgaatgaattgcgaccgttttaagcgttaatatcgttatcttaaggtataataagtgttccaaaaaaacatggcaaaaattttgccggaaaagaggtaattttgatgggggtggtagtatctaactttcatctggcgaagatcacagctgaagaaaaagtgaaactaacttctggaaaagatttctggacctctgagcatcttgccgataaaggtataccaagttttcggatgagtgatggtccccatgggctgcggtatcaggcactggcagcggatcatctcggaatcaatgatagtgttcctagtaccagttttccaacagctagtgctagcgcagctgcgtgggatcctgatctcattcaagcaatgggtaaggcgattggattagaagcgcaaagtttaggcgtcgatatggtacttggtcccggcgttaatatgaaacgcaatccactttgcggtcggaactttgagtattttagtgaagatccattcttggccggaaaacttggcgctgcgtggattaatggtatccagtcgcaaggaattgctgcatgtctcaaacattttgcagcgaataatcaggaaaatgaccggctttcatctgattcgctggtggatccgaccgccttgcatgaaatctatcttgaggcttttcgtattgctgtcacagaaagccacccagaagcggtcatgtgttcctacaacaaaattaatggcacctatgcaagtgataatctgtatttgatgacccaagtgttgcggcaacaatttgggtttggcggggcagtgatcacggattggggagcgttgaatgataaggttgcggcgcttaatgccggtacggatttagaaatgccaggcgacgatcatttatttgatggtgaggcgctgcaggcttatcaacaaggcacactgaaattggccagcttagatcgagcggtgactaagattgccgaaattgcccgcaaacaacggcccaaatttcagggatcgcgagagcaattactgcaagcaaatggacaattggcgcaaaaaattgcggaaagtgcgattgttctgctgaaaaatgaggccgccttgttaccattacaggctactgatacagtcgcggtcattggtgagctggctaaagctacacgcttccaaggggcagggtcttcgcatattaatgcttccgagatcgtttcagttttggatggccttaagcaaaaaaaggtgtcatttgattatgcggctggctatcgacttgacgatcaggatgattcgcaggcgactgccgaggcattagccttggcacgcaaccatgacaaagtcgtttttgttgctgggctacccgacaattatgagtcggagggctttgatcgccaaaatatggctttaccaaaagttcaaaacgatttattgcaggcagtgaccgcagttaatccaaacgtgattgtcctgttagttgccggtgcaccggttgagcttccgtgggtggatcaagtcaaagctgtcgttaacctgtcacttggcggtgaacgtatcggggccgcagctgccaacgttttgacaggtgctgtcaatccaagcggcaagctagctgaaagttatccgctaaaataccaagacgtgccctcagaggatgtctatgataaaaaccctcggtcggtgccgtatgttgaaagcacatatgttggctaccgttattacgacaaagcaaaagtgccagtcgcctttccatttggttttggtttgagctacacatcgtttgccttgaaaaacattcagctctcaagtgatcacgtaaccgatgatcagccactgaccattagcctgcaagtgaccaacactggaaaggttgatggtgcggaagtggtccaggtctatgttcaagaacaacaaccacgaccattacgaccggaaaaatcattaaaggcattcaaaaaggtttttgtcaaagctggacaaaccgttaatgttgctctcgagctgaaggcacaagcctttaaggagtggcgtgaacagacacaaacatgggtcttgcctgaagctcaaaaggcgattgctgttggtaccagtgtcactaatattgatgctgtcttaccagttagcttcacaggggaaacttttaataactttgcaacgattccaaattggtatacaacgctttccgggaaacctagtgttcaagattttgaacagttgacagaccagaaagtaccggcaccacatgaatttgtaccaggcgaattcactcgactcaatacaccgcgagaaatgaagaaacactcattgttgctgcggatagtggcgtggatcacggtcaaaattcgaactaaagattatatcgacaagcaaggacccgaggcgaagttccagcaggcaatcgtattggacacgccactcattcgcttggcgcaacaggccaggggtgcattaaagttaagcatggttgatcgactcgtagctgcggccaatcatcagtatgtgaaaatgatttttagataacagatgtattgtaaaatcattaaaaatttttcttgacgaatgacgattggattcggtatgctgattctcgtaccaaacagatagcgtgtcagcagacgtgatttctgcgactgcgaacgcgtgtttaaaggagtgttgaccatgaacttagtacggcaaacacaacttaataactttttcggcggctttttcggatagcggtttgcagtgagatgcaaaccgcgcaagcagtggtttgcatccataaggccgtcacattaaatgtgcacacaacgccgcatggatgaacaattatccatgcggcttttctataccgaaaaatctcggggccagtcgcatggtgaaaaccagcggctggtcttttttgcatcatacgactatgttgaccgttccggatggctgaattgtcactcgtcacttatcgataacgcgctcgccagcgcagcaaccgcgctggctcgcgctcacaggaggaatttttatgaaaaagcatcgactacttgttattgccactgcagcactggttggcttaacgttgatcggctgcggcaagaaaagtaacgccgccagttccaaaaccgttaagatcggtattttgcagttgattgatcaaagtgccttgactgaggctaggaaaggctttgtggccgagttggccaaagccgggtacagtggtgatcgcgtcaaaattgattacgtcaatgcccaaggcgaccaagctaatctgaaaacgatgagtgatcgtttggcaagtgataagaatgatgtgaatcttgcgattgcgacccctgcagcacaagcactccaacaagctgacaaaaagacaccgatgttattcaccgccatcacggatcctaagtcagccggattggtcaccaatcccgcaaaaccagataaaaatgcaaccggcgtgacagatttagttgcggtagccaaacaaattgacctgcttcatcaaactttcccagaagcaaaaactgtcggcctcatgtataacgctggcgaaccaaattcggtttatcagatcaaacaagccaaagctcggctgaaacaactcggtttgcgttaccaagttcgtacagcggcgacaactaacgatgtgcaacaggccgccgagagtttagccaaaagcgtcaatgccctttatttaccggccgataacgttatggctgccgctatgccgaccattggcaaagttgccaaggctcagcaaataccagtcgtcccagccgcttcgaccatggttcaagacggcggcacgatcaccaaaggcatcaactaccgcgaccttggtaagcagacggccaaaatggctattaaactgcttaaaggtaaaacagttaaaacattacctgttgagaaaccggcaaaagtcgaaacggttcgcaatgaagccatgttaaaagccgtcaaacaaacggttaaattaccagaataactgctatagtaacgttctttgacattcttccccatacaaaaactgaaatagccgaatgtaagttttttgtttgtgttgacaagatgagaatatgagtatacgctttgagacaagtcagagagaacatctctgcatgaaggagtgttgatcatggatcgagtcaaaacaacacaacttaatcattcttattattacggctatttcggataatggtttgtatctcatggatacaagccaatcaggtttgtatccatgatggccgtaagtgtttaacttgcaattaaccgccacatggacgaattcatccatgtggccttttctttttccgggaaaaaacaatggccagccacatggacgaaaaatccagtggctggctatttttgtaagagcgcgagtcagctcgggtagaaaccggagtgtaagcggccttggtcgtgatagtcgtattttgaccactgcgaccaaggtccttacatgtaggtttctgcgccagtgagcgcgtttgcacaaagtgtgaagcaccatcaccttaacccgtacatcccaggaggaagaaaaatgaagatcaaacgaatggccgctattgcggcagcagcactcactatcatggttttagccggttgtggaaaatcaaccagtgcagcggctgacaagagtcaggttaaaatcggcattttacagttgattgaccagcaagcgttgaccgcggcccgcaaaggcttcactgaagaactggccaaagccggttacaaaggcaagaagatcaagttggactacgtgaatgcccaaggcgatcaatctaatcttcagacgatgagccagcgcttgcaacgtgataaaaacgatctcaacttggcgatcgctacaccggctgcccaagccctgcagaaggcagacagcaagaccccattgttgttcacggcgatcacggatccaaaagcggctggtcttgtgaccacaacagccaagccggacaaaaacgctacaggcgttacggacatggtagatgtcgctggtcagatcaactttttacacaaagcctttcctaaggccaaaaaagttggcttattattcaacgccgccgaagaaaactctcaagttcagatcaagcttgcgaaggcagcaatcaagaaactggggttaaccgccgttgaaaaaaccgccgcgaccaccaacgatgttgaacaaagtgccactgcactgatgaaacaaagtgatgttgtgtacattccaaccgataacacgatggcggcctcaatgccgaccattggcaaaatcagcacgaaagaaaacattccggtcgtcactgctgatgcgacgatggtgaaattagccggggtggcgacagtagggattaattacgaagatctaggccggcagactggcaaactggctgttcaaattttgaaggggaagaaagtcagcgatctgcctgttgaaaaaccggctaaaactcgattggtcactgatccgacccggatgaaacaatttggtttgacagaggctgccttgaagcaagctgaataatcgatttcgtgtcataacgcgctggcagtcgcagcacccgggctgactcgcgcttctaccataacgcgctcaccagcccagaagcctgcgtgtaaggacctcggtcgcaatggtcaaagagcgaccatcacgcccaaggccgcttacactccgctttctacccgggctggctcgcgctcacttaacaaaggagctttttattatggacatcgtgacatcaagtattgcccaaggattactatggtcggtcatggcgattggcgtgtacctgacttttcgaatattagacattgctgacatgacggctgaaggcagttttcccttgggcgctgcgattactgctcatgcaattgtcacgggggtggggccgattgcggcgacgctcatgggttttgccggaggcgctgcagctggtgcagtttcaggctttttaaccaccaagttgcatattccagacttgctcactggtattttgaccatgaccgggttgtattcggtgaacctcttcatcatgggcaaggctaatatcagtttgattgggactgttaagacggttttcaatctggttgacagtggtgatgccacgaccactggcatcatcatcggtgccattgtggtcgccatcgtgattggtattctggttttctttttccataccgagatgggcttagctgctgcggcagtcggcaacaaccagaacatggcggcggccaacgggatcaacaatgatgcgatgaaaattatcatctacatgctgagcaatggccttattgctttatcaggcagtctcatggcgcaaaccaatggctatgcggatttgtcgatggggattgggaccatcgtcattgctttggcagccatcattatttcggaaatcctattgcgcggcgtgccgttatgggcgcggttgttgatgatcattgtcggcgctgtgatctaccgcctgattattgcggttgtgctggatcttggtgtcgacccgaactacctgcgtttcttctacgccttgatgttaacgatcttcctgtcattgccgttactgaaaaagaaattgcaactcatgacaattcgtcacggtaatcggcgtcaagctcgcatcgttcaggcacagatgcaagcagcaaaaaccgattcgatgagcacacatgctggtgatcagcaaaaggaggtttagccatggccgtacttgaagtgcatggacttcatcagtattttgaacaaggaaccgtgaacgagaatcacgcgctgaaaggcattgatctcagtcttgaacgcggggagttcgtcgcgattattggtggcaacggcgcaggtaaatcaacgttgctgaacagtatcgctggtacgctcccggttagtcaggggcagattttgattaacggtaaggacgtgacctatcaaaatgttgctaagcgggcgaaggtaattgctcgagtctttcaggatccgcgttccggcaccgcctcgttgctgacaatcgaacagaatttggcattggccgaaaaacgcggctcttggcgtaacttttgggccagtggggtcaaacggagtgatcgccaacattttaaggaaaaattggcgacccttggattgggccttgagaatcgcctgggtgccgaaatgggcttgctttctggcggtcaacgacaggcagtaaccttgctgatggctactttaaaagaaccggcgttgttattgcttgacgaacacacagcagcgctcgatccgcagacaagcgctaccgtcatggctttgactgataaaatggttcgcgcgcaacatacgacaactttgatgatcacacacaacatggccagtgcactgaaatatggtgatcgcctaatcatgctggatcatggtgaaattgctgttgatgtccgtggcgaggaaaaacagcacctgaccgtcgaagacttattgacgatgtttaaagaacgcagtggacaagagtttgccgatgatgctgttttgttgagttaaagctggcctaaaagaagttaatgaatagatcctctatgagaaaacaaaagacgactgatttccgccattggaaaatcagtcgtcttttggtggctatcagttgtctttcaaccgtgtttggttgaagcgcaactttgatggttaaaaaatcaagcttgtccgaaattagtggttaattcataactgctgccagcaaatacagatactcagcagctggcacttttccattagcccatgtccacaatcgtccgggttgtgtggtggttaaagtgtttcgtcaaggtttgtggcaagtcagctagtttgaccgtatcgacaggcattggcgccaatttgtccaatgtctcccatgcggctgctcgggccgcagcaggggcattgacggaatccacaccgagcaagctgacattgcgcaaaatgaaggggaagacggtcagcggcaaggcagttcctgcagcattgccacataacgcgattgcgccgccataacgcatacttggcagcaaactggttgtgaacgatccaccgagcggatcaatggcaaagtcaaagcgttgcttactcaaagcctttcccttgggcagctcgtcaagtgctaatgttgccgtggcgccaagtgacatcacctgtttttgctgatctggtgtccgcacaataccgattcgattcgtgaagcctgcttgctctaataagcgcatggcaacactgccgacaccgcccgttacgccaccaacaagaatctgcggtgcatgctcaggcgtcatgccgtgcgcggtcaaagcagcgacacataaggcagcggtcaaacccgccgtgccaaaactcatggcgctagcaagtgtcatggctgatggcagcgtgattgcccaagaagccggaatgcgggcatattcagcgtaaccaccgccttgactgacccctagaccatgaccggtggccaacacttgatcgcctactttaaaattggcatcttgactggctaccacagtcccacttaaatcaatcccgagaatctgtggataatctcgaataatttgattctgcggttgataggcaagcgcatctttgtagttaatatctgaataagcgaccttgatcaataaatagcctgctggtaagtcatcttcgtgcagggtttgaaaagttgccttttgcccatcgtgaaccaatgcttgaaatgtttgcatagaacaagcctccttggatggtattcttccacctattgatggtgttgaattgccatgctcattagttaactaaagcatatcagataacgatgatatcgcaaaaccaacgttattctgccgaatctgataaggtggcctgacgccatggcgctaattcgtgccgatgttgacggcgcttgtaagtttcaacaaccaacattggcagccagatggcaccgaggacgatggaccattgtccggctgttagtggcgctagctgaaaaatttgttgcaatggcgcaatggttgctaaggcaacgatgactgtcatcgtcagtaaaaggctaccagtcaggatcggattgacagtcatcgctgaccagttaagccgaccacgggttttgatgggaaaaatgtccagcatcgaaccgatggctaatgtcagaaatagcatggtcatgccgatacctggcacatcggggctgaccacgaaacggccaacgaagtagatgccaagaatcaagccaacataggtggtcgtccgcacggccacacgtttgccgaggccattgctgaaaatactggctgcttttggaatgggtttcaagtgcatcatgccaggttcagccaactctcggctaaggaagaagccgggaataccatcagcaaggacgttgacgatgagtagctgctcaggtgtcatcacagcaccccagccaacgaggacggccagtagcatcgtgaaaatttgggcaaaattaaccgaaatcagaaattcaacggcttttaaaatattttgatagacggttcgaccttgtgcgacagcatcgataatcgtagcaaagttatcgtcggtcaaaaccatatcggcagcatttttggccacatctgtcccagtgatgcccatggcaatgccgacgtcggcagctttgagcgctggcgcatcattgacgccgtcaccggtcatggcgaccaccgcatcttgtttttgccaagctttgacgattcgaattttatcactcggggtagtccgcgcgaacacgcggatatcagcaatattggccgccagatcctcgtcgctcatttggctgaggtcatggccggtgatcgcttgttggccgctttcaaggatgccaatgtctttagcaatggctttggccgtaccgagatgatccccagtgatcataaccgttgtaatgccggcctgtttagcagcgcgaatggcagcgggcacttcagggcgcggcggatcaatgataccaatcaatcccaacggttgtacggcggttagctgtgtttcccagttttccccaggatcggtttcaaattgttgatagccagccgccagtacccgcaatgcttgtgccgtcatttggtcatggattgcggtggcagtttgctcccagttttcaggcgcaaagttaattcggtcaattgctcctttaataatcgctagatagtggccatccggcgtgcgatgcaaagtcgccatggttttcttgtcagatgaaaacggcgcttcagccacacgcggataggtttgctcagcctcggtccgactcagatcgtaatgatcaagtagccgaacaattgccagttcagtcgcatcgccgatatctggttcatcatcagcagttaagtgtgcgttggttgcaagaccgagatacttgaaaaagcgggtgtcattggctgacaactttgtgttggcgactttatgaatttctttgccataaggccagaaatgggtaactgtcatgcgattctgcgtgagggtcccagttttgtctgaggcaatcacgttcacgttcccaatggtttcaacagcggtgacttggcgaataatcgcgtggcgcttggccatcttctgaacgccatgagccaaactgagggtgacgatgacgggcaaggtttctggaactgcagcaatggcgaggctgacaccaagcatcaagctatctgtaaagccctcctgatgaagcaaggttgctagcaaaatggtgatgataccgcccaagatagcaacgaaggatagccgcttgccaagggtgtttaaccgtttggccagtggcgtcgtctgcttttttgtctgattgagcagtgcagcaatttttcccagttcggtgtccatgccggtagccgtcacaatcgcagttgccttgccgctggtaatggctgtgccagagaaaatataattggcagcatccccaagatcatcaggagcagtggccaaggcttctgacgttttggtcacgcccagactttcgccagttaaaattgcttcatccgcttcaagttcttggctttgaatgattctggcgtctgcaggaaccgcatcgccggccttgaggagaatcaaatcgcctggaacaagctcggcggcctgaatggtttgcgtcttgccttcacgaacaacggtgacggtttgaatcgtcatggctttcaaggcagcgagtgctttttcagcgctgtgttcttggtacaaagcgatcacaacattgagaatgacgatggcgccaataacaatggttttggtccagtcactgtcagtcgtcaaggccagataggcagagagaccaacggcaaaaagcaaaattagtgaggtgatatcgctgaggtgatggccgatttgccggaacaagctaggctttttagccgcggtgagctgattgcggccattttgctgcaaacgtgcagctgcttctttagcagtcaggccggttttggtgttcgtcgttaattcagcggccagatcgcttggcgttaagcgcgtcaagtgcttggtcgttgttgtcatgagttcattcctttcaatttgtcagagacacgatcattacttacttataataaccgtaacataaaaatattagtgttgtaaaatttaaaatgagtttagacatgagcaccatcagctagttcaaacatatttatggcatttagcttattcttttgtgctcaaaaaagccgctagcctgatgtcgtcattcaaacaacaggttagcggctttcttgattttaaatagtggcgcttgtggctagttttgtaatgcgtgataaggataacttgtttgttgcgtcgtttgggttttgaagccgtatgtgtcggcaacgatatagagcggtcgatggcggctttcagcgaacatcctcgcgatgtaggtgccgagcatgccaatggtgaaggtaataccagcgccaactagcaaggtgatgatcatgacccaggttaagctagtgaggtggcctagtgccaaactaagcccaaagagcgcaaccgcgatgatcaagaagaagccgcttagccagctagctaaagttaacggtactgtggaaaaactagtgatcccatccatagctaagtgcagcatttttctcagtggatagtgcgtttcaccggcttcccgttcttgacgatcgtactcaacggcaatttgtttgtagccgacccaagtgaccatcccgcgtacatatgggtcctgttcattcatctgcttgagaacattgacaacacgccgatccatcaaacggaagtcgccggtatcgacaggaatgttgatgctagtgacagccttgagtaagcgataaaacatttcggcagtcaacttcttaaaccacgtttcaccactgcgtttgcgccgcttaccgtaaacgacgtcatagccttcacgccagcgggctaacatttctgggataacacgcggcgggtcttgcagatcggcgtccatgaccaccactgcatcgccgctggcatagcgaatgccggcagtgattgctagctgatggccgaagttgcgggagaaatcgactaaccgaatcgccggatttttggccatggcggccctgatttgatcagcactgtcgtctgttgagccgtcattgacgaaaattaactcgtatcgttccggccgtgcacgaacgtaatttgccaaaaccgttaaagtttcgccgatgccagcactttcgttataaaccggcaacacaatcgaaatgaatggattcttttcttgtcgcatatcggggactcctttcatagagagatcaagacgctttatttcaccatgctggcatcgagttcatacaaggtgccaccgcccatgccgcctcggctgccaaagccttgcgtgctggacgatgaagtgccgccatattgacttgcggcaacctttttgccgactttggtgacccaagcttcaatcttcgaattgcctgagcggccagaggaaaggtaatacttcatatcgccctttttaacaagcgctttgaactgtttcaaggtaatagctggatcagtcccgttaaagccgccaatggccatgaccgctttgccagatttgatgatatacggggctgcagtgctggcgttgctggttgcaaacaggtatttggcattgccttgatgtttttcaacatactttaacaagccagaatctgctgtgccgttgccgagtccaccgttaccgctagaggagagcagtgatggaccggcagaaggaataccagccgaggaaccagctattgttggcgttaaggaccagaatgctggtgcggccatgattgctgcgatggcaacgcctaacgctgttttacaccatgctttagtgcggccgatgaacagaagtatcaaaccgagcaggccgccagcgatgactaagaatggctgccattgataatagagactgacataccaagcctgcaagcctgtggtgaccacgattgcgattggcaaaagccatgcttgccaatgtttcagatcggttttgaattgtttgaacatagtgacagttccgatgccgaataaggcggcaattggtggtgccaacatgatcatgtaataaggatggaagaagctggcgatggagaagaagccagcaacggggatgagccaaccaagccaaaagagcaagtgattttgttgaatggttgtctggtaccatttccgtttgcggtccaaatagtaggcaaaggcactgatgaagccaatgattgcagctggcagaagccaactgatttgtggacctaaatcagattgcaataggcgtaatggaccgactgtcccgatggagaaagcaccaccagcaccgccacgttgactgccttgacgaccacgtgtaccgcccttaaacgtcccttttttgaagttggcaggcattttgcgacctgtaccagcgcctctttcggtcgtcacagcgggttgcttcccagccgcgccagtcttagtgccgggcatttttgttccggcaggtggtgttttgcctgtgttgccggcaccaggcgttccagttggtttcctagcagtcgtgccacccggcgccgtgcctttagcaccggttggcggggtgccagcagtgccagtggagccggtcttggatttggtacccataccagggaaggcagcaccagttcctgtggtttgtccgagtaatcgttcagtgccgttgtagccaaaagccagctccaattcagagttagtttccgaactgccaacgtaaggccgttgactagtggcggttgaatccacctgtattggccaagcgagggtagtgacggccatagcaaccaaggcaatagccaaggtgcctaggcgccgccaaagtttctgattggaagccagccagaagaataagagcaaagccggcaaaatcataaatgcctgtagcatcttgatgttaaaagagacgccgatcagcgcgaaactcacaacaacgagccatggtttgcgattgctaatggccttcatgaggcaccaactggcgagtaagaggaagaactgaagggttgcatccatattattcgttcgtgaatcagcaacaacgatcggtgtcagcgttaacgccaacgcagcaagccgtgctgcccaaatgttaaagcgcggtttgatcatgttgtagatcaaggcgacgctgccaatcccgaaaagaatggatggcaaaacaacggaccaaccatgtacgccaaaaatttttgccgaaatagccatgaaccacaaggcaactggcggtttatcaacggtgatgaagccggcgggatcgaaggcaccataccagaagttatgccagctttgaatcatactggtaatagcggcggtgtagtagtcgttagcgttaccggcttcccaaatattccaagcatatagaaaggcggctaggatcagaatgccaataaaccaccaatcaacggtccactgtttaatttttttcatgtgcagcaactcccttttctcgaaatacccagaacttgcttaaaaggaagttcgttgggacagtgatcatcaatgcgaacataggtgcaagcggcttgggcagtcgtaagaaatcattccaaaaacttgtcaaaactaaacttagaatgaaggtcaggccataggagagataataacgcggtgccaccgttttgagttggcgtcgatcctttgccttgaacacccatgtgtcattaagaaataggccaaaaatggatgtcagcccgtagccaacccccatggcggctgtcgggttgatcagctgatataatgtcaagtaaatgagataagttaaaatggtgttgaccccaccgaccaagccgaagccgatgaattgtttcagcttttgacgcatcaaaccgctcccttcttggtgaatgggatcattatgagagttacagcataaattaaccttaaagtcgggcattctatttcttaagatggctttatggttatcatgatatggtcagaccagcagatataaggttaccaacaaataagtggggcagaacatgacagttaaaccgagaattcttgtgatcgaagacgatccggatttaaacgagagtattactgattttatccgcgcatttgccgacccagaagccgccttaaacggtgctgatggtctgtatttggccgaggaaggtatttttgatgccattattttggacattatgttgccagaattaaatggttttgacgtactcaagaagttgcgggcaaagcaaattaaaacacctgtattgattttgacagccaaagatgcgctgaccgataaattgcacgggtttgaacttggcggagatgattatctgacgaagccgtttcatcgtgaagaactcattatgcgtttgaaggcgttgttaaagcgaaccggtcacttctttgacgatgacggcttaactgctggtccttttgtggtacatgtgacgagtcatgaggtgctcatcaacgatcaaccagtggccttgaacggtaaagaattcgatctgttggtttatctattacaaaatcagaaaacaatcatcaccaaagatcagatttttgatcgtttgtggggatttgattctgaaacagctgtcagcgtggtggaggtttacatgtccaacctgcgcaaaaaattaaaaccgctaaaagttgagcattggatcaaaacgattcgcaacgttggctatatttttcaggagccggagggcagtgaatgaacgcagaaaaaggtattaaacatcagcaacgtcgcttattcatcgggcaactgttgagctttgcgggcttgtttgtggtattaggtatcattgtttttttcttatatgagcgctcaatttatcaagacattgatcacaccttagagcagcaacaagcaatgattcttaatccaaacgaagaaacgacaaagcttggtccgcagcaacccggtacgagagtcactcacccagcacctttccggaccaacatggtggtctttaatcaaaaaggccgcatcattaatcaagccatgcttggtgagcggttttatgcttactttaaaaatttaaaactggatcgatcagcgcaaaacaagttacagacattgaccacatcaactggaacattccggacgctattaatcaaagcacctaaatacagcgcagatcctcagtatgccggtcactatgtgttaattttgcaaaataccgatgcacaggaagcagcgattcgatcatttcggcaggttctgattgtcaccattattcttttttgggcattggcactcggcttgtcatactggttgtccacacgtgctatgcggccaattgtccggtcatggcagcgacagcaggatttcgttgccgacgcagcacacgagttgcgggcgccacttgccgtgattcaaagcaaacaggaagccctgctgacgaaaccacaagcgaccatcattgacgaaagtgaggcaattgcgacttcgttaggtgagacgaaacgcttgcgtcagctgaccgatgatctgctaacaattgccaaagccgatagcaacaccatcgaaattgaattggttgatcaaccttttgaaaaggcctttgaaccacagctgtcttcttatcaagatattgctgtcagtcagcagaagtccttcacaacaacgttacccaaggccggtcgtgcactgtttgacacggcgaggatgaaacaactgttagtgattttactggacaatgcctttaaatatacacaggcgggtgattctatctgggttgaagtgacacagacaccacgtgattggcagttgcaggttggcaattctgggccgagtattgcggatgctgataaagctcgcgtttttgaacgtttttatcgagaagatgcctcgcgtagtcgccaaacaggtggtagtggacttggtttagcaattgctcggtggattgtgaccatgcatcacgggcatattgaagtcaaggatgtccatcctcatggcgcacttttcatcgcgaccttcccaaataagccgcgtatgcgttgatcaaaccaaagaacatagaaaaagccgcgtcaaaaatcacaattgatttttgacgcggcttttctgttacgagttgttaagaatgcaccgagattacgtttcttgaaaatagcagttagcgagcagggttatttcgaacaccattggcttcggtgaagtcaataaagcccatattggtatcaatatcaccgccgtcaccactcaaaactaaggtattcagcgttttgttaaagtggacattcatgtgggcattcaaatcttcttgcgaataacccttgatcagaattggcccaaggttactgtcaatttcagtgtcataatccgttgccggatcgctagcttttacgacgttaagtgagaactggacctgcatatggatcatcgcatgctgcgaataaggacccaccccatcttcaaacgtaagcagcaactttttgtcatcgcccagatgcggttggattttttcagtggcaccttcatcaaaatgaatttgcataggatcagctcctttcgccgttaacataggctgatttggcgttaaaagcaactgatttgtctcgcagggaaaatgacgttaaagccaccaaattatcgggtgaaagtgagtttattgtgattcaaatatcgacgcaccttaaaactcgcgccaagtttgaaacaagtttcagcatcttttaaatcaattccagtaatgtcactgatgtgcttgagccggtagcgcaacgtgtttaagtgaatgaaaagttgcctggcagtgtgggtgaggttttcaccagattcaagataagcgtccattgtcggcaacaactcagttttattctcagcatcatgatccatcaatgccttaaccgccggattgatgaaaaatggcaaaatttcggcatgatcgacctgtgccagcattaagtcaaagaaggcatcctcacacatggtgacgtgagttggttgagatttaagcttcgcagtacgactgcagacggcataggcagcgatggtatcttcaggccgcgtatattgattcgaaacgatcaaacgacagttggcacgatcggcaatggtcgctaaatcagctttaaattcagggttgttgtaagttggcaagcgacagaaactaaggctagacattgatgatgataaagtgtgatcaaagtttgtgagaaaagcggggttaataaatactttagtcgctctttcaacgctgccaaagattgtccagcacgcggctcacctttaatcaaaaccatgcttgttggcaatgttgcatgttctttcgcaaactgagcggcaaaggtaccactttgttgttcggtaagcagcatggtgagcagttgatcgcgttttgaggcggcggtcggcatcatccggtttttgatcaaggagctggtgataattttggcttcggctttgaagaaggcagtttgttcagcggtgagcggtctgacgcaggccggcatgacgaggtagcctagggcattgttgcgatatgccaatggcagacataaaagcagcaagggcagctgggattgctgaatgagaataacttgcgggatcaagtctttagcgggtctgaattttttcaatgcctgttggacctggacagaggtaatagctggcgctgtcaagtcactaatggccggcgcttgcgtggattgcgccacaggttgcccgacaagatcaagaacaatcaagggattacctaatgtccgagcggcttgattaagaatcgtgtcgaagtcctctgtgatcgctttaatagcaagctgattaacctgtgcttgtaaacttgtttcggacgtcaaaagacaaccagcccgatcgaatagttgagcaagttgcgactcgttttttagctgcgtttgagcacacagggacagttgtgcagtcttgccaacagatcctgtcaaagtaatcgtttgatcagcagatacagcaagatacagtgaggtcggatgtggcgaaagagtcatatcatcgtcaaattgcagacttgttatttcggggttttggagactggtatcaaaggctaatgggactgtttggccaagtcgttggagcaaagtatttaatttcattatttatcctcgaaggtgacgtgaaggtggcacgtgtcaattagcaaaaacatacaaatttatttgttcattcatgtgcaaactgtaccttcatcatacgttttgaaagcgctatcgtaaaggcgtattcgaaattgtgaataagcacacacatgaatgactgcgtgtgtggattcacgccacataggaggcaagcaattatgaaggattttaaggacaaggtcatgttcatcaccggggccgcccacggatttggtcgggtcattgctgaagaaggggcaaaacgggggatgaagctcgccttagtcgatatcgacaagccggctttgaatgaaacttatcaaatcgttgtggcaacaggggcggatgctgtgatgattccgactgatgttaccaaagaagacgaagtcaacgcagctattgatcagacacttcaaacatttaagcaaatcgatctgctgatcaatgatgcagggattgctttgccaggacgtatgtgggaattaccaacccgtgattgggaatggatcatgcacgtcaatgtgatgagtcaggtttatgcgatgaagcggattattccaattatgatggcgcaaaaaacgcgtggggcgattttaaacgtcgcttcgatcgctggcttggtcgataccccaggcatgcctgcatatcacgccagcaagtttgctagcgtcggtatgagtgaagcaactgcttatgacctgcagcgggccggtgctgatattgaaatgcatgtgatgtgcccaggttttgttcagacggatctttatcacactgaagaacatcggccaaagcaatacagcgatccaagtgatccttactatcaaagcgaggctttcctgaaaggtcaacagtttgccaaatatgtgatcaccaacggtatgccacttgatacgattgcggcgacggttttcaaagcacttgaagaagatcagttctacattttgacccacccacagttcaacccattgattttggatcgggtcaatcggatcgtcaaaaatggtgcaccagatgtccatgtgatggatgggattatgtagttagttactttcgataacacgcgaatcagtgcctcaaccgcgctggcgagcgttcacagagaaggagtgtcaaaaatgtcgagttatgttgtgagtcaagaagacgtgaagaactttctgaatttaccaagtatgaatgatcaagaagggatcagttttgcctatgccacggatccagacgccttggccaaattgattccggcaccgttgaagttggttgcaccagttgtgtgcggctacgtcgtccacatgggtaagccgtcgtttggcggaccttatctggaacaaacgctatttgcccttgttagctacaaagacaaaatgatgggttcctatccactaaccttgctcctgcatggccctggtgctgaagccggcttggtggcaggtcgtgaaggtgcaggtattcctaagaagctcgccgatcacatcgaactgcggcgcaatgacaacagtgccagtgccacggtggaacgtcacggcaagacgctgctttcggttgattgggaagctggggatgtcaatgatccttccattttgcaaacatttggcagccaatttgccttaaacaaagaatccgaaatgaacagttttttcttcacccatgatcttgtacaggataaacaaggtgcgaaccactttgaaaatgttgagctggtcgccacgcagatgaagtcgttggctgatcgagttgagccagggaaactgtcgattcaacttgcatcaactgaagatgatccattcggtgaattgccagtgctcaagccgcttggtgcgatgtggtatcattttgcgacttcgaccatgttcaacactttgcatctggaacaagtcgatgccgataaaaccgccccttatttgatcaccggtcgctacgatcgcagcatgatgaatccgctggcaacaacctatattatttgattgaaaacggttaatattgatattaagaaatgaggcaaataaaaatgacagaaacagtagcaacaaaaaaattaactaataatgacttcgcagacgtgatgtttgatcgtcattcagttcgggtgttcgatccatcagttaaaatcagtcgcgacgagcttcaggaaatgattaaagaagctaccaccgcgccatctgcctgcaacttgcagtcgtggcactttgtcattattgatacaccagaaggcaaagaaaaattgaaaaagtctgccatgaaattcaactatccgcagatcgattccagttctgccatcatcttcatcgccggcgatacgcagtctcatgaagtttatcgtgatgtttggaccaaggtttatgaagacggcaaaatcagcaaggaaaagttggaccagattttcaataccttcctgccattatatgaaaatgcttcacctgaatttctgacattagatgccaccatcgatggcgccatggttggcatgcaactgctgctgacggcgcgggcacatggctttgatgccaatccgtggtccggttacgacttcaagacgattattccaacattggggcttgatccaaaacgctttgtgccagttatggcagtggctattggtaaggcagctgagaagccgattcatactgatcgctatgatgtgaagcagctgattgactatttggactaatatgacggcacaaactgtccgagatgagtgggcacgtttaattttttagaaatagagaggaagtttacgatggtcgatgcagtagagaccgatccattcggcaaagttgatgcgattgatgtgttggatttagccagtttggaggcgcgtgcggagaaaattcttggccgtggcgaatttggctatatcagcgaaggctctgacgatggttacaccatgcgccgcaacaccaccgcttttacagatgtacaaatgctcccgcgcgtgctccaaggagtggagaagccggatcaaagtacgacctttatgggagcaaaactggcgtcaccgctgttaactgcgccgatcgccgggaacacgctagcacatccaagcggtgaattgggcttagcaaaaggcgcaaaagaggccggtattatgatgtcgcaaagcacctttgcttccaagacaattgcggaaactgctgcagtcagcgacggtgccccttagagcctgtttagtgtctttacggaatagctaaatttcaggtatgctttgcacaaaaactggagctaactatgcgaagaggccatcgatatcgcacttgatactgagcccaagctcaagcaaacctacgagacctacttagcgcttcatgatgctttgatggtgaagaaacatcccgcggaactggcaaacctgttagctacttacgagccaaacggtacggcaatggacatgacgatcgcgacgcttaagcgacacaaagtcgctgttctcgccgctgtcaccagcccttattccaacggtccgatcgaaggcgttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgtagagccttttttacttcaaaatcagctgactattttcagtgcaacaaaaaaacaccttcccgaaaatcaggaaagtgctgagacgccaaatgttgatcgaatgattaacgcttggagaattgtgaagctttacgagccttcttcagaccgtacttcttccgttccttcatacgagggtcacgggtgagcatgccggcctttttcagcgggccgcggaagtctgggtcaacggtcaacagggcacgggcaatgccgtgacgagtggcgccggcctgaccagaaaaaccgccgccattgacgttaacgagcacgtcatagctgccagttgtttcggtgataccgaacggctgggataaatcagtgatcaggttttcatatggaaggtagtcgcgaacgtctttaccgttcatcgtgatcttgccggtgccgggaaccaaacggacccgcgcaacggagttcttgcgacgacctgtacctgcgtattgtacttgtgccacagtaattgcctccttagattaagtttgaaatgtcaagtacttctggcttctgtgccaaatgcgggtgttcctccccagcatagacatgaagcttcaagaattgctgatggccaagtgtattcttggtcgggagcatcttcttaacagagtattcaacgagacgagctgggttatcccgcaagagatccccagcgatttcatgtttcaaaccacctggatgctggctgtggtgatagtaaatcttgtctgaggcttttttgccagtcaacttcagtttggaagcattgataatgatgacattgtcaccagtatcaacgtttggggtgaattgcggcttattcttgccacgcaagatcgaagcaacgacagatgagagacggcccagcggaatatccgttgcgtcgaccacataccacttacgttcgatttcacctggcttagccaaaaatgttgtacgcacgatttgtttcctccataattctgtgcttgtttgaacacgttaagtttccggggcttatcgtggggcaaacaataccagctactagaataccaacgattggcgtctaagtcaatgtaaaaatcgaaaaacgatcgccgcgaaactgtcgactgctcagcaaaccagtagtgccgaaccgccttatctagagcagctttctcatgctatgtttttgaaaggacgcaccatcatccagcacacttatcagtcttgctggatagttcctttctgttggacccctgtacaaaacatttgcaacgcgcgatcaagcgataattggcgtttgaatgttatccggttgctagtcggacgctcatttggttggagataaactgataggactgtcaaaaaatacaacgtcacttcccgaatttggtaatccggcgcgagtcgttgtttaaaaacggtaaagaaactgtctaagggattcaacaggcctttttgccacgcttgaaacactttgaatcgcgctgcttcatttaagttgccaatatcatggagcaccaactgcaagttcatatcattgtcgtcggttaacaaatggcccagccgattgacgttggcgacaaaatgttgactatctgtttgttcatgcacgatttttgcggccattgcttcacttacatgcatgacaacagcaaggtacaaggcctctttagtcttgaaatagtggtaaagcaacggttgctggacactagcagcgtcggcaatcatccgcgttgtgaccgcagcataaccgtgcgtcatgaataaagtttgtgctgtcgtcaaaatgcgttgcatggttgcttttttctgttgttcacgttgattcatttttttaagctcttttcgtttatcatttgataaatgagtgatattataattgtgcaaaatcaaatgtagaggtgatcaagatgtttcttgcctataaagagattacgcacaacaaggcccgttaccttttagtggtggtgacttttgtgctaatttcctacctagttttctttctgactggcctggcaaccggtttagcgcggaacaacctaaccgcgattgatgccttaccaggtaactatgtgctcatgtcaaaatacgcaaataaaaatctgttaagctcgactgtcactaagcaacaagtcaaccaggcagacactcatcaggcagcgctgcttggtcaagtgtccgttgtcgccgaaaacaccaagacgaatcaaaaggtgaacagtaatatttttggtgtcaatcttagtggcaagttgaagccacctgtcaccagcggccgaatgcccgaggacagcaatgaggtactggctgacgacagtgttcttcattacggcctccatcaaggtgaccatatcacgctcaatggcagcgatcaaaagtatcacattgtcgggctcacccatgatcgccttttttacactgtacctgtattctacacaactttaacgacttttcggcaattaaaatacggccaaagtcgtgtccagaacgtttcggttttgattagcccgcacgccttcaaaaaggtgcccgccaaaatggagcaagtcacccgagcgacattgattaacaacatccccggttataccgccgaaacttcgacgtttgctttaatgattggtgccatgattggcattatgttgctcattatcggtattttcatgtacatcttaacaatccaaaaaatctcgatgtatggcgtcatgcgggcgcaaggtatccgaacgcgtgccatcatcgccgcattattctggcaaatcctaatgctcgccgtggtgggcgttgcggtgggggcaggcctgttgatgctgactgagctgatacttcccaaaacaatgccattttatgccaatagtatcctctttttcagcattgcgacggcgttaatcgtcatgtcgcttattggtggactattttcacttcgacgcattttacaaattgatccattagcagcgattggaggcgaatgagatggcaattcttattcagttgaaacaagttagtaaaacttacggtactggccataccgcggtcacagctctgtgcccgaccgatttcactttaaaggccagtgaatttgcggccatcattggcccttcaggttcaggcaaaacaactttgctgacgattatcggcaacctgcaacgcccaagcaacggtcagattatcgtcaatcatcaagacaccacccatttgaatgaaggccaacgaaccgatttacgcttcaatacgtttggttttattttacaagctagcaatttgattccatttttaaccgtgaaagatcagctcgctttagttgatcggttcaatcatcatcacaaacatgaaactaccatgtcagcactttttgacatgcttggcattagcgatttggtcactaattaccctgctgctttatctggcggcgaacggcaacgcgttgccatcgcgcgagcattgtacaacgatccgtcgatcatcctcgccgacgagccaactgccagtctcgacactaagcgcgccttgcaggtcgttcagttgttagcagatatcgcacaccattctcaacgcggcgtcatgatgattacccatgatacacgcttacttgacgctgtcgacaccgtttatgaaatgcgcgacggccatttaaagacgttaactgacgaagggatgcggaaaataaaggcaagtgccatctaaaaggtgatgtcgtaaacgcgctgactgttaccagctatcggctagcaacgaagaaacaccccaaaaattagcactcaattaaaaacagtgctaaaaatttgcaccatctcctaagtaaaaggattataatgaacttgtatcaaaaatgagtataaatcatggaggtaatcattatggcatcagtagatcctgaaaagacattgtttctcgatgaaccaatgaacaaggtatttgactggagcgacagcgaagcacctgtacgtgatgcgctgtgggattattacatggaaaagaacagccgcgacaccattaagactgaagaagaaatgaagccagtcttagatatgtccgacgacgaagtcaaagctttggccgaaaaggtcctcaagaagtaaccatcgtcaaacaactgaatatcatgaaccgcggatcgcactatcgggtcgcggttctttttttgcaaattttaggaagtcctccccgccaaataattaatttcttttgcgcttgaccctgaccttacgtcacggtttattgttatagttgattaagggagcgcgcgaaccaagtcggtttgaaaccggcatataagcgacttcaaggacatcggccgggtctttggccatctttggccattgcccttggaagtgtctggttgagcgcgtttaggaggcaagtgatgacctattctacaaagcaactagccgatttggctggtgtgacaccacgaacattgcgctacaatgacaagattggcttgctgaaaacgcaacgtgatcctgataatcagtatcgcgtttatactcaggctgaggttgatcgtctgcaaaccatccgcttcttacaattatttgagatgccgcttgcccaagtgaaggtgctgctagacggtcctgctgaaaacttaaccgccgctctcaagcaacaacgcaaacgcatcactgcgaaacgcgatcaactaagcttactgctcactacccttgatcaaactttagaaaaaggagtcgatacaatgactgatgacgaaaaatttgccgcttttaaagatcaatccatcaaagcaaacgaacaacaatatggtgaagaaatccggcaacaatatggagatgatattgtcgaagccagcaacaaaaagttccgcgatatgtcacaggcgcaggtcgcccaactaaccgccctacaacaggaaattttagatgccttaaagccgttagttggcaccaccgatttcaataccccggaggcaaaacgcgtcttcaaattgcacaagcaatttctacaaatgacctggccttctgaacaatattcacaaaaagctcatcgcggtttagctgctatgtatgtttccgatccacgttttagcaagtattacgaagacggcaccggcaaagccggagcggctgaaacgttaaatgcgattgtgcggcactatacgcggtaatcacaatgatgttctgccttacctgattgattcgtcaaaaagcaccaaagcgtttgtgttacatgctttgatgcttttttctttggcttagatttaggatgattcttttttacgtactatataaatattccatacgactaatatcacaatgatcatgaccaccgccactgcgaagataacacgtcccatttttgtgtagacgacaacccctgcatacgccaatcgctgaagtatcacgccaattcccataaccaccgttaccaaagcgattaagcgaaactctgacggcattttaacccaaaaatacaatgcaccaagaattgtgataagaacaattagccccacatcccatggatataaaattttgataccaaattgacttggtatttcctctagccaaatccaagcagcggcgtcacctgcaaacaccaacgccattaaaacaccagccgagaatcgcttccaagatcgatgagttgtcgacacggtgtagaaattgactatccacaaaattagtgctaaacagattccctcaataaaggcaactcccaaatacttccaggggttcagaatcatggcttgatcatcgcgcccattaccgccactcaagaagagatatagccaagaaatgccgacaacaatcccgattagttcaaggcgctcccgcaaactaatcttcggcatttgcgtgagcatctcatcggccattttcttgggctttttcccaaaaaaatttgacgctgagatgccatcttttgaagcatccaccagatcctgtgccattgtataaagtgatttttgaattgccagctcatcgcgtgaaaaggcctttttagtgactaaatataattgtaaatcttcaaagtattgttgatcattttttgacaaggactgtattaattgatttgtttgatcacgataccactgcgaactgtgttcactcatcagcgtcatcccctttatgtaaaactgtagccacctgctcaaccaactgctgccattgtcgctcaaaggcagcaaggcttgttctaccttgctcagtgacatgatagtattttcggtctgggccctcaggcgaaggacgcatgcgactggctagatcaccatttttttcaagctttgctagcaaaggatagattgtaccacccataaccgaattgaatccagcctgctgtaacgcttgaatcaactcgtagccatatatctctcctttagccacagtggcaagaacacatccttccaggacacctttcaataactggctttgcttcaatttgcacctcgcataactaggttgttttactaactagatagtagcatgtgttcactatgttgtaaagctatctagcaaaagcaaaaaagccaacgccgcagcgtcagcctctaataataaacttccttcaagtacagccctgatgctggtgcggtgccgcgtgcttgttgacgatctttgactgcaaacaaacgctgaaagtcgtgaacatcacgccgcccattaccaatttcaagcgctgtcgcaacgagaatccgaaccatgttgtaaagaaaaccattgccatagaattcaaaaataatttcgtttgtcactgaatcttctcgaacagttgcctcataaatcgtccgaactttatcgacaatcacgccgccactggccgcaaagcttgtaaagtcgtgtgtgccgactaggtccttcaatgccacttcaattcgttgcacatcaagtttgtaaggataatgaccagtatataggcggttaaacggatttgtatagtaaccacgagccactcggtacaaataccgtttgcctttagcggaatagcgggcatgaaaatcggcatcaacgatttcagctttaagaatttcgatgtctaatggcatcaacgaattcatcgctttcagcatcgactcagccggaatatttcccgggtaatcaaaactgatcacctgacctaaagcgtgaacaccagaatccgttcggcctgaaccatcgacatgcactggctgccccttcgtcattttggttaaagctttttgcagcacaccttggactgtgcgctgttttggttgaacctgatagccagcaaagttggtgccatcataggccagtgttaccttgtaatgcgtcatgatgtcccttctattaagcacgcaacaacagcaatagaccggttaaaacaagcatcccgcctgctgcaacccagtcgcgccgatgatagcgtaggatacggtacttcgttcggtcatcgccgccttggtagccacgcgcttccatagcagtagccaattcatcggcagtcgtaaagcttgagacaaatagtggaattagcaacggtacaacagccttcatctgctggaaaatgttaccttcaccgaaatcaacaccacgggcacgctgcgcattcatgattttggtcgtttgatccatcagcgtgggtacgaaacgcaaggcaatctgcaaaaccaaagccagctcggttactggtacgcgaatgacccgcagtggcttcaacagactttccaccgcatcagctagcgacagcggctgagtactcaaggtgagcaaagtggacatgaaaatgatcaacacaaaccggacaaagataaaggctccgtttatcagaccaaattcagtaatccataaccagccccaatgccagtaaaccgtaccaccacgaacgaatagcacctgcagcacaaccgtaaacagaatcagccaaatcagtgggcgaacccccttaaggaagaagccgattttgatacccgataaccaaatcatgaacagtgtcgctacaaacatcattaggtatgtctgccaattattggctaaaaagacaattccaatatagtagaagctggcgataagtttggttcgcggatctaatcgatgaacccacgagtcgccgggaatatagcggcctagcagtaatttatccacgctggccacctccaatttgcggcaccaattgatctgccaactcgctttcagttagcggttgtggatcaaagtggaaccccttagctgctaattgttgcgccagttgcgccgtctttggcagccctagctgattcgcttttaaccaagctgggtcagcaaagatctctcgcggtgttccggttttgattaacttgccttctgccatgacccaaactgtatccgcatagtctgccacatcatccatttgatgtgtcaccaacacgatcgtttgtccttgctcgcggtgcaactgttcaaacatttgcatcatctcatggcgtcctgaagggtccaggcccgccgttggctcgtccagtactaacacctccggctgcatcgccaacacgcctgcaatcgcaacacgacgcatctgaccaccagatagatcaaacggcgacttttccaacacatcatgcggtaagccaaccattttgaccattttatcggccaaggctaaggcatctttttcgctaaccccaaaattttgggggccaaaagcgatatccttagcgactgtttgttcaaacaactgattttccgcaaattggaaaaccatcccgactttttgccgtagcggcttgaggttcttattgttagtttcattggtaatgaccttgtcgccaatcgtcaccgtgccggaagttggtttcaacaacgcgttcagatgttgaagaatggttgatttgccagaaccggtgtgaccgataattgccgtatagctgccgtctcgaataaccccgctcacatctttaatgccatcaccagcgaaaggcgtacctgcctgataggtaaagctcacatggtcgaatgtaatgtccacaggtagtctaccaacctttcattgtccatatagtctttcggcatcgcaatgccgcgctgggccaaagcatctttcagcttctccgagtatgggacgtccaatcccagtcgtaataattccatcccatgcgaaaagatctcgcttggggtgccaatctcattaattttgccatcattcaagagaataatccggtgcgcttccgccgcttcgtcaatatcatgtgtaattgaaagaaccgtcaacccaagttcgtctttcaattcccgaataacacccaacacttcttgccgaccagctgggtccagcattgatgtggattcatctaaaataataatttccggacgctgagccacgatgccagcgatggcaacccgctgtttttgaccgccagacaaccgtgccggttcccgatcggcaaaagccgtcatgccaacacgatccaaggcctcgtcaactcgcttaatcatttctggtcgcgggacgccacgattctctaagccaaaagcgacatcatctgcgactgtcgcaccgacaaactgattatcaggattctgaaaaacaatgccgactttggcgcgaatatcccaaacggtttcttcactcaacgtcatgcctgctacctgcacagtaccggattccggtgccagcaaaccatttagatttttggcaagggtactcttcccactgccgttgtgcccaatgatcgccagccactcacccttggccacatcaaatgaaacatccgtcagtgcttgctgtttggcttcaggataagtgtaattcaaatgttgaacacgaatgacgttgcccacgatgccccttcttcctacgctttgtataccggataatgataccatattttgcttagccgatgggagttaggctcccctcgtcttgcagttactcggcaatgtcagcatgtgtgaaaatcgtacacacatgaaaaccaagtttgttagaaactttttttaacgatgtcgagcttggtacttagaagtgcaaaaaaagtgcttaatatcaaaccacctattaataacatccaagcttgtacacgcatcggagtcgcattcaacatcaccatgccaaattgactgttaccattcacgatcaattgattagtgtgcattgtcatcagcaaaagcacaaggaaaatgactgttaaataccgagaaccgttcacaaacagtcctgcatatgcggcgcagatcccgactggcataatgacaacaaaactaagcattgccagcagcagaaagccgtcaagtgagtgtggtttcgtcaaccaagacagtggataccattgagcaagaagcaaaatgatgacccagaaagtcgttagtggtataagtgttttgggcaatgcaggggttagtttttgcttgcgatattgtcgtcccgtcagataaccacttaacatcgatatgagccaagcatatgacagccattgcacagtaacgctgccgttagcaaggtgatccactcccggcatcaataaaccacctgtgctgccatttggtggtgttaacaagaccaacaggagaacccaaacaatggcaatcagtgaccaaatgccgatgacatataatccaatctgccatggtgctctttgtttaagccaattgtgcatgttgttaacctccgttattttgcagtatacaggaaaaaccgccaattttggcggttttctgcgaggtttttcaggtttgctgtggttcatgctattgtaggaatgttctatccttgacaataccattgagcttctgcgcgttctataacgcgctcgccagcccagaaacctgcgtgtaaggactttggtcgcaatggccaaaacccagccatcacgaccaaagccacttacactccggtttctacccgggctggctcgcgcttccacaaaaaaaatcatttaatgatggagacaaccggttgcccggtgctctcaagctagactaagcaggaactggccctgccatcatcgtaacgctccatcgatcaaatgatcaaagttggttgaccgcgtgggccatccattttcaactgtgtttagacgagctcaatgataaccattggtgcaccgtcaccgcgacgtggcgcagtcttcaagatgcgggtgtaaccgcccttgcgatctgcgtattttggtgccaagtcactgaacagcttttgcaaagcggacttcacaacaacactgttgtcatcttgttcctcgacactcgcgatttcattgcgaacgtaagctgctgcttggcgacgggcgtgcaaatcgccgcgtttgcccaaagtaatcatcttttcagcagttgaacgaacttctttagcgcgggcttcagtcgtgacgatccgttcattgatcaaaagatcagtggtcaggtcgcgcaacaatgccttacgttgtgagctggtccgccctaatttacggtaactcatggattggcctccttttcgaaattagtcttctttacgcaatcctaagccgagatctgccaacttgtttttaacttcttcaagtgacttacgacctaaattacgtactttcatcatatcggcttctgttttgttggttaactcctgaactgtgttgatcccagcacgcttcaagcagttgtaagaacgaacggacaagtcaagctcttcgatagtcatctcaagcatcttttccttgtgagtctcttctttttcaaccatgatttcagcgttcttggcttcatccgtcaaattgacgaagatgtccaagtgttctgtcaggatcttcgctgctaagctgatggcttctcgtggtgagattgagccattagtccatacatccagcgttaacttgtcgaaatcattccgacggccaacacgggtgctttcaacttgatagttaacccggctgatcggggtgaaaatcgagtcgatcggcaaaacaccgattggcatgtcatcagacttgttttggtcagctgccacatacccgcgaccctttttaacggtcatacgtacatggaagtgcccgccatctgcaacagtacagatatactgttcaggatttaagacctcaacatcaggatcagcgacgatatcagcagcagttaccttagccggaccgttgacatcaatttcgatgttcttgtcttcatcagtgttcattttgagtgccaattttttgatattcaaaatgatctgggtcacatcttccagcacaccgtcaatcgtggagaactcatgtagtaccccgtcgatttggatgctgctgatagctgccccaggcaatgaagaaagaaggatccgccgcaacgagttacctaaagtagtaccgtagccgcgttccaacggttcaaccacaaacttgccatagttggtgctttcgtcaactttggtaatgttcggcttttcgaattcgatcatctagtttgtacccctttcaaaacgagaagtgaagatttgtctgcctgaccgttaaagcggccgaagggtaacaattaaacacgacgacgctttggaggacgagaaccgttatgcggaaccggtgtaacatcacggatcgcagtaacttcaagaccagttgcctgaagtgaacggatcgcagcttcacggccagagcctgggcccttaaccgcaacttcaaccgacttcatgccatgttccattgattcctttgcagcagcttcagcagccatctgcgcagcaaaaggcgtcgacttacgactgcctttaaagccgagtgcaccagcagaggaccaagcgatcgcattgccgcgagggtccgtgatcattactaaggtgttgttgaatgttgagtggatatgagccacgccagattcaacgttcttgcggacacggcgcttccgcgtagtttttctacctgccatcgatcaatgacctcctttaattattttttcttacctgccatgcttgctttcttccctttacgggtgcgagcattgtttttggtgttttgcccacgaactggcaagccacgacgatgacggatgccgcgatatgaaccgatttccatcaatcgcttgatgttcaggtttacttcacgacgaaggtcaccttcaaccttaacggagtctaaggctgcacgaatcttgtcttcttgttctggggtcaggtcatcttgacgaacgttttccggaacaccggcattcttgaggaccttttgagcggttgtcttgccaacaccataaatataggttaaggcaatgacgatttgcttaccacgtggtaagtcgacacctgcgatacgagccatgtacaatgacacctcctattgaattagtttgtattatccctgacgttgcttatgctttgggtttgcagagcagataatcatgacccggcctttacgacggaccactttgcagtgctcgcacatctttttaacagatggacgtactttcatgagaatttagcctccttgagttggcaactacttgaaacggtaagtgattcggcctttggtcagatcatatggggagagctccaccgttaccttatctcctggtaaaatccggatatagtgcatgcgaattttaccggaaacatgggcgaggatctctgcgccgttttcaagtttgactttgaacatcgcgttgggtaaggtatccgtcacggtgccttggatctcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcaaccaaaatcgctttgatctcggcaaacaccttatcaatgtcctggtcgccattaaccgtgtgaagcaggcccttcttttcatagaagtccaacagcggtgtgttcatttcgatgtttaccttgagccgatttttaaccgttgccggtttgtcatcttcacgctggaagaattcatgaccgccgcaacgatcacaagtgccggcaacctttggcgggttgtagattttgtgataagtcgcgccgcatgtcttgcaaataaaacggccagacaaacgatcgactaattttgcaggtgcaacatcgatattgatgacagcatctaacggtttcttcagatcggctgtaatcgtttcgagtgcctctgcttgttggatggtgcgcgggaagccatcaagcatataaccagcatcggtatcagattcagcgagtcgttccttgacaatgccattcgtgaccgagtccggtacgagttgacccttatcaatgaaacctttcgcttctttacctaatgcggtaccagcagccatcgcagctcggaacatgtcaccggttgaaatatgtgcaatcggataagtgtcttcgatccgttctgcttgagtacctttccctgcaccgggaagtcccattaaaatgagattcacgttgcatcctcctctaaacgcgctcgccagactagaacctgacgtataaacgctcttaaacacaataaccgaacccggtcatcatactcagattcgcttacacattggactctaatcaagctgactcacgttctgtttaaatgacgtttattttttactgtcgcctttaatcaagtctccgcgaatgaaaccgatatactcgcgtttcatgagtaagccgtctaactgacgaaccaattcaatcgctgtcatgacgacaatcaagagacttgtgccgcccagtccgattgactgtggcaagccccaaatgttggcagctaactgtggcagcaatgcaaccaggccaaggaacaatgccccgacggttgataatcgcatcagtaaacgcgagatataattctcggtttcttttcctggccaaacgcctggaatgtaactgccttgtttggttaagttctcagagaccttttcgggattgacctgaacaaacgcatagaagaacgtgaaaagaatgattagaagcgtgtagatcgcagtcccggcaggtttttgcatattgaagatgttggtcatgacttgataccagccatcaccgctatgattcttttgaaaagccatcagaattgtttgcggagttacgatgaaggaactcgcaaagataactggaataacgccggccacgttgacctttaaaggcaagtagctgttgctgcctgcgctggtgacacgccgggtatattgaatcggaatcttgtaattcgcttgctgtacccatgtgacaaacgtgatcactaggatcacgataatggctaaggctgccatgaaggcaatccctttccagatttcggcaccagagtatacctgaacgttatcgcggtatagctcttgaaggccagaaggcaagcgagcaatgatcccggaaaagatcagcaaggaaaccccattaccaagacctttatcagtgatctgttcacccatccaagtcagcaacatggtgccgccggttaagatgatcccgatcgtgatataggtgctaacagacggatttttgaccaagcccatcgaacttaacgtttgaaagccggccgtaatcccgattgcctgaaagaacccgaagataatggttaagtaacgagtcacctgattcagcttacgccgaccaacttccccttgcttgctccattcaacaaacttcggaacgatatccatctgcagcagctgaaccacaatctgtgccgtaatgtacggtgagacccccatcgagaagatggagtactgggccagtccgccaccactgacagtatccagcagtgagatcaggcctgtcgaaccgattgattgcagcgcctttgcattgaccccgggcactgcgatcagtgtacctaatcgatagaccaataaaaccgctaaagtgaagaggatcttgttacggatgtctttaaccttgagcgcgtttttcagggtcctcagcattagatcacctcaatcgaaccgccagctgcttcaacagcagccttcgctgcagcagaagcctttgctaccttaatggtcagttttttctcaagcttgccgtctgccagcagcttgacgccgttcttttcgttcttaacgataccagcatcgatcaaggctgctggggttacttcggcgccatcatcgaagcggttaagatcggaaaggttaacaacagcatattctttgcggttaatgttgttgaaaccgcgttttggcatacgccggaacaatggcatctggccaccttcgaagccaagacgcgttttgccgccctgacgtgccaattgaccctttgtccctttaccagctgtcttaccttgaccgctagaagtaccacggcccagacgcttgcgggaatgacgggagccgacactcggctttaattcgtgcaattgcatactcttgggcacctccttgtcgaaataatgttattaatccttgatttcttcaacggaaaccaagtgtgaaatctggaaaatcgcaccacgagtggctgcgttgtcaggcttgatcactgagctatttactcgagctaagcctaattccttcacaattttacgttgcttaggaagacggtgggcagcactacgggtcaaagtaatcttcaattgagccatgtgtttacctcctagtcttctaatgatgacgcagaaacgccacgcaattcagcaacttgttcacgggtacgcagttgtgtcaacccgtccatcgttgcccggatcatgttgatcggggtgttacggccgagtgacttgctggtaatatcagcaatgccggcaagttccatgacggaacggatagcgccaccagcagcaaccccagaaccttcttcagcaggcttcagcaaaacttcgccggcgccaaaatggccgataacttcatgaggaatcgttgtgccgacaatcggtacttcgatcaagctcttcttggccgcgtcaacagctttacggatcgcttcaggaacttcttgggccttaccagttgcaaagccgacgtgaccattcttatcaccgacgatcgcgatcgcagcaaaacgcagacgacgtccacctttaacaactttcgtgacacggttgatggaaacgacttggtcttctaagtccaattggtttggatcgataaatgatgccatgtgttggttatcctccttttttctagaattcgaggccattttcacgtgctgcttcagctaacgcagcaacgcgaccatggtacagataaccaccacggtcaaagaccacaactttatgaccatcagcaacagcacgcttggcgatcaacgcgccaacttgtgcagaagcagcagtcttgttttcaggatctttaatgtccttatcaagagtggaggcacttgctagcgtcacacccgctacgtcatcaattaattgtgcgtagatgtttttattcgaacggaaaatgttcaagcgtgggcgctcgctcgtaccagaaatcttgcctcgtacgcgggcgtgacgccgttgccgagtcttgttcttatctggcttagaaatcacaatgttcacctcttgttaaatttgttgaaggttaagactacttaccagtcttaccttccttacgacggacatgttcgtcaacgtaacgaatccccttacccttataaggttcaggtgcacggacggaacgaacaacggctgcaaactggccaacaacctgtttcgagatcccgctgatgatgatctgagtggtgcttggaacttcaacagtgacacccttaggcgcggtcatttcaactggatgggaatagccaacgttcaaaacaagcttttcgccttgtttttgtgcacgatagccgacaccgaccaacttcatttctttcttgtagccttcggtaaccccgacgaccatgttgttcaagttggcccgcattgttccgtggacagccttgtaggaatcatcaggacgcgtgaagttgatctcgtcgccttcctggtgcatttcgatttccggggcaaaatgacgggtcaattcgcctttcgggcccttaaccgtaatgttgtcgccatcttttgtgatggtgacaccggctgggactttaatgactttataaccaatacgactcacttatcggcacctcctttttgatatattgaattaccaaacgtaggcgagtacttcgccgccgacgttcttggcacgagcttccttgtcggtgataacaccttcggaagttgagatgatagcaatccctaagccgtttaagaccttaggaacagcatcacttttaacgtatgagcgcagacccggtttggaaatccgcttcaagccagagataacccgttcattattcttaccatacttcaagaaaatgcggataacgccttgcttgtcatcatcaataacttcatagtcacggatgaacccttcacgtttcagaatctcagaaatgtcttttttcatcttagatgcaggtacgaccaaggattcgtgacgcaccatgttggcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgataaacggaatgtggacggccacaacgttggcaccgcgtatattcctggactgcaaattttgcaggccgattgttcttagcgatcattgacttcttagccaagtagcggacctcccttatttggcgaatggcatcccgacttgcgtcagcaattcgagagcttcttcatcagtatttgccgttgtaacgatgacaacatccaacccacgaacacgattaaccttatcgtaatcgatttctgggaagatcagttgttctttaacacccaaggtatagttcccgcgaccatcgaaggacttgggggaaataccatggaagtcacgcacacgcggcagggagacattgatcagcttatccaagaaatcatacatgcgttcgccgcgcagggtaacctttgcgccgattggcatgccttcacgcagacggaagccagcgatactcttcttagccttggtgatcagtggatgttgaccagagatcagggtcagttcgtcaactgcctcatccagcaatttggcgttctgagtcgcatcaccaacacccatgttcaaaacgatcttttcgatcttcggtgcctgcatggtgctcttgtagttaaacttgcttaccaatgcaggagcgatttctttgctataacgttcttcaagacgattctccatgaaaaagtttgtcctccttccctattatttatcgattgcggtgccagacttcttagcaatccgcactttgttgccatctttaacttcagaaccgatccgtgtcggcttattggtatctggatcaagaagcatcacattggacacgtgaataggtgcttccttatcgataataccgccttgcggattagcattgttaggcttttggtgcttcttgatcatgttaataccttcaacgacaactttaccagcgtccttcaagactttagtgatctggccttctttgccggcatctttgccgcgcatgacccgcactttgtcaccagttttgaacttcatgtatcgcacctcctatttggtcagaatgattaaagtacttcgggcgctaaggagacgatcttcatgaaatcgccgtcacgcaattcacgtgccacaggtccaaagatacgagtcccacgagggctcttgtcggcgttaatgataactgctgcgttctcatcgaacttgatgtaagaaccgtcagcgcgacgggcgccagacttggtccgtacgatgacagccttgacaacatcagccttcttgacaacgccacctggtgttgcttgttttacagttgcgacaacgacatcaccgatgttaccagtcttacggtatgaaccgccaagtactttaatcaccaggatttcgcgcgcgccggaattatccgccactttaaggcgactttcttgttgtatcacggaatggtcctcctttcatccgaaaaattgattagatgataactgccttttcgacaatgttcaataaacggaaacgcttattgcgtgataaaggacgtgtttctgcgatccgcacgatatcgccagttttagcggtattgtcttcatcatgcacgtaatacttcttggagtacttcatacgcttgccgtaaacagggtgcatcttgaccgtgctgacttccacggtgatcgtcttgtccattttatctgagaccacgcggccttgataaaccttacgagaattacgttctgccaaggtaaatgtctcctttccgattatttattgagtgcctgttgccgaaggaccgttttgatccgtgcaatgtttttccgaacctgactcaagcgagcggtgttttccaattggccagtcgcctgttggaagcgcaagttgaacagctcttctttatattgcttctctttgtcgagcatctcagcagtggttaatgcagtaatttctttagccttcatttgattgcccacctacttcctcgcgtgaaacgatcttggtacggatcgggagtttgttggatgccaaacgcaaagcttcctttgcgactgcttcggaaacgccaccgacttcaaacatgatcttttcacgtttaacgacagcaacccatccagttggtgcacctttaccattacccatccggacgccaacacctttactggtgtaggacttatgagggaaaatgcggatccatactttcccaccacgcttcatataacgggtcattgcgacacgagcagcttcgatctgacggttggtgatccagtgggattccaatgcttccaaaccatattcaccgaagtcgacgttacggccgcctttagctgcaccgcgcatcttcccacggaattcgcgacgatgctttacacgcttaggtactaacattgattatttccctcctttcacactattttgctttggcttttcaggtaaaatctcaccacgattgatccaggttttgatcccgatacggccataagttgttgcggcttcttcccatgcgtagtcgatatcggcacgcaaggtatgcaatggtactaagccttcattgtaatgttcgcgacgtgcaatatccgcaccattcaaacgaccggaagcttgggttttgatccccttggcacctgctcgcatggtccgttgcattgcttgacgcattgcacgacggaaagcgatccgttgttcaagctgacgggcgatgttttcgccaacaagcttggcatccagatcaggtttcttaatttccacgatgttgatgtgaacttggcggccagtcagcttgttcagctgcttacgcaagttttcaacttcagaaccgcctttaccgataaccatacccggcttagcagtatgaatggaaatgttgacgcgctttgcggcacgttcgatttcgatacgtgatacggaagcatcttgcagcttcttgttaatgaagtttcggatttcaatgtcttcatgcagaaaggctgcaaagtctttgtctgcataccatttggcatcccagtcacggatgacaccgacacggaaaccggttggattaatcttttgacccacgcgttatccctccttatgcttctttttcggatacaaccacggtaacgtggcttgtccgtttgttgattggtgatgcgctccccttggcacgaggacggaaccgcttgagggtcgggccttcgttgacgtaagccttgcttacataaaggttttgtgcatctaagtcatagttatgttctgcattagcgatggcagacttgagtaccttctcgatgatcggtgaaccggatcgaggggtgaattctaagattgccaatgcttcagcaacatcgcgaccgcgaatcaagtcgattaccaggcgcgctttgcgagcagcaatccgaactgtcttggccgttgccgttgcagacgtaatttgatcagccatgaatgttgtgctcctttctagcgtgctgttgtcttcttgtcgtcggtgttatgaccgcggaaggtacgcgtaggaacgaattcgcccaacttgtgaccaaccatgtcttcactcacgaaaactgggacatgcttacgaccatcatatacggcgatggtgtagccaatgaaacttggaaaaatggtggaacgacgggaccatgtacgaataacggtcttcttgtcgttatctgcctgcgcttcaatcttcttcaggagatgagcgtcggcaaaaggtccttttttaagactgcgacccattttgtgacctcctttaatcgatgtaacacttcaatgtgtttacttcgctctgcggtgacgaacgatgaatttctcagacttagccttgtgatcccgggtcttcttacccaaggtcttcttgccccatggtgacattggagatggatggccaattggtgctttaccttcaccaccaccatgcgggtgatcgttagggttcataactgacccacgaactgtcggacggaagcccaaccagcgcttgcggccagctttaccaatactgatcagctcatgttgctcgttaccaacggcaccaattgtggcacggttttcagccaaaatcagacgaacttcgcctgaagctaacttaacggtaacgtacttatcattgtctttacccaacaattgggccgaaacaccagctgaacgtgctaattgcgcgcccttacctggcttcagttcgatgttatggatagttgtcccggctggaatattcttcaattgcaatgagttgccgactttgatatcgacatcttcaccagaataaaccttgtcgccaaccttgagacccttaggtgccaagatgtaagacttaaccccatcttcataatgcagcagtgcaatgtttgcggtccgatttggatcgtattcgattgctttaactgttgcagccatgccatccttattacgtttgaagtcgatcacacggtagaattgcttgtgaccgccgccacgatgacgcacggtgatgtgaccatgggcattacgtcctgcagtatgactttggctgaccagcaaagtcttttcaggctttgtcttggtgatttcagcaaaatcagacccggacatgttgcgccggccgttgcttgttggtttgtacttaataatcgccacgtgttttacctcctataacggatttttgttactttttatcgttatcttcgtcagcgaagatcttgatttctttggaatcggcgctcaaggcaatcaatgccttgcgacgacgacgcgtcatgccttcgtaacggccttgacgcttcttcttaccgcgaacgttcgcgatgttgacgttgacaaccttcacaccgaagatttcttcaacagccttgcgaacttgcggcttggttgcatgcagtgcaacttcgaatgtgtatttacggttatccatttcagccatcgattgctcggtgacgatcggacgtaaaatgatatcgcgtgcttccattatgcaagcacctcctcaatcttttggagcgcagattgggtcaagattaatttcttgtagtcaacaacgtccaaaacgttgataccctctgcaggaacaactttcacgttcggcaggttacgtgcggctttggcagcaacttcattgccgtcttccaacacaaccagtgccttgtcgctgaccttcaagccatccaagacagttgcaaaagcttttgtcttaggtgcatcgaagttcaaaccgtcaacaacgaccaagtcgctatcgagaaccttctgtgaaagtacggatttgattgccaaacgacgaaccttctttggcagcttgtatgcatagctgcgcggggtcggtccgaagacgatcccaccgccacgccattgcgggctgcggattgaaccttggcgggcacgaccagtacccttttggcgccaaggcttgcgaccgccgccagaaacagcagaacggtttttaacggcgtgagtaccttgacgaagggaagcgcgctgcatcacgactgcgtcaaacacgacgttttcatttggttcgactgcccagatggcatcattgagttcaactttgccgttttctgagccatcttgcttatataaagtaacgttagccattagttattgtcctcccttcgtattatttagctgctttaacagcagaacggatcgtaacaaaggacttgtttgcccctgggacattacctttgatcaacagaacattgtgctctgtgtcagcggcaacgacttgcaggttttgcatggtgcgggtgtggttacccatccgaccaggtaatttcttgcccttgaagaccttgttaatgatggccccaagtgaacctggacgacgatggtaacgagaaccgtgcgccataggaccgcgggattggccatccttcttaatgttaccttgataaccgtgacccttggaagtaccagtgacgtccacaatgtcgcctgctgcgaattcgtcagccttaacttcactgccgatttcataatcactaagcgctacatcgcggatttcgcgaacgaagcgcttaggggtcgtgtctgcctttttggcgtgaccgacgcttggcttattcgtcaagacttcacgcatatcgccgtagcccagctgtactgcttcgtaaccgtcagattcaacggtcttgacctgcattacaacgtttggagttacgtcgacaacagtaacgggtacgagttcgccgttatcggtgaagacctgcgtcatgccaacttttttgcctaagattcctttacgtgccatgggtacacctcctattttctaagaattataatttaatttcgatatcgacgccgcttggcaagtcgagcttcatcaaagcatcaactgtcttcggtgttgggttaacgatatcgatcagacgtttatgcgtccgcatttcgaattgttcacgtgaatccttgtacttatgcggggaacgtagaaccgtgtaaagtgtacgttccgttggcagagggatcgggcctgaaattgttgcgcctgtgcgctttgcagtttccacgatcttgtctgcggattgatcgagaatccggtgttcataagccttaagccggatccgaatcttttgttttgccattgtgtgacctccttcgtctattatcagttagtagactagctccgtgaaaattaccaacacgctgccgtggcaaagcggccgggcgtgtcgcaacctctcacatccgcgctactctggttcacctttggaaccaagtgcatagttgtccctttgagaaacagcactcttgatagtatacaaaatctcccccgccattacaaggttttctttcggtttacaaaaaatatgttagaagcaaacttattcctttgaacagctgcttgtgctaaattcaaattaaagccttaacttttgaataaccatagaaagaagggaggcagttgatgaaatttgaccattacaaaaagctcgtcaactcaactttagatattctactcggtttttcagccattgtcgtggtaatttttatgctacgctacattctcgatatcggtagtctgatccttcaaccactttcgactgctttgtttggcaaagtcattcaggaagttaccagcttcttcatgctctttgaatttgtgatcatgctggttcgctacattgaggaaggtcatcacattcctatccgctaccttattttaatttcaatgaccgccatcttacgccaactgctcgtgctgcatgaccgtgggactgaaaccctgcttttaaccttggccattttggtattagccggtgtactcacggtgttttcgtttgtcagtggcgatttcaaacagtcgcaggatggtaaaaacgttgatattgaccaacacttttaactttgttttttctcgtttcttctatattactttatacacgcaaaaaaggaaccgcagcgaaaatcattgcggttccttttttgcgtgcgtcgctgattagccaagcgctgatatattcactgttagctgatcaaagcaccgttttaaatcttgccaaccaagtctgcccctggtgtcagtgtcttagcgcccggttgccagttagctgggcaaacctgatcgccgtgagcagcaacgaattgcgccgcttgcaaagtccgtagaatctcatcggcattacggccaataccaaagttattgacggcataggcttgaatcacaccatcgggatcaatgataaaagtcccacggaaggcttgaccgctagcttcgtcacggacatccaacgccgttgccagtttacctgcaggatcggcaagcattgggtattgaatcttcttaatggtgggactcgcctcggcccatgccatatgtacaaactcggtatcctcagaagcagaatagacttcagctccaacagcttggaaccgctcatagtgatcttgcaagtcgccaagttctgtcgggcaaacgaaagaaaaatcggcagggtagaaacaaatcactgcccacttgcccttaagatcagtatcactgacttcatggaaatcgccatgttgataggcgttcaacttaaacgccggtaaatgttggccaatatagttcatgatattacctccatttttagaatgattattatttacatattcaccgtaccttttccttatgcaattatcaagcattgccaaaaaaattctgcctttttgtcggcagtcaactttggccacctttacctgtttaatgatgccgatctcctataataaggcatacgagaatatgtgttcacatcacgccgtcatcatgcgcttgccttcccagaaatcgggttggttcgcactcagcaaaaaaccgagtctgcattcattcgcaaacccggctgcacaactgctatcaatacttgccagtatcatcttcgttttgataattcttcaaacttttacgcaagacccaaaccacataatcacgaatatgtttgggagccaggacttttacgagatccccttgcccttggagccacatccggacgccaaaaccatcgttaaccggaatcgtaatgtgataaacctttcttgcgtatggattcttaataaacggacgatcacggacattttcccaatcaacaatggcctcgggaaagcgatcaaggacaaactgcggatcataactgtagagaatttccaaattaatcggtttgcctagatacggataccacgtgtgattctgtaagcgtcccccgcggaatcgctcatcatgatcatgggtcggctgctgacgatgataggtaatattgcgcatatagtcgagccgaaatcggacgaatttgccctcgtctggatcatcatccgcctgttcatcgctgccatcgacaataagatagaagaagagatcgccaaaaaacaagccggttggcagtcgccggtcaaagtgccgcatttcgccgtgatacacgtgatcaaagctgatcagttcgtgattaacgatagcttggctcaatcgggccaaccgattagtcaacgatattttggggacaccacgatactcaaaaactggatttttggtaagccgatccaatcctttgtgctcgggtccggctggtaataattgtgccattagttgcttcatttctacggacgacaagccacggctagccgtcagtatcaaggcaatcgccaacagttgcccgtcgtccagactgcggccagcggcgtgcaggtctggcttgagtcgataatccccagaacttgcagcaataaatggcgccggttcactgaacacatcgtcaaaggcacgtttgatgacgctaatatcgcggcgaatcgatgattcatccttattgaattccgtcatgagcgcttgcttattgagttgatcgcctcgcagcaagcgcaataaaatggtcgtaatacgctcctgactcgacacgctgcttcgccctctaacgcttatagaataacatcagtatactataatcttttcccaagcccagcaatcaggttcacgattttcatgcttatttccggattttgacttctggcgcacttttagaaaaaaacgacgatgcctaaaaggcatcgtcgttcatgcagctggtaacaatcaaagactagtctttggttgcgacgccgccgccatttttcttgatgatttctgcttgaatgctctttggaacagcttcgtagtggtcaaaggtcatggtaaacgtaccacggccttgggtagcactacgcagggtggttgcataaccgaacatttcggcaagcggcaccatggagttaaccaattgggcattcccgcgggcttccatcccttcaacgcgaccacgacgagccgtgatttgtcccataacatcgccaagatattcttcaggggcaaccacttcaacgtgcatgatcggttcaaggataaccgcgccggcactcttcgaggcattcttcaatgccatagaagcagccactttaaaggcagcttcagaagaatcgacttcatggtaagaaccatcataaagcttagccttaacgtcgattaatggataaccggcgaggacaccattggccatggcttccttcagaccttgctcaacagctgggatgtattcacgaggaacaacaccaccgacaatggcattttcaaattcaaagcctttgccttcttcgtttggactgaattcaatccaaacatcaccatactgacctttaccaccagactgacgaacgaacttaccttgcgcggaagtttctttagtgaaggtttcgcgataagcaacttgtggttcaccaaccttagcagcaaccttgaattcacgcttcagacgatcaaccatgatgtccaaatgcaattcgcccatgccggcgattaatgtttcgccagtttcagggttggtttcagctttgaatgttggatcttcttcagaaagcttttgtaagccgacatccagcttatcttggtcttctttagagtcaggttcgatggaaacttggataaccggatcaggcacatccagagattcaagaatcagcgggtggtcaacatcagtcaaggaatcaccagtagtggtgttcttgagaccgatagcagccgcgatatcaccagagaaaacttcagggatttcttcacggtgattactgtgcatttgcaacagacgaccaacacgttcgcggttatctttagttgcgttcagcacgtaagaaccggcttcaagcgtcccactataaacccggatgtaggttagacggccaacgaacgggtcagtcgcaaccttgaaggccaaggcagcaaacggcttgtcgtcgccagcggtcaattcaactgcatcgccagtgtcaggatcggtcgcatgatatggccgaacatcaagtggtgatggcaagtaatcaatcacagcatccaacaacatctgaacacccttgttcttgaaggcagaaccagccaaaactgggtagaattccaagttgatggttgctttacggatcgcagccttcaattcagcattggaaatctcttcaccttcaaggtacttgtccatgatgccgtcgtcaacgtcagcaacggcttcgatcaagtcgttatgcgctttttgagcagcttccttgtagtcatccggaacatctacagtgtcccacttggtacccaattcatcttcgtcatacaaatcggccttcatttcgatcaggtcaatgaccccttcgaacttatcctcggcaccgatcggcatctgaacggcgtgagcgttagcctgaagccgatcatgcaatgtcgtcatcgaataatcgaagtcggcaccgatcttatccattttgttgacgaaaaccaaccgcggaacgccgtatgtcgttgcttgacgccaaacgttttcggtctgcggctcaacaccggattgggcatccaaaacggtgatcgcaccatccagcacacgcagggaacgttcaacttcaatcgtgaagtccacgtgtcctggggtgtcaatgatattgacccggtgatccttccagaaagccgtagtagcagcactggtgatggtgatcccacgttcctgttcctgtggcatccagtccatctgtgaagctccttcatgagtttcaccgattttatgaattttaccggtataatacaaaatccgttcagtcgtggtcgttttaccggcatcgatgtgagccatgatcccgatattacgggtacggtctaacggaaattcacgtttgttggccatgtggcgtattgctcctctcttgtttcaactggctttatacaaagaatggctactatataccaagccgcggatataatagccaaatcatcttaccaacgataatgtgcaaatgctcggttggcatctgccatcttgtgggtatcttcacgcttcttcacagcggcaccggtgttgttagcggcgtccatgatttctttagccaagcgttcgtccatcgtatgttcaccgcgttgacgggaatactgaacgatccaccgtaggcccaaggtggtccgacgatccggacgaacttcgattggcacttggtagttagaaccaccgatacggcgagctttaacttccaagaccggcataacgtttttcattgcttcttcaaaaacgtccaatggttcgttcccggtttgtttcttaatcatatcaaatgcatcatataaaatagttgatgccttcccgcgcttaccatcaatcattaagtggttgatcaagcgagttaccagctttgaattgtaaactggatcaggtaaaacatcacgttttgcgacactgcctttacgtggcatgcactttgcctcctcttaaacgcgctcgctgacgcaaaaacctgcacataaggaccttggtcgcaatggtcaaaaaccgaccatcacgcctaagcccacttatgctccggtttctaccgcgccagctcacgctctgtctataccgcacatagcggatctaaaaatttttaatagcgatctttaatgttgatcgtgaattacttcttcttagggcgctttgcaccgtacttggagcgaccctgcatccggccgtcaacaccagccgtatcaagcgcaccacgaacaatgtgataacgaacccctggcaagtccttaacacggccgccacggatcaagacaacactatgttcttgcaagttatggccaatacccggaatgtaagctgtcacttcaattaagttagacagacgaacacgggcatatttccgcaatgcggagtttggcttcttcggtgtcatggtaccgacacgagttgccaccccacgtttttgcggtgctgggttattggtaaggctcttcttcttgctgttgtaaccgaagttcaacgcaggagagtctgacttggttgaaattgatttacgaccttggcgaactaattgattaatagtaggcattaagcttctccttccttaatttacatcattttataagtccacacatccaggcggttcattttttctgataaaaaaatggccaaccgaacggcaacggctcttaacccagtcagcacgtccgggcaacccgaataaactggaaaaaagcacctttgatagtgtactatcctttgcggctgagtgtcaagagaaaaagaaagggcggggtgactcgcgcgacaaattcaaagatttgtattagttctatttgagtcgcgtgttctcgattgtccgagttggctacgcggcgaggagggctggcgaccgcgaagctagagctgtgggcacagctttgaactcgcgcaaagcccgcacgatttcaaaagtctggccttgttctaaaacgggaaaaccacccgtttaagaacaatatcacggctgagccccctcaccgctccgccagctctcatggctctattcttgaattcataccttttaagattagcatccccccaatcaaagaagtggtgagccgttctcaaatagcagattcaccggttgtaactaagttgttactttttcaataaacacagtttatcaaccgctttaatcggccccgaacgcgccatacccctaaccataacaaaatagctccgcaaagcaagtctccggctagaagactcacctcgcggaactattgtaacgtgatgccgttcagtctcgaacagctcgtgtcaattgattatgatcgcttacgccgccgcaggatcacggtgctgccggcgatgacgagaatcacgatgcctaaaaggacaagggtaatcgcatctcgatcaccaaagctgccgaagagtaagcggcgtgacggttggtcatggcgcacatcgttaccattgttcccaccttctgtacttggcagaacatggcgctggtcggcgattgtcatgcggattgtatcaccgctcttaatatcaactgcgaccggctttgcgtagtccggattaatcgtgtacccagccggcgctttgacctcggtcagccagtaacgacccagtttcaggttatcaaaggtgaccagcccattgacatcagtcgtgaattccttgctataaccgttgtcatttgtcagtcggaaaacggcacctgctaagacttgattgctatcagcagcatccaccttcttgatgacgagtgaattgatctgatagttggcaacctgtacagtaaccggctgctgcttattctggcttgctagcgcgctcacggtttgcgtcaggtcggtttgttctactttaaagtcgatcttgtcggtattcagttcatatttcggcaaggtcttggtttcttcaaagtagtagtcgccgattggcaagttaaacggcaggttgatctgcccggcttcatccgtgacaagatccttggcaaggacattgccattgctaccatataagtcaaaggtaatgccggccaaatgattgccaaaattaccatccgtcttttgcagctgaatggcgcgtctaaattcgggttcgataatcggatcaagagcaactttttggtcgcccttgacgttcacatcaatccccttggccagatcatctgggataacgtagccgcgtggtgcctgcgtttcaaccagcaaatacttaccttcataaagatcatgatcattgaaggtcacaatgccattctggttggtgatcgttgttgtccatgcgtgactgtgatcaaccgtgccgtcttcgcgataacgatacatcgcaaattgggcgccaatcatggtcattttgcccgggaagcgatcatcggttgtggtgtccgccttcttcgtcacaatgatttggccagccttcttctggttagttgcggtcagcttcagctgggtttgatcagtcttgatggtgaaatcgacactaccagcggccaaactatcttcccatcgttgcttctggacgccgcttgtcgcgttagcttgatcagcagcatccccttcataatgctcaggggcttgggtttcgactaggcgatacgaatcgtccggtttcaacccttcgatcgcgtattcgccattcttgagtgaggtgtcaaagctgcttgctgcgccaaaggtcaattgcccttcagtgttggtcttcatgtcggccttcaacgtttttttggttacggcatccacaagcttatacgtcgctcccggcaacagatactgcttgcgtgttgccgcatcatcggtcttcttaacccagttatcgtacttagttaaggtgacttgataaggatcgtcggcaatttgcttgtcgatggtgattggggtcggcgtgatcgctgaggataaggtgatcgcatgaacggtcttgtccaaccgatacccagctggcgccctcacttctgtcaacgaatagctgccgagtaggagatcgccgaatgaggccagcccgttttcgtcagtggtgatgtcacgactgtagccggcactgttggtcagccggaaaacggcacccggcagcacatgagccgcgaacgtgcgatcaacttttttgacattcagggttttgacttgatagttggtgacgttgacgcgaatcggttgttgcttattttcagttgctaaactgctggccgtttgcgtttgatcagtctgcttgacttcaaaagcatgtttgtccgtatttggccgatatggcggcaaggtcttcgtttcctgaatataataatgaccaactggcagactaaacgggacattgacttggccatttttgtctgtcaccaaatccttggctaactcagtgccgtcttcgcgatacaacgcgtacgtaatgccagcaattggattaccaaagttaccatcggtcttcgccacacttaccgtccgacggtaaaccggttcggtgatggttggcagcgttaaggtttgatcgccagtgatatcaacgtcaacgcccttggccagttcatctggaatgacatagccatcaggagctttggtttcaaccaactggtatttgccttcatataaatctgaatccttaaaggagacggtgccgtcattgttagtgatggtagcgtcccatgaccggctgcgatcaactttgccagcttcgtcataacgataaagcttaaattcagcgccagtcattggttgacgatcagggaagtgatcatccttgatggtttcagcttgtttcttaagatccagctgacccggtttcttttggttcgttgcggtcagcttcacttgcgtctgatcagccttgatattgaaatcaacactgccagccgctaagctgtcttcccacgcctgtttctgggtgccgcttgtcgcgttggcttggtcagcagcatccccttcataatgttcaggtgcttccgtttcgaccagccgatatgaggtatccggcttcaacccttcgattgcgtattcgccatccttgagcggcgagtcaaaactgcttgccgcaccaaaggtcagttgaccatcagcattggtcttcatgtcagcctttaaggtcttgttagccgccacgtcgacaagtttgtatactgcgtttggtaacagatacttcttttgactcgccggatcatccttcttgacgcgattatcatacttcgtcagattgacctgataaggatcgtcagcaatctccttattaaccgtaatcgctgtcggcgtttcggcagatgacaacgcaattggataaacggtgttgtccaaccgataccctgctggtgccttgatttcagtcagcgagtaactgcccaacagcaagtcgccaaatgaggcaatcccattttcatctgtcgtcacgtcgcgagtgtaaccagcactattcgtcagccggaagacagcccctggcaacacatgagttgcgtaagtgcgatcaacctttttgacgttcagggttttggcttgataattggtcacattgactttaatcggatgctctttgttttcggtctccaggttgcctgccgtctgggtttgatctgtctgcttcacttcaaacggatgcttatcgctgtttggccgatatggtggtaaactcttggtttcctgaatatagtacttgccggccggtaaattaaatggcaagttgacctgtccattttcatctgtgactaagtccttggcgatctcagtcccatcgttttgatacaacgcgtacgtgatgccggcaattgggttgccgaagttgccatccgtcttagccacttgcaaggcgcgtcggtaaactggctccgtgatcgtcggcagcttcagcgtctcgtcaccagtgatattaacgtcaacacctttggcaaggtcatcggggatgacataaccttcaggcgctttggtttcgactaactgatacttaccttcatacaaatcaggtgaatcgaagataaaggtaccatcttggctaatgatcgttgcgtcccaagatttgctttgatcaaccttgccgtcatcgccgtaacgataaagcttaaattcggcgccggtcattggctggcgatcagggaacttgtcgtcagtgatcgtttctgcctgcttcttgatatccagttgaccaggtttcttctggttatacgccgtcactgtagcggacggcgccttgttagaaatgatcgccgccacgctgccggctttcagactatcttcccaaacctgcttgtcgggtccgctggtaatcgtcgcttgatcatgcgcatccccgcgataatgatctggggcttgcgtttcaaccagcttgtaattgcctggcttcaagtcttcaaggacgtattcgccatctttcaagtcaaggggtgaacttgtcgccagcatactgacctgaaaagctgctagccgttccaatggtgattttgccgtcagcattggtcttcatgcccgacttcaatgttttctgcgtatcggtatccactaagtcataagtggcgccgggaagcagatagtgtttgttatctgtttctgattggcccttagcgcggttgtcatacttcgacagcgtgatctgataaggctcgttttcaaccgcctccgtttgaatcgccgtgcctgtgtcggaagttgcgttcaaacgaatggtctttggtgccaatggcttatacccagctggcgtactgagttccgtcaacgtatagtcaatcccaattggcagtccttggaaagttgccagtgccttattcgtggccgaatcaagttttgtggtggcttcaaatgtatgggtgccgtcacttaagcggaacttaacgcccggaattggcgtgccactgacgctatccttcttttcaaccactaagttggctaattgcgtgagggtctcgccgctgataccggaaccccaataaggcaagtacccatttgcgtttgcaattcgcgcatcaggagggacaccatcacttggcttttgagtcgtttggctgccatcccattcaacgctactcgaattgtatgcccatcctgaactcttgctacttgttgagtatgcaacgctcacttcgtaattattgagcggactattggccgtttggacgagattgccaaaagttcgattaaaagtaattgtaaacttcttgccatctagagaaaggctgtaatccttcccttcttcaagcgtatccgggtcagctataccaacctttagtgtcaccacaaaactggtagcattgatttctgctccagtacctcttggatccaaagtatcctcaatgactggattcaccattggtcgatacttgtcttggatattgatcaaattcactttccaattcaagacattttttagtttagtatcagcactaacagttttgctgatcggcgtccaataactttgtgccgactttgaggctgacgggttgaaagtaggaattgccgtggtcggttcggtatctgtcacagtcgcattgttggcgaagttaggatcgttatagttccactggttagcgcgcatcgtcttgaaaacaacccaaacacgccccgtaccgatatttggaaaatcaaaatccaattgttgtgctaagtttggattgttcttgagccacgtatttggcgtgttggttggtaacagacgttgctgtgctgcatcctcagctttaagtgctgttgatgaccagccaccggttccataatatggactcgtcttgatttctttcacatcgttagaagaagctggatcacctgtgttcgatggatcaactccgtctggtcccgtgacttcatagaatttaatcgaatcaggaatcaactcgtaattaacgccatcaaaccgcggcaaaatatcggtcaggtgcatgtggccatatggaagccccaattggttaaccaagacaccccaatactgggtatcaggcgcgtcactccaagaattcttcaaggctccgctaaaggccccttcttctggtgttggtgtactactactatcaccgctggcaacgtcatcatcacctggtggcaagtcaaagaagaaaaacgcgcgattatttaaagcctttttcaaagcgtctgggtcgtgaccgacttggcctagcttcaacatgtccagcttagtatgcgtataaatcacaatttgcgaatctgtttctgcatacgcccctttgagcgtgacgacaaagccgcgaatgcctttttcctgaccattcgcattaatcggatttgtcttatccttgtcgttatattgcttaactgcagattgaacgtcagcgtcttgggtactcatatcgtaatcagtccccggcttcagcaacgttcttgcgccgtccggattctgagcgtagacaagaataccgtcattagcgccgtcgtcaacatttgctgagacattttcaccggagatggtgttgatgttatcggccgttggatcgttgtccagcttatcgaccccatccgggaaaaggtcgaagattttaccattcttcatgttccggaaaacgcggttggcattgatccgccacgtcatttgaccattgtaggcatcaatcttgccgcctacttttgtaatcccgcttggcagcctaactggataggtcgcatgatcgtaatgattcttctgatcattcacaatattggttaagttgtcgccatttttcggtgtgttcttcagtttcgtttgatattgaatctggaaagaagcattttccgggagatcgccgccgccaagataagttagtgtgaactcgccgtcgcctttttcagtgagcttaaagtactgcgcgatgtcgactttggaaacaatcggcgttgcccactcgtcaaacgtgacttgaaagaccttcagggacttcgtgtctaaggtttgattgccatctgtctcgatgttgggttgatcatgctcatctttcccgctggtttgcttaccaaagcgatccgttagcgtggcgccagccttcatggtatccatgctgtaattccaattaattttccagttaagtgctcggaagttattggtaatatcgccagatttggtgatcgctacaccggagttgcgcatggtgacactatcatagtcataaccgtcagacgactgtgaaccagttaagtaacgatagccttcaactaaggcactgcccactttcccggtatcgtctaaagatcggtcaatcgtggccgtataatctacctgatacccagttgtttttttaaagccgcctgtcagataaattttaaccgttcgtttgtcatccgataaaacagcatgaaaatcttggccggcgactaacggcttaagttcttcagaaaagccgccgagaatattgactggtgccgacgagaccttgatcttcgccagatcgctatcgctaaaggtcagcgatttgagataatctgtcccgctgcctcgtgccgtcagtgtcaatgccatgtcagcgttctttgatcgtttagccggatcactgtcccactttgtcggatcggttttgctggtttcgttcccgttcaaattaaacttcgcggtcccagcaatgccagtcggattcaagctttgtggtgtcgtcgtatgcgcatacaccaccaccggcttggcattcgacctaaacgtgattggaaactttgtgtcctgatcttttgtatggaaaaccagtgtctgattgagtgaatcattagcagttaaagccttaaagcttgctgcaatatgcactaaccaagaaccattactcgtggctttcaaaagtttgatcgtcagctgtcctgtggttgcgtcaaaatagtacgaggcgacatcaccggaaaagttgccgccgccgctttcaggaaaagcaatctgatcctttggcaaggtcgttgtaaaggatgcccctgccggaaacggggtgctcgttgccggtaatgtaaaggtcatctccatcttcacagcactttgctgatcgacttccgttcccaaaggctgatcattgccgtccttcagcgccaccttcgtgaaaatattgggcagctcagtatcggcctttgcgtccggtgtcgcgcttggttcagcttctggcgtcttcgctgccgctggttttgcggctgtgctactgctactgccgctatcaagtgtggctgatgcgcggctcttaaacagtagtgtcacattgcccgatgccgtgacactgaaatttttcgtctgctcaagagctgtgtaaccggaaacagactgtttttcggttaccgtgtaatttccgaccggcaagtttggtaccgtcgcctggccgtccttactaatctcgctattcgccactacctgatgcgattcattttgaatctcatacttagcgccgtttagcggtgatccttgttcatcttggttcttgatcgtgagcgtaccagtcactgcctgtgtcggattttcggctgcaagggctagtgctggcgaaatcagttgcacaatcatgccaaggatcaccgttaagtaaatccctactttaagcatgaagtgcccggttttcttgacacctaactccctcatttttctcctcttcctcctctttacaaacctacttggtatctccccctgagaccattaacctataatttatggatacattaatttacgctccgctcaatatcattgtataacatttctataaatattgaagggattataaaaaatattcattaaatatatatgcttatgtttattcttttcacccagtgctgatttgcctttaaatccttacacatcaggtgttacagccaattaaaaaatgtactgttagacagggctattaaatgtcgattttttctagaagttgatagcgttaacaatagaactttttcagtccattatcatctactttttacttgtgcaagaagaaaaacaaatgcgaaatctgcttcatgaagaggtgaatgctatgctaataaccgtacttttgctcattgttctgtacttagttcgtcagcacagcttggcaacccgttgttttcactgtctattagccgtcctctttggattaagcatccatacttggttaacttttttgcttgcctcaggcttaatcatctttagcgtggctgactggcatgagcgaacggttcctttcttcagctttactggttggtgtttgactttgctggtttgttttccccatgaccttttcggcatgatgctacttgctgtcatgattggcggtttagccgttgtgtcgcaaggacttgggagtgcggatgtgatgttaattgccttgctggcctgcgttttacgactcgaggcagcgttaatcgtgacactgatcgcttgcggaaccgcctgcctgcattggatagctgctcgcccgccgagtttgccaatgatcagtcatttagcggctggttatgcgtgctttgctctggtaaatggcggactataacgcgctcgcagtcgcagaaacctacacgtaaggaccttgaagctcagtgaccaccccatgtcattcagcttcaaggccacttacgtcccagtttctaaacgctcctactcgcgctcaccaaaaaagcggcgcaagcatcttttcagatgtttacgccgcttctttttggtttaactgtcagttcacgcgattactttttgtccgtatcgccttgctggccgtcttttgctttcatttgcttttcgatgtctgaaatcgaatagacactgtcggaaacggtgccgacactctttggttcttcgtgtcgatacgttgccatcccggtaccagccggaatgatcttcccaatgatgacattttccttcaaaccgatcagcggatcgttcttgccgcgaatcgaggcatcggtcaatacccgtgtcgtttcctggaaggaagcggcagacaggaaactgttggtctccaaggaagccttggtgatccccagtagaactggccgtccagtagcagggataccgccactgataattgcctgcgtattcttttccttaaagtcagcaatatcgagtaaggttcctggcaagatgttggtgtcgcctggatccataacccggatcttgcgcaacatctggcggaccatcacttcaacgtgcttatcgccgatatcaacaccttgcatacggtaaactttctgaacttcagaaagcaggtaattttcagtggccatgacatcgcgcactttaatcaattgcttaggatcaatcgaaccaccagtcaggcgttcgccacgattaatgtggtcgccttcagcaactgccacactggaagcatatggcacgctgtaagtccgggtgtcggtttcacctttgaccgtgatttcccgtgtatgctcagctggattttcgtcaatcgccgtaatttcaccggtcacttccgtaatcacagcttcacctttagggttacgagcttcaaagatttcctgaacacgaggcagcccttgcgtaatatcttcgccaccggcaacaccgccagtatggaagttccgcatggtcagctgggtaccaggttcaccgatagattgcgcagcaacagtcccgacagcttcgccgacttcaacttgttcgccagtggccatgttacgaccgtagcacttctggcagacaccatgtttggtgttgcaagtgaagaccgaacggatcgtgacggattcaaccccggcatccacgatcatctgagcagtatcttcgtccatcaaggtattgcgcttgacgagcacttcgccactcttcggatccagcacatccttcatggtgaaacgaccaaccagtcgatcatacaacggttcgatcatttcattaccttcacggatagcactgacaactaagccacggtcggtaccgcagtcctcttcacgaacaatgacatcctgtgcaacatcaaccagccgccgagtcagataacctgaatcagccgtcttcagcgccgtatcggtcatccctttacgagcaccgtgagttgacatgaacatttccatgacggacaggccctcacggaagttcgagataacaggcacttccatcatcccaccgtttggcgcagccatcagaccacgcatgccggcaagctgtgtaaagttagaaatgttaccacgagcacctgaatcggacatcatcgaaattgggttgttcgggtcaaacgaatcaaccagcttctgctgaatatcatctttggcatcattccagatctggataacccgatcatgccgttcctcgtcggtaatcaacccacgacggaactgcttggaaacagtggcaaccttcttatgggcagcttccacaatttcaggcttttccttcaagttagtaatgtccgcgatcccgacagtcaagccagagttagtggactgcgtatagcccaaagtcttcatatcatccagcaagtcactggtccgttgaactttatagaccttgaagacttgcgcaatgatgtcagacaggaagcctttcttgaatggatcgattaacggtgcatcttcaaggtagtcgttgatgtcttcacccttatcgatgaaatacttatccggcacaccattgacgatgttatcctgcgtcggttcattcaaatatgggaagtctttcggcataatctcgttaaagatcgccttaccaacactggtgaccatgatcttttgtttctgatcatcggtaaacggcttgtccgtaaaggaattagtcgcaatcccgatgcggctgtgcaagtggacataaccgttttgcaaggccatcaacacttcgttggtgtccttaaagatcatgccttcaccttcgcggcctttttgttccatggtcaggtagtagttacccagcacaacgtcctgtgatggcgtaacgattggcttgccatcttttggtgccaaaatatggtgtgcagccaacatcagcatccgtgcttcagccatagcttcgtcagatagcggtacatggatcgccatctggtcaccatcaaagtcagcgttataagcttcgcagaccagcgggtgcaaccggatggacttcccatcaacaaggacaggttcaaatgcctgaatcccaagtcgatgcaaggtaggtgcacggttcaacagcactggacgttccttgatgacatcttcaagcacgtcccaaacatcatcatcttggcgatcaatcttgcgacgagcatttttgatgttgctagccatgtcgcgcttaaccaattcgcgcatcacaaatggcttgaacagttccaatgccatttcacgtggtacaccgcattgatagaacttcagccatgggccgacatcaataacggaacggccggagtaatcgacacgcttaccaagcaagttctgacggaaccggccttgcttccctttcagcatgtgtgacagggacttgagcgggcgattacctggccccgtaaccggacggccacgacgaccattatcaatcaaagcatcaaccgcttcctgcagcatccgcttttcgttttgaacaatgatacttggcgcattgagatcaagcaggcgcttcaaccgattatttcggttgataacccgtcgatacaagtcgttcagatcggaagtggcaaaacggccaccttcaagttgaaccattggccgcagatccggtgggataactgggatcgtgtccatgaccatccaagctggatcattaccggattccttaaaggcatccagaatatccaaccggcgaatcgcacgggtccgcttttggccttgggctgacttcaagtcttcctttaattcggcaacttctttatcaagctcaacatcctgcaacaattccttgatggcttcagcacccatcttggcattgaaggtttgaccgtattcttcgcgtttttcacgatattcacgttcggtcaggagctgctttttctccatcggcgtatcgccaggatcgatcacaacgtaggatgcaaaataaatgatctcttcgagtgaccgcggtgacatgtccagtaccagacccatccgacttgggatgcccttgaagtaccagatgtgggtaaccggtgcggctagttcgatatgacccatccgctcacggcgaaccttggaacgagtaacttcaacaccgcagcgatcacaaacgattcccttataacgaatccgcttgtacttgccacaggcacattcccagtccttggtcggtccgaagatgcgttcatcgaacaagccgtcccgctcaggtttcaacgtccggtagttgatggtctcaggttttttaacttccccataggaccagctacggattttatctggcgaggctaagccgatttgcatactttcaaacttattgacatcaatcaaagggctaacctcctatttcttatcgtcggtactgttggcagacttaccgtcatttgcttgtgctgcggcttcgtgagccttcttttcttcctgctgagcagcaaacttcgccaaggcatcgacagaaacaatgtcatcctcgtcgtcgtccatgtcccgcagttcaatttcttttttatccgcgccaaggaccttcatatccagacccagtgcttgcaattctttgacaagcacacggaaggattctggtacacccggcttaggaatcggttcgcccttaacgatggcttcataggtcttaacccggccaaccacgtcatcggacttgtacgtcaggatttcctgcaaagtataagccgcgccataagcttcaagggcccaaacttccatttcaccaaaacgctgaccaccaaactgagctttaccaccaagtggctgttgggtaactaaactgtaaggtccaatggaacgagcatgaatcttatcgtcaaccatgtgagacagtttcatgtagtacatgattccgacagaaacacggttttcgaatggttcaccagttcgaccgtcatacaagacagacttaccatcagatgccataccggcttccttaacggttgcccacagatctttatcattggcgccatcaaaaacaggcgttgcaacatgaatgcccaagttacgtgcagccatccccagatgcaattccagcacctgtccgatgttcatacgacttggcacacccattggtgacaagcaaatgtcaactggggtaccgtctggcaagtatggcatgtcctcttcaggcacaacgacggaaaccgtccctttgttcccgtgacgaccggccatcttatcaccgacctgaatcttccgcttctgcgtaatataaacgcggaccatcatattcacaccaggagacagctcatcgccggcttcacgagtaaagatcttaacgtcttgaatgatcccgccgccgccatgaggaacccgcagcgaggtgtcacgtacttcacgtgctttctcaccaaagatcgcatgcagcaaccgttcttcagctgacaattcagtaacgcccttaggtgtaaccttgccgaccaaaatatcaccgtcacgcacttcagcaccgacacgaacgacaccaaattcatccagatccttaagggcttcttcaccgacgtttggaatttcacgcgttacttcttcaggtccaagcttggtgtcacgtgcttcagattcatattcttcaatatggattgaggtgtaaacatcatctttaacgagtcgttcggagagcacaatcgcatcttcgtagttgtacatgttccaagtcatgaaggcgatgatcgggttttgtcccaatgccaattcaccattttgcatggctggtccatcagcgatgatttcgtcaacatcaacatgatcgccgatggtcacgattggccgctggttgtagtttttaccggcgttactacgcttgaatttcatcaagttgtaggcatccaaggcaccatcttcacgacgaacccgaatttgcttagcatcaacatattcaacggtaccagcgttattagccaaaaccgctgtcccggagtcatgggctgccttgtattccatccctgtcccaacaagtggggcatgcggattaaccaacggcacagcctgacgttgcatgtttgcacccatcaaagcacggttggagtcatcgttttccaagaaaggaatgcaagccgttgcgaccgcaacaacctgtttaggtgaaacgtccatgtagtcaactttgtctggagagatttcaatgttgttatccttgtgacgagccagaacggtttcgtcaacaaaggaaccatcgtcgttcaaaggcgagttcgcctgcgcaacgatgtagttatcttcttcatcggcagtcaaatagtcgattttgtcggtaactttatgcgtatcccaagaaacacgacgatatggcgtttcaataaaaccataaggattaacaaccgcataagaagcaagactgttaatcaacccgatgttcgggccttcaggcgtttcaatcggacacatacggccataatgggtgtagtgaacgtcccggacttcataaccggcacggtcacgcgtcaacccaccaggtccaagagcagacagacgacgcttatgcgttaactcaccaagcggattcgtctgatccataaactgcgacagttgggaactgccgaagaattccttgatagaagctacaactggccgaatgttgatcaattgttgcggcgttaccgtagcggtatcttgaatggacatccgctcacggacaacacgttccatccgagaaagcccgatccggaattggttttgcaacagttcaccaacggaacgaatccgccggttacccaagtgatcaatgtcatcaattgaacccaagccttcctgaagattcaggaagtagttcattgatgccaaaacatcagcggggacgatgtgcttcacttttttaccaatatgaccattaccaatcaaattgatttctttatcaggggtcacttgtgagtatactttgatactctgtaattcgatcggatcagtgacaacgccttgatcggaaggttggtaggtgatggtcttgaaatcgtcgcggtcaagatatggtgccaacttgtccatcacttgacgatcaaccttggtgcccttttgcgcaatgacttcaccagtatcaggatcggccagtgtttctgccaaaacctgattcaaaagccgggtcttaaggctcagcttcttattcactttgtaacgaccaaccgaagcaagatcataacgcttcgggtcgaagaagcgggcatacaaaagagaccgcgatgaatcggctgtttttggttcaccaggacgtagacgttcgtagatatccttcaacgcttcgtccgtacgggaatcatccgtgttcttatgcacatctttttcaagcgtaagcatcaaggaatcattgtcaccaaacatgttgataatgtcttgatcggaaccgaagcccaacgcccgaaccaattcggtcagcgggatcttccgtgtccgatcgattcggacatacgcgatatctttggcgtcagtttcatattcaagccatgcgccccggttaggaatcacggttgtgccataagtgacacgtgagttcttgtctgtttcgctatggaaataaacgccaggtgaacggaccaactgagaaacgatgacccgttcggcaccattaataataaacgtcccttgtttggtcatcagcgggaagtcgccaaagaacacatcttggctcttaatctcgcctgtttcatggttggttaaacgcaaggtcacatgcaacggtgcagagtagtttgcatcgtgttggcgtgcttcctcaacagtatattttggttccagcagttgatagccgacaaattccagtgacagtttcccttgaaagtcatcgatcggcataatatcgtcgaacatttctttgagaccttcatcgaggaaccattggtaagaattcgtttggatctcgatcagattaggaagatccaaaacttccttgatccgggcataggaccggcgtgtccggtgcttaccataattcactaagtgtcctgccaaattattcaccccttgtaagattttccggcttaggttgattgtaaaaataatgtaaatattgttaaatttacatgacaacgaccatcccgcagacattttgagcaaaaaaaaaccaaaaacagatcgaccttcaaccagcctgctgtttttgctttttcattagccagaacggacaatagatcgtcctgacagcctgtccaaaccgaaatgcgattagattaataatacgcgtatcaatcaacgatgtcaagcggaggttgatccgtgctgcgcaagcaaagccaaaaagaaatcgcaacctaacagccgcgatttcttcattatcaacactaggctttaacgggttcttttgaagcaccgttttctttttgcttgcctttgttctctttaacagtaaatgtcagcttgccttttttagcaccgatttggatcaagtcaccggttttagcttggcctgtcaataagagttcacttaactgatcttcgacaccggtttgcagtgcccgccgaattggacgtgcaccgtactctggatcgaagccggcagcggcgacagcgtcaataccggctggggtaattttaacgtcaatcccttgatccttaatgcgactaagcactgtcttcgtcatgatcttaacgatttcatgcagctcagccttgttgagactgtggaagaccacggtttcatcaattcggttaaggaattctggtcggaacgcttttttaagttcgtccagcatccggctcttcatggcattaaagtcagcttgtggatccttggcaccaaagccaacagtcttatcgtcacgaatagcggttgcgccgatattactggtcatgatcaaaatcgtgttacggaaatcaacccgccgaccttttgaatcggttaaatagccatcatccagcacttgcagcaaaatgttaaagacatctggatgcgccttttcaacttcgtccaacaacacaaccgagtaaggcttgttgcggactttttcggttagttgaccgccttcgtcgtaaccaacataaccaggggccgcgccgatcaaccgactggtactaaatttctccatgtactcagacatatcaacccggatcatggcatcttcagaaccaaacattgcctcggctaacgccttagccagctccgttttcccaacacctgtcggcccgaggaacatgaaggaaccaattggccgcgtcggatctttcaaaccagaacgagcacgccggatagcacgcgcgacggcggaaactgcttcgtcttggccaacaacccgctcatgcaggatcttctccaagttaaccaaccgatcggattcttttttctgcaactgggtgactggcacaccggtccattgagaaaccacttctgccacatcgtcgcccgtcactttaatgtcagttcgaacgccactttcattaactggttcaggcgtgtcggccaacttcgtttttaaatcagcttcctgagtccggatgttcgcagccgtttcgaaatcttgatggtcaatagcgtcttctttatcagctaccagcttggccagttcatcctgaagcttgtcggccttcgtctcaacattggccttgtccaagcgaaccttcgccgcactttcgtcaactagatcaattgccttgtcaggcaagaaccgagtcgtgatgtaccgtgatgacaaaaccaccgcctgatgcagcgcttcgtcagtaatcgtgacaccgtgatgcgcctcataacgaggacgcaagcccttcaaaatttgttcagcttcttcttcagttggttcgtcgacttgaatcgtcgcaaaccgccgctccaaagcagcatctttttcaatatacttttgatattcatctaaggtcgtggcaccgatcaattgtaattcaccacgagctaatgccggtttcaaaatattggaagcatcaatagcgccttctgcaccgccagcaccgatcaaagtatgcaattcatcaatgaacaaaatgacattgccatctttataaatttcatcaatgatcttcttcagccgatcttcaaactcaccacgatacttggtgccagcgacaagtgagcccatatcaagcatcatcaaacgcttgttgaccatgtcatccggcactttaccagacacaattttttcagcaaagccttctgcaattgcagttttaccaacaccaggttcgccaatcagtacagggttgttctttgtccgccgtgccagaatctggatcagccggcgtacttctttgtcacgcccaacaaccggatccatccgattctcgcgcgccatttgggtcaaatcccgcgccaaaccatctagcgttggcgtaccttgtccatcttgacgagcaccgccacgtgccattggacgacgctttgctgcagtgtccgcaatccccatcttcttgaagaccatttgacgcgtcttcgaaagactgagaccaaggttttgcaaaatccgtgctgccaagatgtcatcttcacgtagcaagccaagcaaaacgtgctcggtaccgatctttaaagcacctaaccgttttgcttcgtcacctgcaaacgccaaaatctctttaccttttggtgagtaaggcaaataactatcactagcttgaccagcggcatcaacagtcccataccctgtgaagcgctcgatctcgtcatggacatcattttcagtgacccctaactgacgcagcgtcttaccagcgataccatctttttccatgaccagtgccatgagcaaatgttctgtcccaacagcatgatgatggaagtacttcgcttgttcctgggctaaaagcaatacatttttagcactaggggtaaataagttgtccataagcacgctcccttttttaaaaactgatgataaactgtttcatctttcataccgcaaacgatccaaaaatgcaaggaacaaacgcgatcgtagatgctcttctgccccttggtcgaagatgcccaacgtctcatgatccatcaccgcgagcatcaggttgccagactggcgggcgatcaacccgttatcaaacaattcctgaatcaaatctcgggcatcccgcatccgcaaacgacttggaatatgctgtcgcatgatctgaatgagatcctgatcatctgtcaatttgaccttcacgattcgaatatagccaccgccaccacgtttgctctctacgatataaccgcgagcaggtgtgaatctggttttaatcacataattgatctgtgaaggtacacaattgaaacgacgagcaatttcagcgcgtctgatttcaacagccgcttcttgcgccaatatcgtttttagataggtttcaatgatgtccgaaatgttctcacgctgcatgtcattcaatcctttttgactttgaccaatcttgactattacacattatactgacatctgtccgtttatacaaatttatgactttgaacgcaaaaaaagaccacgactattcgtgatccaagaatcgggaagacaagattcgaacttgcgacccctacgtcccgaacgtagtgctctaccaagctgagctacttcccgaggaagcggaagacgggattcgaacccgcgacccccaccatggcaaggtgatgttctaccactgaactacttccgcattccgagtatttagttctaatcggcgccagcttagtagcggtcgatgatgcacccagtaggagtcgaacctacaaccttctgattcgtagtcagacactctatccaattgcgctatgggtgcattcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcataccgcatattcaattattgagaccggggagaaaaaaccacctattggaaccgagcttttacttcacagtacaatgcgggtgaagggactcgaacccccacggtcaaaaaccactagaacctaaatctagcgcgtctgccagttccgccacacccgcaaaaggtgggttaaaaatgagccgtgacaggctcgaactgtcgacccactgattaaaagtcagttgctctaccaactgagctaacggctcaatggaggatacagggctcgaacctgtgaccctctgcttgtaaggcagacgctctcccaactgagctaatcctccatatgtaagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgtttaattgctgccttgaacctaacgtacttgtcatcgaaacgtgttcgcagtcgcagaaacctgcgcctgcttgcacgcttacttggttaagtcctcgaccgattagtactggtccgctccatgcatcgctgcacttccacttccagcctatctagcaagcttcacactagtacaatgatgataacgttagcctttcttcgcttcatgctcaaaagacactaaacaggctctaagattctttaggtaccgtaactgttaagggttctaattgaaaattcttatctatgttgtgaccaatattattgatccccttcataacttcacgacgggtgacgatgccagtaaagtaaccatcttggacaaccggaatgaatgggttatcgacgagcaaatgtaggacattttccaagtcgtagggatcatcaatggtcgcgacctctgtctgcatcacatctttgactgtcattgtatctagtgaattaaaactcatgtgatcaaggccaagcatggtctcggtaatcattggcagtgagatgagccctttgaattttgaatcatgatcgaggacgggaattttcgcataccgcaccttggtcaataccaaaaaggcatgactcaaaggattgttttcagacacagttgcaaccatgtcggctgaaatcatgaagtgatgccgattttcgatcagcatattggcaatgactggatttaacatatgagcaactcctttattgacagtcctattttacctgagtacgcctaaaaattcagcttcaggcaacttctttatttcatcttaacgcttacgttactcgctgccatccgtcaaaagacggacaattggttaattgattcaaccatctttcgagcgaattcgtccgataatgcgcaaagcagcgcattcgcaggcacagaaacctgcccacgcttactagtcgtttaaatggacggttccccaaaaagttggtacactattttcagctatatttatactttcataagcttttgggtattattttaactacttggaggaaacaaatgacatacgatctaggcgtgcgtttagccgccgaatttattggcaccgcgattatggtgctactgggaaatggctctgtagccaacgttgatttaaaagggacaaaaggtaacggctctgactggttgctcattgccgtgggctacggtgctggggtgatgattcctgcgatgatgtttggcgcgatttcaggcaatcacatcaatcccgcctttacccttggactcgctgcatctggcatgttcccatggtcagaagtcttgccatatattgcggtacagatggctggtgccatgttcggtcagttattggtggttgcggcctacaaaccgcattatgatctcacaaccaatacacagcatgttttaggcaccttcagcacgatcagcgccaccaagagcaagcttaacggtttcgtcaacgagttcatcgggtcctatattctttttatcggtgccctcggaattaccaaggctccttttttccaaaataatctgggtactgcccacatgggactgggttttctggtcgcgaccttggttgcctcgctaggtggaccaactgggccagccttgaacccggcccgtgacctcggtccccgcattctccatgcactgctgccgcttaaacataaaggtagctccgactggggatactcatgggtaccggttgttgctccgattttagcagccatcctagccgtctttacctacaaagttctattcatcaaaggctagccaaaaagatctcacctgcagatcactgtcaattgacagcgtcctgctagtgagatctttttttaatcgtgcttccttgaaaaatcacgacttaattctggcacgattgccccatcacgcttcaaaaaatcaacatgaacgttatccgcagtaaattcaacagtggcataagttccgccaaggttggcaaactggccacgcggctggctgatagaaccgggattaagaatcacaatccccgcatgttcctccacacccaactgatgggtatgcccgaaaatgatcagatcagcatgaaccccttcgcccgcagcgatgagtttatctaggccaaaattaaccccaaaacgatgtccatgggccatgaagactgtcacaccttgaatggtggtcgtgatttgcatgggaaaattaggatcatagtccatgttgccttcaactgcctcgtactgctgaaaaaggccatcatcagcggctaattctgagtcaccggcatagaaatagccatcaagatgcggctgttgtttcaacaaagctgtgagaatctctcgatcaccgtgggtatcgctaactgctaaaattttcatccgtttgcctccaaccatgtttgccaaacatcttcaagtgccctcattgcgttcccgcgatgactaatttgatttttttcttcagcggtcatttccgccattgtcttccctaacgctggaacaaaaaagaatggatcatagccaaaaccatctgtgccacgtgggatcgcagtgattagtccgctcacatcaccatgtaccaccaagtctgcttccggatgatccggtttagcaagcaccaaggtagtatgaaaagtcgctgttcgatcatcttccgggacatctgccaaggctgccaatagtttggcattgttagctgcatcgttgtgaccatcgcctgcataacgggctgagcgaataccaggttgcccgtctaaagcatcgaccatcaacccagaatcatctgcaatcaccggcaactgcaaatctttggcatactgatcggctttttgtcgggcgttctcctcaaatgttgtgccagtttcgtcaactgttggcacgcttggaaagtcggctagactcttcaccgtgatgccagcaggttcaaacattgttttaaattctttaatctttccttgatttttgctggcaacgacaatcgttttaccctttgcttcaggcactgtatccatagcgtggtctgcctcagcctcaatgttgacatgtttggcgtgcatcggcgccgtcagttcaagccaagcttcgccaagttcgtcaaacattgatggtgccccggttgtgtaatattcgtgagttggggtgtcgccgctgttgtttgctagatcaaaataatcaagtagcatggaaacatcattcacagtctcggcgccggaatcaattaaggtcacttgatcacccatcacattttgaatcaacgggcgcagaatcgggtaatgtgtacaacctaaaattaacgtgtcaatgtcttcatgcagcaatggttgcaaggtgtcagccaccacccgtttagcaatgggtgagtgggcttcgttactttccaccaatgagacaaatttaggggccgccagactagttagtcgaatcttcggcgcctttgcgcgtaaagccttcacataagcaccgcttttaacggtgccttctgtggcgataatcccgatgtgaccagtttgcgtcgccttcagtgccgcccgactgccgggtttgatcacaccgatgactggtatgtctaagttagccttaattaagggtaatgccgctgcggtggcagtattgcaggcaatgacgagcattttaatatgctttttaagcaagaaattgaccatctgccaagtaaacgcctgtacttgttcggcaggtcgcgggccatatggcaaacgagcctgatcgcccagataaacactgctttcagctggcagctgatgcaacgcctctttaacgactgtcagcccgccgacaccagaatcaataaagccgattggttgcttgttcatgaaatattctccttttgaaacaggtttgcagggatggcaagcaaagtagttcatgttgccaaaatgtctgcataggattctctttaaaatgttctgcctcacgggctttgggtgaagctgtagaggtgtgagacagatcgtttttagccgcatttctaggtccgagagtttgcgtgtaaggaccttggtcgcaaaatggccctcggggatccgctaaaacgcgttcgcaggcgcaggaacctgcacataaggaccttgaagctaaatggccgcttatgctccggtttctaaccgcgcctgctcacgctctctgaaactttattgtgagttttcttgttaaaaattgcaagcgttgagaaaatcatgttttgctttgaattttccgctatactagacgaatagaaacaggaggcacaacatggcaaaatcttactataccaccctgctgaaccttccaggctcggtttcgttctttgcgttgacagcgatgcgtgatctcatgctgccgaatatgcttggcgaggaacagcacaacatcctttattgggctgggcgcgatttggctgctaagttgcctgtcgatgagacagccattccgcaactgttcacgcaggttggctttggcgcgctcaccccgctcaaacaaaagcggcaggaacggcaatatttactcgctggtgacgttgtgtcaacgcgaattcgtacatatgaagatcctgattttcaattagaagcagggttcttggcgcaaacactgcaacaagttttaggttttgcagtcgaaggcggtagtgcgattcaacgtcgcgagcaaaacgttgttctgaccgttgtgatggataatcaagatacccaaccgcgagctgaacatctgattgacttggaaactgatcaccaaccaaccaaaaaataggctaaaagactcgtatcataattgactgtcctatttttgggtttgcatgcttactgctcaatcaaaaggagtctaaacgcaagcagttgcttacgtttagactcctttttgagtatgatgctttttgaatctcgacaagttttagttcaagccattagcactacgctgctgccaccgcgttgtgtaaaagtcatcattcagcttgtagtgcacgggtgcagccttggtggttttgagaaatggccggacagtttgatccatcttcagccagccacgccagccaatgtgaatcgtgtcttccatgaagtatggctgagcaccatcttgactcaaatcaagaacgtgattaaaaccttgggacttcagttgatactttaacttggtaaccgtgttttgaatcatcccgagatccagaccagtataagcggcccacttggcattgatcggcggaatgacgaacagtacctccatgtgcttttttgcatacgtgttcaataccaactgtagatctgaatactcaggtgatttcacatagctccatgttgcctgagagccttttaatttaggcaaattacgcttaacccgtttggtgtagaaatcatttttcaactcaaacgcgttgttcgtcgtttcgttcatcccatcctgtgttgccagaccatccaatacatcagcatcgtaagtacctggtagcgtcttggctgctttggttaacttaggttgattattatccaagaacagctgagagaataaaatatcctgatggtcagacatgggttccttgatttgtttcaaataccagtactgactgtcagacaacttctgccctgccgcaatattcttcaaagcatcattggcgatgcgatcagagtcagcggatggaaattgtaacaatcgactagcagcataacgatcagcctctgagttaggattcgctgataacaagaaggttgtcatttgtgcaggcgaaaagaagtaatcaaactgcgccttgcgaaccccgccaggaacgaaccattgcggtgacaacaccatgactgcctttttcccattcacatgttgtaacgcattgatcgacaagaagtgcgtgagatcctgcgtgccagccatccccatcaagaatggccgatagttgcgatgatacttttgtgccaggacagaaggatgaaatgcatccatccgcgacagctcggatgacccgataaacggaacatagttttcggccatggcttcatttttgatattctcgcctttaagcacgttggccgacatagagctggccgcttgtctaatcgttgcttggctgctgcggccaaacttaaatggcacgagcatcaacgcagcgaccaggatcacagcgatcagcagcgggccaagtccgcgccaaaggatcttcccgatcggttttttcattgtgcttgttcgacctttgcgatgattttgttaggggtatcccattgactacgatcaaattcagaaacaggtgcttctacgccgaactggctttgcagttccaacaacagttgtaccgtccccattgaatctaacaagccggtttcaaacagattcagatccaaatttgtcttcacatcatcagaaccggttaaatctgccaaaatatctaaaacaccatttttaattgcttcgtcagccattattaagtacctctttctttttaatccgcgacttgtcgtcacagcgacaagcctgtaccaacgttaccttaatggaaccagagtgtgtctaggaatcctgagaaaatcaggaatgagaagcagacagcattagcggtcatgaagatcgcaaagtaatgcgttgctttgttgtgcgggaagaagtctttgtgcttcttcttgaaccgcagccaagcgtctgtcaagttgatcaacatcgcatggaatagtccatacgtgatgtaataccaagtttccccatgccagatacccataatcaggaacaacaccagatagccgacaaaggctgtccagatccgtgatttaatcaacttatgcttcatcataaagaagacaaaacgcatgtagatataatcccggaaccagaaacttaggctcatatgccaacgattccaaaaatccttaatgttgtatgacatccacggtttattgaagttcattggcgtttcgatccccatcaaatacgagatcgcaacggcgaataaactataaccagcaaagtcaaagaacagatagaaagagtaagcatacatcacacctacgaccggccagcttaagcctagaaatgcgccggtacgactgaccatggccatatgttcaaccgatgggagccataaagttccaaaaatgtacccaagaatgaacttgtacaaaaatccaagcatcaaataatgcattgccttagtaactaactgggcataatgctctggatcagggacacgatcatagtctttgataaaccggcgataccggtcaattggaccactggaaattgttgggaagaacagtagaaactgaatgaatttccacatgttcaaatctttgattgacccatcccgaatttccatgatggtaccgacaacccgaaatgtcagataactgatgcccaaaaatccaagaatggaaccatgatgttggaacaacggtgtaaatttgacaacgactaattgggcaatgcccaaaatgacgctgagataaaagactgccgttgagttttttgatccttctcgcgtacgatacttgaagtaggcatagaccaagagcagattgaaaacaacatatcccaacagtgctttaccttgcggccacttatcggcatcaaagatcatcaccagaaaaacgattgagaaaagactctcgtaccagtgcatccggaaacccttgaacatgccaatgataactggcagtaaagcaatgatgagataaacaaagtattgcggattctcatatggttgtaagttcagcattaatgatttacctctgcaatcagcgctttccgatcgactttgccgttggctgtcagcggtaatttgtcacgatagataatgcgctgcgggatcatatattccatcaccattttgcctagctcagcttttactgcctgagtgagcttcatatcgctttcgaagtcattgggcttcgccactgcaaaagcaatcagttgagcaaccttatgatccttgttgtagcgcggtaccgttgaagcttgtttgatgtaggaaacctgattcaagttatgatcaacatcttcaagctcgattcgatagccatgcagcttaacctgaaagtcagttcggccacgatagaaaatcatgccatcctcagtcatcgtggctaaatcgcctgaccgatagccgcgttgactgccaacattgaagaaagctttggccgttttctcaggattgttaagatacccctttgaaacacttggtccaacaatcatcaattcgccttcggtacccgctgacacttgattgccttgctcatcgacaacgaaaatttccgtatccggtttagcaaaaccaattggcaaacgcggatattgatccacaatgtcctgcgtaattgccattcctgtgaccgccacagtcgtttcggttgggccatatgtgttatacacggttgcctttggaaaacgggtgatcaactcctgcgccgttttattgaccaattcttcaccacagaacaggaaatgtgtcaaatcagggtaattatcttgattgaaattaggatcaagcaaagcaatttcggcaaacgacggggttgatacccactcattcaaacctagcttaggtaaggttgcgaacaacgttttgaaattgtccgttacttcctttggcaatgccttaagcgtaccgcccaaaaccaatgtcgggtacaaatccatgacactcaagtcaaaagaatagggtggctgtgacatggccacaacgccttccttgagaccaaaatcggaaatgttccagttcacgtaactcaacaagttatcatgactgatctgaacacctttaggtttgccggttgtgccgcttgtgaaaataatataataattgtcatcgccaacgaccgcatgttgcaatgaactaatgggtgcatgcgtcttctcagcttcatgcaactctggtgcgcgaataatctgaacatccggaactgcaatcggcaaaggcgctacttcgatgatagccggtgtatgggcgacatcctgcacctgcgtgatccgctcattggggctatgggtatcaatcggaatgtatgcatgcccagacttggaaaggcccaagaaaacctcgaccatatcgaaagtctgaccgccgtaaacaatgatcggctcatgctcaggcaaggtttcagcaaaaaagcctgccaagcgatcgctaccttcttttaattgtgcgtaagtgtactgtgtgccttcataatcgtaagcaacgcgcgttggatgttccgcggcgacccgatcgatcgcagtaatcacattatcgatcatattggctctcctcctctttagacgcgttcactggcgctccggtttctagtcgcgccagttcacgcttttagaactcgttataaatgaatttactgttattaatcccgctgtagccgtagagataaatcaagaccaacaggataagaaaatacgtaatggtccaaaaaataaatcgaaaagtgggattctcccacatagcttttaattttgcgaacatgatgccaccccacgtttttatttacacattcattataggttttcagaaaaaatgacgccaacgaattgcgtaacaatgagctaacagtttcgtaatatgagaagcgtgagccaccgcggttagaaaccgaagcataagcggccttgggcgtgatggccggtcttgggccattgcgtccaaggtccttatgcgtaggtttctgcggtggcgaacgcgttatggagcctaagctatccctttttgaaactggtatgtaaagcaattatgctgccaccgtcccaaatacccacacaatgacttagaaaaattttaacataactattgatatcctagttatttttagaccaattcatcagcatcaagaaaatcttcaatattttaagttttgaaattaacgcctgtcagcttcatcttaagcgacatcccattcaacatgttttagtgcaaaaaaacacgcatcgaccagtagcgtcgatgcgtgtctgttcacttattcattaagccgtatatttgttcaaggttgactccaactgatccttggtttgatagccaacaagcttctcaacaacctcgccatcttttttgatgaccaaggttggaatggccataatgccaaaagactttggtgtctctggattggcgtcgacgtccattttcacgaatttaacgtcatcgcgactttctgccaatttgtcgatgaccggactctgcatccggcaagggccgcaccaagtcgcccaaaaatctgttagggtgacgccagtgtcggtctccgtcttgtagtttgaatctgttactgcttgaaccatgaacggatccctcctcttacttttcgtaactaaatcatagcacaatgaagtgtaaaaaactacctgctacttaaagtttacgatggtagctcctgaaccaccggcattttgtggtgcaaagccatacgttttaacctgccgattgcgtttaagatactgggtcaccccgttgcgaatcgcgccagtgcccagtccgtgaataatcgtcacagatggataaccggccaataaggcggcatcaatgtattgatccaaatccgccatcgcctgatcataccgctcgccgcgcaaatccagcgtggtcgatgggccgctcatcccgccgccacttactttgacaaccggccgttgcgccgctgattgcttacttggcttgattttttccagctcatcagttggtaccttcatttttaaaatgcctagttgaacctgccaatgcttcttatcgaattgctccagcaaggtaccagtttgatcgtaacttgccactttaacctcatccccaacatgcaatgcctgtttctcacgttcccggcgcaagatgcgatttttctgaagcggctcgtcttgatgcaattgtttaagcgccgttttggcagcaatcaattgattctctttcacggttcccggattcgtcaattgcatttggcgcagttgcttgatgattttatcggccttcgtttgggccttgtcaaccaacgtgttggccttgtccttagcctgctgcaactgggcatcgcgttccgttgtgaacttcttgtaggctgccgctagctcgtcatggacagactgtgcatcggcaagttgacgacgagcggcttcataagcggtttccgctgcctttcgctgtttttccaagtcgctgatcatattattcagctcatggctgtccgagctgatcattgacttagcacgctcaacgatgacgctcggcagccccaaacgtgcagaaatatcaaacgcatttgagcgcccaggtaccccgaccaaaaggcgataagtcggctgcagcgttttgctgtcaaattccatcgatgcgttaatcgtctttgctgtattgtacccatataacttcaattccggataatgggtcgtggcaactacatacgcgccaacttcacccactgcgtccaagatcgcgattgccagcgccgcaccttcttgcggatcagtgccggcgccaagttcatcaaacagcactaaactattctgtgacaattgtttgagaatatgaacaatattgtccatatgtgcagaaaaagtcgacaaattttgctcaatggattgttcatcgccaatatctgcaaagacttcatcgaaaatgccgatacgactttcatcatcagctggaataaacaatccggactgccccatcaactgcaacagtcctaatgttttgagggtgattgttttcccaccggtattcgggccggtgataaccatagcttggtacttgtcgcccaacggaatatcgttgccaaccaccttatgcggatcgatcaaggggtgccgagcatcacgcaacaatacgtcattatcagccgacactaacggctctgtcgctttttccgccttggctaatctcgccttcgcattgatgaagtcaaaatgcccaagaaccgccgcattcgccttgatttgaccggtataaggcgctaattcattagacaattcggctaagatgcggttaatctcagctacctcggccagttgtgcctcacgcagtcgattattcaaggcgacaattgcttgcggttcaataaacaaggtttggccggtcgcactttgatcatggacaacaccgccaaatttggcgcgatactcagccttaaccggaatcacgtaccgatcatcccgaatcgtcacaatcgggtcacttaaatactttgattgggcgccgcgagtataatttgtcattttaccgcggatctcgccttcaatacttttgatctgttcacgaacaccatgcagctgaggactagcctcatcggtcaatgtcccatcaggatcaacggctgtcttcaagcgccgtgataattgcggtaacacggttaacgattcttgaagtgtgtaaagctggcgaaaatcaatctgatcctgtaaatcagtcaaaaatttatcaatggcactcaccgtttgcaagacacggctgatgctggctagttcttgaccattcaaaacggccccaatgtcgactcgtttaagcgccggatcaatattctcgagttgcggcaccggaataccgccttttaatcgcaacgccgatgcgccgtctgcggtttcatctagtgcctgttgtacggcgactggatcggtcagcggctgcatggcctgcaccagccggcggccatttgctgtcacgacctgacccaacaatgcttgctgaatcttgtcgtattcaagggtttttaaaatcttttcattcataaataattgctcctataaccaagaagcgctcaaagacgtgataaatcgtccctgagcgtcgtcaacattcatagccataaagcattcacaaattgtgttagccctggcgaatatttgatcatgaccttggcaacgatggcatggtctaagccatgttgaataccggcaatcggaatcaatgccagcaaggctaaaatcaaaaacagaaaaatgtaaccaatcactaaattagcacagccgccaataatggcactgcgtcgatgacccattgcggcatatgtcaagtcgtgaaaccacaatgcccctactcgagttaataaccagccaaacgtcagcacgactaaaaaagcaaagccgcgataaaatgcggtatcaagcgtcaagccgactttatctgaataaaatgcaaactgaccggcattcgtagcagacgggtaaggcactaccaaagtaaaatgcgcccccagtggccgagcaagtgcagttgcagcaagaaagctcaacccataaccggccacatgcaaccactgcaacgccgcaccacgacgcgcgccgctataatagaaataagccaaaattaaaataatcgataatgaaatcaacacggtcccccactactcttcctgctcatgatcatcctgttgcgccgccaacagtttgacctgatcggaaacagaattgaaggcaactaaaatggcttgttcctcggccgatagatctggcgcaagtgttttaacttgcgccagccgttcattcagcaacttcgtgaccgttataaaatgttgttcggaccctggtccgataatcgtgtacgttttatcaccgatcacggctttaaaacgacgcttttcttcgctcattgcgtgaatgcctccactctctcaaagtgtattctaccatagccggcaagtagggtaaggggttgattgcgacacagctcaatttatctgttttgccagcgaatattaagtggggttcatatgctcgccagttcaaaaccgggccggctttaactccctttttaggctgctggcaatttacgcttcgctcgtaaacgcgctcgccagcccataaacctgcgtgtaaggaccctgagcgcaatggccaaagcccggccatcacgttcaggtccgcttacactccggtttctaaccggtctggctcgcactctacaaaaagaccaccaatattctggtggtcttacatgccgtgagttaagacttaatctttcagattcgaatcgtcgtcggccaagaaagtgttcaaaacttcctcaaccatatcccattcagcatcgtcttcaatcgggaaaagatcgcccgagctggcatcaccattttcgtcgggggtaaatgagaaagcctgaatttcgacttcctgatcgtcactttcactcgccggatacagcaatacgtaactcttgccataatcttccgaatcaaatgtgaacaagacctgatacaattcttcattgcctttttcgtcaatcagcgtaatctgctgatcgtcttcgccgggcgttacatgttcattatttgccatcttgtttctccttcaacacgggcggaggtcatgccatcacttgccctgattattgcttggtcaagggaccttttgcatccagataattctggagaatcatctgagcagctaatttatcgatcacctgcttttgccgtttgcgactggcatcagcttcttcaatcaacatgcgggaagcctcaactgttgtgagtcgctcgtcaatgaaatcaactggcaacccaaacgttgttttcaacagttcaccgtaagcttgtgacttttccgcacgcggtccaatcgagttgttcatgtttttaggcaaccccaatacaaacgccgttacctcatattgcttcacaagctccttgaggcgggcgatgccgaactgctccttgtcttcgttgatccgaataatttccaaaccttgagctgtccagcccaaaggatcactgaccgcgaccccaacggttcgggaaccgacgtccaaccccatcaagcgcattaagcttgctccttgccaagatagtttcgaacaagctcttcaatgatctcatcgcgctcatgtttccggattagattacgcgcatcattgtaccgtggaatataggccgggtccccagaaatcagataccccacaatctggttgatcggattataccccttttcttcaagagccttgtaaactgtctccagcgtttcgtgaacattcttcggattgttatctcgaaaatcaaaatgaacggtttgatctaatgtgctcattcttacacctctattctatccgcttcacagaccattttacttgaaatacaagcaaatgtacaattcctgagcaatagtaagtgaataaatgctattttttgttctgcgcggctaccaatcgtcgttatcgactaatttaatggcctatttgattttgtgcaatggtccgtaaaaaaataggtgttgaaacacgcggatcaactgaatatatgattttgatgccatcatgttgttcggcaaccagatagtgttcatttggtccaaaaaagccagtcaacgacaaccgcaacctattcatactccccgcctcgatgaaatcgttttcttaagtttaacatgaccgctcaactttgcgtgattgacttcaccaatctcagaaaaaaggtcaagtaaaagcggcaagttttcgaaatttccaaaaacttgccgcttcattatcgatggtgaccatctggcctaatcagctaagccttttggctaatcactgtctttgcttcagacaacgccgcaggaatgccagctgggttcttgccgccagcctgcgccatgtctggacgaccaccgccaccgccgccaacttttggtgcaatggccttgatcaaatcgcccgctttaaagcctgcttggttagccgtgtcattgacagcaaccaacaagttggccttgccgctaacttcggtacccagtaccaaaatgtcagatgcctgcttggctttccatttatccgccaactgtcggagttcattcattcctgccacctgaacctgtttggcaatcagtttcaaaccgccgacttcctcaggatgatcaaaaatacctgccgccgcttgggctgccaacttggcctgtaagccagccactgtcttttgttcggcttttaaatccgcctgtaattgggcgactttgcttggaacatttttgacttggtcaatctttagattctcagcagtttcgctcaaccaatcctgttgctgggtcaaatattcgtaagcttcttttgacgtgaccgcttcgacccgacgaatcccggcgccaatcccagactcacttgtaatcttgaataagccgagtgcattggagttggttggatgagtcccgccatcgaattcggtgttgtaatcgccaatcttgacaatccgcacgacagaaccatatttgtcgccaaacatcgcaatcgcaccaagttttttggcctcttcaattggcatttctttccaagtaatcggtaaagcgtcccaaattttctggttcacaatcgtttcaacttggcgtagttgcttaggcgttacttgaccaaaattcgtaaagtcgaaacgcaagtaatccggttcaaccaaagagccagcctgatgtgtgtgctcacccagaacatcacgcaaagcttggtccagcaagtgagttgccgtgtgattgagtgatactttcttacggcgcaacggatcaacacttagccagtattgctggcctctttccagtttgcccttcaccgtaacggtgtgcagattttggccatttggcgcatgctgcacatcgctcacgtcagctaacaccgtgccgtcttgggccttgatttcgccgtggtccgccacttggccacccatttcagcatagaatggggtctcgtcaaaaatcagttgggcggtaccttcactgacactatcttgcagttgatcattcaccacaatggtctgcaaggaggcgtgcttatgatccaattcggtccagccagtaaatttgcttggcgtagtgatgctcatcagcactttatcttgactgcccatggactgtcgatcaccgcgcgctttgcgggcccgatcacgctgcgcagccatgtttttcttgaagccagccatgtcgacttgcaaaccttcatcttgagcatattcgttggtcatttcaactgggaagccataggtgtcaaagagtttaaacgcatctgctccaggaatttctttcttaccgtcttgtttcaagtcagcaatgatctgattgagcaaggtcacgccggcgtccaaagtctggcggaagcgtgcttcttcagattcaatgaccttttgaataaactgctggttggccagaatctgtgggtaataactcttcatgatctcaccaacaaccggcactaattgatatagaaaatcatgatcaatgcccagctttttaccattcagaaccgcccgacgaattaatcgacgtaaaacatagccgcggccttcattgcttggtaaggcgccatcgccgatcgcaaaggtcactgttcgcgcatggtcggcaatgattttaaaagagacatcatcctgcgcactgacaccatagcgcttgccagcactcattttctcggttgctttgatgattggcatgaacaaatcggtttcaaaaatcgtgggtgtgccttgaataaccgccaccagtcgctccaaacccatgccagtatcaatgttcttatgcggttgttccacaaatcggccatctggcaaatgattcaactcagaaaagacgatgttccagatttcgacataacgcgaattttcgccaccaggataattttctggatcatcttcagccacattattgaattgttggccacgatcatagaaaatttcggaatcgggaccagaaggaccttcaccgatatcccagaaattgtcttccgcctccacaatatgatcgtcaggcaccccagttttctgccaaagttctttcgtgaccttatcttttggatagacggtgacgtataaccgtttaggatcaaatccaaaccattttggactcgtgagcagttcccacgcccaaggaatgacttcttttttgaagtagtcgccaacagaaaagttgccaagcatttcaaagaacgtcaaatgacgagcagttttgccgacattttcaatatcgttcgtccgaattgatttttgggcattggtgatccggggattgtcaggcactactgatccgtcaaaatattttttcagggttgccacgccggaattaatccaaagcagagttggatcatcaacgggaataagtgatgcactcggttcgactgcatggcccttgctcttaaagaaatccagaaacatttggcgaatttcaccactggacatttttttcatcaaaaagttcctccttgtttggtgtccgttataacgcgctcgccgtcgcagaagcctgcacataaggaccttgaccccaaatggccaggcccaggccatttggggtcaagcccgcttatgctccggcttctaaacgctcctgctcgcgctcacaaaataaaaagcaccattgctgccaagggcgcttgcacgcggtaccaccttggttgcaatgatgcgagtcattaccacttcattaattgtcgtttaactaatatcagggagcacatcttagcctgacgcgaccgttctcagctgtgcggtcgtttctgtctcgtgcagggttcaacgcatgtcctaacgaaaactcattatagcttttctgaaaaaaagggtcaacttgttgttgattattgtctcatcctgattgtttagcgcgcattcaaacgccaacgagtacagattctcaatccatcgtaattgtcgccacgcgccgatataaagccgtgcccatgttcccttcgcctgccaactgataaaacggcgacagtgccaaagcttcttttgcggttggttgcgcggatagtggtgtgcttttttgcatcgcttcttggattagctcactgccggatcgcgtaaccggaacagttaggccgaagcgattgggaaggtagcgtggcatgtcggctggcagggtattgccgaatgaaaataggctggtgacacccccgccttgcaagtattcatattgatcttgggttggcaggcggaagccgaagtaactaagtgctttttgcagctcagatttttgccagtttttgctgatgcttacctgataatggtgcgcactggcaagtcgcaggatcaccgatccgctagtcaaagttgctggccagccggattgagaaaacggatcaagactgccatggcggtccagcaaggccagcacttgagcacgaacagccgcgtaggccatatgattgcccttaaaaatacgtgtcgttaaactgactcggcctaaaatctcttcgctcgctggcattgctctcgttgccacgagcatcgctggtatatcaacttgtcgttcaggcgaaagctgatggctcaggtcttgcatggttagtccgctttgccccaaataatcagctaactgcccttgttgatcagccgcaaaacctaagctaacattaggcatccccgggaccaaccgtaaccattccccgccaatcattgcctcgaacgtatgcaaagtttggccaaaaaaagtcaccgtcaacggccgaatatcgtcaacggacaataacggacttagaaagtatcgtgtgagttgctgaaaaataaacttctgccgcgcttcatccagcgtgttccaggtcggcagggtcaggtcgttgactgccatatgctcaccctcgtttgcggttcttgcgtttttctgctaacagcgcttggcgccgagcaattttggtatttcgtttgcgttctaataacaccgcagttcgaatctttttacgataattcggcatgtgcttttgctttgcctttttcaccaaaccgcgaatggcaagactggtgtcttcttgcttcggtttgcggtgaactcgacgattgcggtcataagtgtcgacaagctcaccgtttttgatcattttcggcgcaaacttaatgcccatatgctctaattcggcaatttgatcttcctgtcccggttcgtacagtgtcaccgctgtaccagccatgccattccgaccggttcggcccactcggtgaataaagaactcgttgtcgcgcggaatctcggcattgatgaccattgagacccccttgatatcgataccccgagcagcaagatcagtggcgaccacatactgatatttgaggtcggcaacatccttcatcacgcgccgacgttctcgcggctgaatgccaccatgaatcttagccaccttcaaaccttgatgcttcaagaagtcatggatagcatccacgctggttttggtgttagcaaaaatcagcactaaaaagggatgccccatcgtgacaagctgatagattaactcatttttatcgcgcccttttgccgcaatcaaaatgttttcaaccgtgtcagcaatcaccgactgcggtttcaattcaatcgtcgttggattgtccatgtacttgcgcaagaatggttccagtttttgcggaatagtcgccgaaaaaacagccatttgcagatgatctggaaaactcgaggcaatcgcatcaaccgtttcgaggaagcccatatccagcgtcatgtcagcttcgtcgactacaaaatgacggacagacgatggcactaaatcatagcctttgatcatgtccaagattcgacctggcgttccgatagccacatgtggttgatgattttgcaacttgtcgatctgcttttgcttgtccattcccccgactaaacggttaatccgaatcgcgggctcagtttgtatgagttgctgggcaaccgcataaatttgattggctaactcacgtgaaggggcagtgatcacgacctgagtcgcatcttcggtaggatctaccatactgagtaagggtaccaaaaaggcgtgagttttcccgctaccggtctggctttgtccaacaatgttttcaccacgcaaaagcgccggaataactttttgttgaatgggtgtcggggcggtgatggccattgcattgagaccatcgataacaaaaggttttagttgaaattgtttgaattgattctccataatgcctactttcctgaggtcgaatattctttgaccagttgatcgagttgcgtctcgatttgaatcagttcgtcaaaattagctgccttagcgccgcttgctaatggatgaccaccgccattgtgtgctttggcaagtgtgttgatgatgggaccttttgaacgcagatgaacgcggtaaccgccttctgcctgttcaataaattctgcccaagcaatgacggtatccagtcggccgggtgtgccgacaacagcgcttacctgatcatcagccagtttcagctcgttgatcgcggtccgtggtaccgtcacactggcggcacctgctggggtaattttcagatgatcgacaacatagccttgcaaccgtgcttgtgccaacgtcaccgtgttcatccgattattaatggctgttggatcaaaatcctttttaatcaactcagccgcgacctgcaacgtatgcggggtcgtattgttaaataaaaatcggccggtgtcgccaacaatcccagcgtacattaggcgagcagccttatcgctgagtttcaaaacaccgttgctggcggcgattaaatcgtaaatcagttcagaggcagagctagcgttgttatcgacccaaacaagatcgccatacgcatcatcgttcggatgatgatcgattttgatcagcattttccccttgttgaagcgctcatcagaaactcgcggcgtatcggcagtatcggtcacaatcacgagagcatccttgtaaacgtcatcagtaatggtttgttcctgtgccaaccagctcaaattgccagtgtcactaccaacctgatacactttcttatccggaaaactagcgcgaatggtttctgctaagccaacttgggaacccaacgcatctggatctgggttcacatgacgatggataatgattggatcgtttgccttgatggcgttaataatatcggtttgaatcatcaaaaatcaattcctttctaatagctggcaggtcacaatcgctttagcaacctgaaccccgtcgcttaagacatcaacatccagcgtcgcatcatgcctagtcatctcaagttcacgtaacaagacggtgaccacactttctaactggatgggtcgaaatgttgttaaattcagtccttcgaccaacacgtttcgccgccccgtgtcatgcaaataacgggtagtgcaaccgttaatggcttcagccagcaccccaaaactcatagtgccaagcgaattggtcatggccggcacggttttcaactcgtaaccgccaacgtaaggcggttgcggtgtgatggcggtcagttgagcgctgacctgatcggcaatggtattggatagttcgcgactgtgggcaatgcctgtgagacttgaaaaaaccgcgttgcgggtcacaattcccaacagattccagctatcatccaccaccggcatggccgttaaaccgttatcctgcatggtatgccccacagcagtcacactaaggtaaggtttgacagtttgcggatccttctgcatcaaccgttcaatcggcaccgtcggcttcttaccgccaaccagcgatggccgcatgacgccaaccaatcgcccattgcgcgtcacgaccggcaatggatatcgcggatcgggcaacagcaaataatcaccgaccgtcgcctcaacaccaatggtttgaatttgggccaacggcgtataaatggcagctactgtcaaaatatcctgtttgatcgcctgatctgacaaagctcgattgatcatggttgcaactgtaaaggtatcataagcagtttgcaacacaggcaactgctgatcatccgccaaggcgataatcgccgcactagtttcgaatcccccggtgatcaacaccgcagcaccatcttctagtgccagccgttgtgcatcttcacggtttccgacaatcatcaacgagttacgcgtgatgtaaggccgcatggcagctggtgtcatcgccccgatcacgaatttgtccaatttcttgtccataccggcctgcccgcctaaaactttggcgtcaatcaaatcaaccagtgttttgaatgtcacagattcaattggatttaacggtttttgttcaatccgaatcgtgccgacacgcgcaattgtcgagacaaagccggtattctcggcttccttaatagctcgataagcggttccttcgctgactttcaaatgcttcgcgattgaccgaacggaaatcttcttgccaaccgccaagtttgcgatataatccaaaatctgctcatgctttgtcgccataccatcaccccactgcaatctatcgttagtataccataggttacggctgtactatgacagacgaagcgcgagccaacccggtttctgggttggcgagcgcgttatgggaaaaacgtgcgctaaaccgcattaattagctcaagtagcgcatgccgctacttgagcccctacagcaagcaccccttcgctgtctgtcttcacaacggtaagtccaaattctcatactgcttcggatccaacccggtcacggtaatcccaagtaaccggatggccaagttcgacatggcaacactgccccagagctgccacgctgcatcgaaaatggcttgttcgccttcgaagtagtgatcttgggttagccgctttgtttgcgtgatgaagtccacatcgcgcaccttaagcaccacggttttgccgtgcatagctttttgattcaacgatgtcacgaccatccctgccagattgtgtaactgtgtctgaaccgcctcggcgtcagttagaggcgtgccataggttcgttctttgccaattgacttcgccgtccgaacagcaacaggacgattgtcaacgccacgagcatgttgataaagcacaaatcccattttgccaaacatccggatcaaatcatcttgcgataaggcccgtaaagacttgccatcagtgacacctaagtcggttaacttcggcaacgttttcttaccaaccccgcgaaactgcttgatcggcagccgatccaaaaataataaggcttgttctggcaaaaccagtgtacgaccaaccggtttattgtaatcagaggcttgcttggcgataaatttattgtaggaaatgccaatggaacttgtgagctgcgttgcctgactaatttgatcttgcagccacaatgccaaggcgatcgtactcgggaacatcttgttggccgtgacatcaagataagcttcatcgaacgccactggttcaattagatcggtcacttgatgaaacaaggcgtgaatttgcgcggacactgctttatattttggaaaatccggcgtcttaaacaccagttttgaacgaggcacaagttgcaaggcttcgttggccggcattgccgaatgaacgccataacgtctggcgacatagttggccgttgtcacaacacctttgccgccagttgtacgcggatcccgggcaattaccaaggctttactacgcaattgcggattatcgcgcatctcaattgaagcataaaaggcgtccatatccagatgaatgattttccgggaagtatcgttttgtaatggtaattcaaataacgccatgagcttccccttcctcgtatcaactgttctgttattctttctgtcgcgctagttcacgttcagctttaacgatcaagaccgattctactcggaccacctataacgcgctcgtcagcccagaaacccgggctgactcgcgttcactaaaaaaaggaccctgaccgccttttcgggtcacagtcccttttgtttatctgtgaaagcctagtccgccagtttaattcggcgtggttgccagaaccattggcggccatcacgagctaacaaatcaaacgctgcttgcggacccatcgtggcagccggatatgtcggcatttctgtttcctgtgaccaagctgcttgaatcgcatcgatgaaccgccaagatgccgataactctgaccaatgagtaaagtttgtctgatcgccttcaagcacattattgattaatcgttcatatgcttctggagcagcagcggcggcttccggatcatgacgataccgcaactcatcgggttcaatattaaagcctgtgccaagggccttaccattcaattgcaacgaatagccttcacttggctcgatataaatggtcaagctgtctggttgacttccggtttctcggttgaataacggacttgcgaccggtttaaatgtcagtgtcagctgggttgacttccgagttaaccgtttaccagtgcgaatataaaccggcacaccctcccattgcggcatatctaacataattttgcctgcgacaaaagtggctgtttgtgaatttgctgccacgccttcttcttgccgataacccagcacttggtcgccatctacttcggcgcttgcatattgcgcacgcacaaaattttctttagcagttgcaagatcataaggcttcaaagcggcaaacacttgatccttggccgtcaaaatgtcgttagccgtaaaagtctttggttttggcattgtcagataagacagcacctgcatcacatggttttgcaccatatcacgcaacgcgccggccttttcataataaccagcgcgttcctcaaccccgaccgcctcggaaagtgtgatttgaatattgtcgatgtaatccttgttccagactccttcaaaaatggcattatcaaaccgaaaagccaacagattctgaatcatttctttgccaagataatggtcaattcggaaaatctgatcatcatcgaaggttgcagttaacgaatcgtttagttctttagcactggcataatcatgaccaaacggtttttcgataattaatcggttgaaaccgcgctccgtcagcaaatgttccgatttcagatggctcgcaattgtttcgaagaaatctggtgccatggccatgtaaaagatgcgattgccaccagtcacatactgatcgtccaattttgcagcaagatttttcaaggtaatgtaatgatctgcatcggttacatcatgactctgataaaagaaatgctgggcaaaggcttttgcttggtcacgatccacatcatcgccagcgacggcgttttcaacaacctcgtgataatgatcatcagtccacggacgccgcgctgtgccgatcaccgcaaaatgctcagcgaggacaccacgacggtaaagattaaacagtgcgggatacaacttgcgtgaggctagatctcctgaacctccaaaaataataatcacagcacgtgactcttctggcatgtatacgaccctgctttctctagacttaattacaattcgacaaaaatgtgatcagcacgatctgcatcgaccgccaattcttttccggtacgggctaacttgatgatcacggcatctaaggttttcgcagtcaccgtgaattcatcatccagccgcaggtcaattttaaccgtgtaatcaatcaacgaaacttcatcaatcacgcgttcaatatgcccactttgcccaacatctaacgtgcctaatgtcacccgactttgttggagatagtggccattggcatccggaataacaccgccgtgcggacaatagcgaggttcgcccaacatggctgacaaccgtttggccatttccggcgttaaggcatgttccagtttttctgcttcttgatggaccgcatcagctggatatttaaggcactgaaccagaaacacttcccagagccgatgattacgcaccaaaatggccgcctttttccggccagctgatgtcagctggataccttgataaggcgtgtgcgcaaccagtttttcttcgcccagtttgttgatcatctcactgaccgaagcagcagaaacatgcataccggcaacgatttgtttattagagaccagctgtgtatcgccgccaatctcaaaaatcaatttaagataatcctctttattcggtgtcattttacatccttacttttaatttgcagtcactgtactccattatgccatgagtcacacaaaaaaacacgccaatttactgacgtgtttttcgtgatcggctcaaataatgtcgccattgaattctctgcgccgatcattgtgaaatgattagcagcaaacatcttagaaagtggattcggtgccttcatattcatcaaggatgatatgcttcaagtcgccgattaacggttcctgcgggttggtaacggtgcagttatcttcataagccagttcggcaagacgatcaacttgcttgtcgagatcagcctttttaacgccttgttccttcaaactgagcttgacgccaacactgtgagccagcttgatgaaggcctgaacatagctttcaaccaattcatcagttgtcttgccaggaaggccgaggtagcgagcgatttctgcgtagtcttcgttagcgcggaagtagctatacttcgcccagatagcgcgcttcttcggttgactcgcattgaagcgaataacatgtggcatcgtgatcgcgatgcaacgaccgtgaggcagatggaacgcttgcccaatcttatgcgcaatgctgtggttaatgcccaacagtgcgttggcaaaggccatcccagcaatggttgaagcgtcatgcatctttgactttgcttcgacgtcgccatgataactcttttccagattttcgaagaccaacttgattgcttccaaactcaggcccttagtgtaatgagtggccatggttgaaacataactttcggttgcgtggcagagcacatccaaaccggaatcagcgacaaccactggcggtacggattcgatgaactgactgtccacaatcgcgatgtctggcgtcaatgcatagtcagctaacggatacttgatgccagccttggaatcggtgataaccgcaaaaggtgttacttctgaaccagtcccagaagttgttggaatgcagacaagctttgtcttattcagattcgggaaggtgtaagtccgcttccggatatccaagaatttctgcttagcgccgaagaaatcagcatccccggcatcgttgaacaagcacatccctttggcagcatccataacagacccgccgccgatagcaatgacggtatccggtccaaatgagcgcatgatatcggtccccttgaagaccgtgtcagttgatggatcaggttcaacatcgacaaaagtctgaacttgaacaggattttcacgccgagccagaacatcttcaacgatcttgacgaagcctaacttttccatgcttcgatcagcaacgatgaaggcccgtttgatgccttccatgtgttcgaggtaacgaacagaattcttttcaaaatagatctttggtggcaatttcatccactgcatgttattgcggcgttttgccattgtcttgatgttaagcaagtcgaccgtccccacgttatgcgaaattgagttaccaccgtatgagccgcagcccagtgtcaaacttggaatcatttcgttgtaaagatcgccaatcccgccgacagaagatggtgtgttgatcaaaatccggcaagcttgcatagcatcggcatacttcaaagctaactcatcatcagccgtgtgaatgactgccgtatgacccaaaccgccgatatcaagcatggtttcacatttcttgaaggcatcttcatgaccatctgctttgaccatggccagtactggacttagtttttcacgagacagtggatacttttcgccaacacctttcaattcagcaatcagaatcgtggtgttatcaggaatcgtgatccccgcccattcagcaatctgcttaggactttgaccaacgattcgcggattgacactttgcttttcaagattaatgacggtactttcgaacttcttcatgtccttctgtttaacgaagtaagcaccttgggcttcaaattccttcttcacatcatcgtaaatgctggaatcaataatcacgccttgttcggaagcacagatcatgccattatcaaaactctttgaaagtactaagtcattgacagcttgtttgatgttagcgctggcttcaatgtaagctggcgcattcccggccccaacacccagtgctggcttgcctgatgaataggcggacttaaccatgccaggaccgcccgttgccaaaatcgtggcgataccagggtgatccatcaaagctttagtcgcatccatacttggtacagggatatattgcaaagcaccctttggtaagcctgctttttcggcttcatcacggatgacctccaacgcacgcgctgaagacttttgggcacccggatggaaggcgaaaatgattggattacgggttttaatggcaatttcggatttgaacatggtcgttgaagttgggttcgtcactggggtcacaccagcgataacaccaattggttcagcaatcgataccaagccgcgttgcttgtcttcattgatcacaccaacggtcttgttgttcttgattgaatgccaaatttcttcagtggcgaacatgttcttgatcgctttatcttcccacacgcctcggcccgtctcgtcaacagcgagttttgccaattccatatgatgatccaaaccagcgattgccatccgatgaacgatgtgatcgatcttttcttgatcgaaagttttcatgatcttcaaagcggcatgcgcattcgcaaccaattcgtcaaccatactcttaacatcaacttcggtagcagtcttcgcagtattctttaacatgagcttacctccaagtgttttgcggaattttttgttaaccatttcacaagaacatcataaccggtctttgtgattttgtaaacaattttggtgaattttttcacgaaaaatcgacttgctcactgatattgttgtgttcattgactttaattgcttatttcactttgtatttttttgaactattaaggcaaatttgcagtttttttctgacttagaggtcttttaaagtcatttatcaaaaaagaacgcggtgttttgacatctccccgtgataggcgccaatccgctcttaaaacgcaaaaaaagagaaggctaaacaccttcccttacgtcacctatattgaattctctatcagatgacgaatctatttgtcgtcttctgccttgctatcacttttggcatcggtttgatcgtcagcctttggtgcagcctcttcaactggtttagcttcgcgttgttcatcagtattatgtgcttcttcagcctttgtcacggtagcggctggtgcaggcgctgcaggacgagttgctgtgccgcgaacagcactcaagttaaaggtcaaatagatgccgtcagaatcaatgacaaccgtcccagcttgctggtcgattgaatcaatgacaccgtgcaacccaccgatcgtgatgatggggtcgccttttttaagctgattcaacatttcttgacgcttttgctgttgtttcttttgcggacgaaccatgccaaaatacatgaagcccacgaaaatcagcagcataatgatcattgtcatattaccattcaatttaggcacctcttatttttattttgtcaacaaacagtgtaacagaattaggcggtctactccaaataatctaaaaattctttgctttttccttgttgtatccgtaagcttcaaagaaatcttcacggaaagccagcaaatcatcattggcaatcgcttcacgcacttgctgcatcaagtgcagtaagaagtagagattatggtaggtcgtcaaccgaataccgaaagcttcaccaacatggatcagatggcgaatataggcgcggctatagttacgacacgtgtagcaatcgcaattaggatccaacggtccaaagtcatgcgcatatttcgcatttttaatgacgagccggccacggctggtcatgcaagtaccatttcgggcaatccgagttggtaagacgcagtcaaacatatcaatgccacgcaaggcgccatcaatcagcgcatccgcagagccgacacccatcaaatagcgcggtttgttttccggcagcagcggggtagtgaaatcaaggacatggttcatctcatcttttgattcaccaacagacaagccaccaatcgaataaccaggaaaatccatgctaacaagatccttagcactttgctcgcgcaagtctttgaatccggcaccttgcacaataccaaaaagcgcctgccaatcaggattcttgtgagcctgcaagccacgttcagcccaacgactggttcgagcaacactctttttaacataatcatagctttcaaaaaacggcggacattcatccaaactcatcatgatgtcaggtcccaacgcgttttcaattgcgatcgccttttctggggacaggaacatcttggcaccattcaaatgatttttgaaagtgacaccttcttcagtaatatgtctagtgtcggctagcgaaaagacttgaaagccacctgagtcagtcaggatacctttgtgccagttcataaacttgtgcaaaccgcccgcttcttcaatcagttctggccccggccgtaaccacagatgatacgtgttcgccaagataacagtggcccccatcgtatccaattcttcaggcgccattgttttcacgctcgcctgtgtgccaacaggcataaacattggggttggaaatgtgccgtgcggcgtgatcaattcacccaaccgcgcaccgctatgcttgtcctgatgaatcagacgatacttaactgctggttccatacattctcctcattcatggcaatgccctcgcagcaccgccgcttgattttctcgtgacgtcagtttaacagagttacttgttatttaaaagtaagtgcatgcatatcatgattgacttaaccttcaagaaagtccgagctttccgcttttctcataccatcttccctgttagaatgaagttaaggacgggatcaccgttaccgtagttttcgcacttcccgggttttgacccggccattgtgatcgcctatgaatacgttgttccacgcagcgatgcgttaaaagaaaaatcgagacatgtctgttggtatgtgttgatgtgatcccgtccgttaaaaaatcggcttgcttaaatgcaagccgattttttagtgagcgcgaataagttgctgcgtcggtaaacacgctaaagtgagcagaaactagcttcgtgattagtaaatgaacatcgcatcgccaaagctgaagaagcgatatttttcgtcgatcgcatgcttatacgcatttaaaattgtatcgcgcccggtgaacgctgccacgagcataactaacgttgactttggcaaatggaagttggtgataaacgcatcaacaaccttccactgataccctggcttgataaaaatgtcagtccaacccgaatctgccttgatggcaccatcaaatttggtaccgatggcctcgagggtgcgaatggatgtcgtaccggtagcaataattcgaccgccattgtcgcgaacatcattcaaagttgctgctgcttctggagtcaaccgataaaattcactgtgcattttatgtgcttcgatgttttcctcaactactggccggaaagtacccaagccaacatgcaacgtcaagtaaaccaacttgacgcccttttcttgcacttttttcagcaagtctttggtccagtgaagaccggctgttggtgccgctgcagagcctagctctttagaataaacagtttgatacatttctggatcttcaagcttttccttgatgtaaggcggcaatggcgtctcgcctaacttatcgaggatttccataaagatgccgtcatagtcaaagtgaatcattcgaccgccatgttcgagttccttggtaactctggcctttagtaagccatcgccaaaatcaatcaccgtgccaaccggagccttgcgcgcaggcttcatcaaggtttcccaatcatcaccagacgtgttgttaagcaataacacttccatatgggcaccagtctctggcttaaccccatacaatcgcgctggcatcacccgcgtatcattcatgaccaacgcatcacctggcttgaaataatcaagaatgtcgtaaaaatgcttatcttgcatctcaccagtttcagaatttaataccaacagccgactggcatcacgttccttcaaaggtgtctgcgcaatcaattcatgcggcaggtcataatcgaaatccgatagctgataatgtttgtcttctactttgtgataacgtttgttctcttgcaccatattcgcttccattcattttaatcagtgagcgcgagccagcgcggttagcaaccggaatgtaagcggccttggacgtgatggtcgctttttgaccattgcgaccaaggtccttacatgcaggttgctgcgctggggagcgcgttatagctgagcgcgagcaggagcgcttagaagccggagcataagtgggcttgagtcaaaatggcccgatcttggtcgttttgactcaaggtccttatgtgcaggcttctgcgactgcgagcacgttatagttgagcgcgagccagcgcggttagcaaccggaatgtaagcggccttggacgtgatggtcgctttttgaccattgcgaccaaggtccttacatgcaggttgctgcgctggggagcgcgttatagttgagcgcgagccagcgcggttagcatgttgcctaatgttgctcagccgacatccccatatgtgcaaatccggctggcgtcaccatgcggccacgcggcgttcgtttcaaatacccgatctgtaacagataaggctcatacatttcctcaatcgttgccatttcctcgccgatgttagcggcaatcgttgagagtccaacggggccgccttcgtaatcacgaatcatgaacatcaacagtttgcgatcaatttggtctaagccttgctgatcgacttgcagctggtcaagcgcatggtcaaccatttgtatatcaactggactctgccccgcaacttcggcaaaatcacggatacgtttgagcagccgattagcaacccgcggtgttccccgcgaccgtcgggcaatttcatgagcaccttcagcatcaatcgccatatcgaaaattgttgctgatcgtttgacgatctcactgaggtcatcagcagaataatacgccatatgttcactgatgccaaatcgatcacgtaacggagcggaaagcatgccagcgcgcgttgtcgccccaattaaggtgaagggaggaagcgggaaatgcacagggtgggcggttggcccttgaccaaccacaatatcaatataaaaatcttccatcgctgaataaagcatttcttcgacaatttttggtagacggtgaatttcatcaatgaacaagacatcaccgggatgcaattcattcagcagtgccactaaatcacccggtttttcgatagcaggccctgatgtcgtgcgaatattgacgcccagttcattggcaatcaccaaagccaacgtcgtttttcccaaaccaggcggtccatagagcagaacatgatccaatgactcttcgcgctgtttggcagccgtgatatagacttccaactgatgtttgacgcgatcctgaccaatatactgcgcgagcatccggggacgtaaacttttttcgatctgtgcttcattcgaatcgtcaacgtcgccagaaaccaagcgatccttgtctgcgtctgccaaaagcccacttcctctctagttaacatgctattaaaagcacgggaaaaattttatcgtgattcaaaagccgcttccgttgtcgtcaacggtcagcttcagtataatcaagcctaagccttgccgcttaatagccgcaagccttcgcgtaaataggcatcagttgtcttggcactgaatgccttcagtgtgtcagtgagaccatcaacggtgcgttgcgggtagcccaatgccacgagtgccgctaacgcatctgcaagttccgaatcaacgtcactggcaactggtgcaatcgctgctgccgctggttgtccatctgttgtgattttacctttgagatcaaggataatctgggcagctgttttcttaccgatcccaggaaacttagtcaaaaacttcacatcatcttgagcaatcgcagtcgccaagccgccgctagacacgttcgccaaaatggccaacgctgacttcgggccaatgcctgtgaccgtcaatagctggttaaaggtacgcttatccgcagcaccttcgaatccataaagtgtctggtcgttgtcgcgaatgatcagctgcacataaacacgtttttgctcgccagcttcaaaatgataaggattggctaccagcagacggaacccgatgccatgcacatcgatgacgatgtaagccggggtcaccgcctgaataatgccttcaaaatactcgtacataagctctccattcagtacgtatgtttggtatgcttgattcattgtagcatagatgttttcctgatgatgaactgttctgaggccaaaaatagatgaatccaaaaaatgtgcgtcgtctgattaattttgccaccatcgttgttgttatcttattagcagcagtagccatttactggtatgacttaggtattctttcaaacatcaatgctctgcaggcttacattgctcgcctcggaatagccggcgctttattttttatgctcattcaagtcattcaggttgtcatcccgatcattcctggcggtgtcagtacggcggctggcgtgattttgtttggcccatggacaggctttttttacaactacatcggtattgcaattggctcgtttatcaatttccatcttgctcggcgatttggtaagccgctgcttacttatctgatctctgaaaaaacctataacaaatacatcggctataccaaaaatcagcaacgctttgatcgctttttcacgcttgctatcattttaccggttgctcctgacgacgttttgtgtctgcttgccgggttaactaaaatgacctttaaaaagtttttttggatcattattttaggcaaacctatcacgatcctcgcctacagtatgagtttgatttatggcgggcaatggctaatccacttatttcaataatccttcgaacatgaaaatggcactgtcaaactcatttagcgagttatagcagtgccatttttatgcggcaattttgagctggtgggattgaaaccaagcctcagacaacctgacgcgtgtacgggtcatttgaaatgccgcggctcaaaattaacttcgcccactcctttgctgaaaacaggctgtgatccttgtaattgccacaactcttgatgtcaacaccagggacgtcatcccaagtaatgtcattggcaatggcctctaagcttgacttcaaagccttggccacttcggttgtgctgtgctcaccccaagtaatcaagtggaaaccggtgcggcagccgaatggtgaacaatcaataacgccgtccatccgatcgcgcaataacgatgccagcaagtgttcaatcgtgtgcaagccagccgtatcaatggctgctgtgtttggttgtaccaaccgcaaatcatagtttgaaattacatcaccctttgcaccatgctctgtcgtaatcaaccgaacataaggtgctttaacagctgtgtgatccaaggtgaaactttcaacttttgccataatatagaaatctcccttttagttttgatgacacatttatcatataacacaacagtggtatctgttaaaaaaatctgagcgcgagcaggagcgctcagaagccgaaacataagtgaaaaaacaatctaagcatccgcccaaactcgcttggcaattttttgaaccagagccagtttcgcccactggtcatcttcagtaaccttgttaccttcttcggttgaagcaaaaccgcattgagtggacaacgccagattcgtcagcggtacgtactcagtcgcagcgttaattctcttgataacggcatcctcatcttccaattcaggaaacttcgaagtaatcaggcctaggacaatgcgcttattagtatcgccgtgccacaactttgttaacggttcaaaagaccccgaacgctgattatcatactctaggaataagccgtcatacggcaaatcaccgatgtaatctgccacatattgatacccgccggaaaacaggaatgtcgactggaaattgccgcgacagatatgcgacgtcacggtcaagtcttctggcagtttcaccaaaaccgccttgatcacgcggtgtgccaatttagcgaggtcaataaaccgctgatgcgccttgggatcattttcagtatcttttagattctgaatcaagtaggcccagttagtatcgtcaatttgaagatagcgggcacctaaatcatagaaatgttgaatcgtatccacataggcttggacaacgtcagccaaataatcatcaaatctgtcataatattttgcccagttatcgctgcgatggtcacgaaagagcaatgcaggactcgggatggtctgtttggggagaaccccttctggcacaatgctctgcaaatacttaaaggcggcaaaaaatgggtgatcaggattgaagctgactttcccagcaagatgcacattagctgctgcgttaatgccgcctttgaagtcgtgttcatactgccaactatcatctttttcaaaaccgttcaagccccataaaaagtctagatgccaataacggcgggagaactcaccatccgtcacagctttgaaaccaagttcaacttgtcgtttgacaatacgctcaatggctgcgtgttgaatgttgagttcctgatcttgtttaatttcaccgatcgcaagttgttgatgcgccgcttttaagcgttcaggccgaagcaagctgccgactaaatcggcccggaaaggagcttttatttgaactttttctgtcatgatggtggtcctccttatttttcgtcgacagacgcagtgatggcttttgcggaaagaatgttgggagggggcggtgcttacgatggcttggaaagtgggtttgggctggctcgcgctcacaaaaaaaagccgccccttgaccatttctgatcaaggggcgactttgcgcgttaccacccttattcgcactggttttgatgccaatgcctcaacggtaccaattttgatacccggcatggtaacgggtgcgcccgtttcagtggcgtgaaccgctgaaaagctgtttggagctcatcttccctgattaactgatcgcctgctttcactgttcaggctcgcttgtgatctgcgcttcaggtactcttctccgcaaagcaatctgtctgtctaagttggcattatcataacaccgccaatcaaactgtcaagaataacttctgtcatgttctgtttctggtatgcttttggtagttacttttttggaggtgtctcatgggaacaactttttatgcttacagcgtcttaactcgccaaactacttggcaaagtaccttccgttacatcatcatcatggcaggagctgttgtgattgtcgcctatctcatctattttttgcgccacaaacacacaaacaaatatcgcgatctattgattttagttgcgttgattgaactattaaccatcggcattcaaattcgtgatctgcaagcgagccgcaccgcaaccgctgattcacaggcagtcgcgacactgttgcgcagtgttgccaagcaaaaacaggtgggtgtgcaacaagtctatgctaacagcaacacagttcacactggcatgctcgtcaccatcggtaagtcaacgaaaaccatgtttacggtgacgatcaatgcggacaacaatagctaccagctagataaaaccaccttgattgtgcctcaagcaaactttgtgactaagtaggaggctgtcatgcaactttttagagatccatatttcatcacggcaatgaaactcttgctaggctttattgtgttcgttgcccaaatcaagctcaccggcaaaggtaaccttgccccagcaacgattgttgatcaaatgcagaattacgtccttggcggtattatcggcggggtgatttacaatactgatatcggcttgctccaatttgtaaacgtactgctgatttggacactcattgttttcagttcgaaatacttaactaaccataaccgttggatcaagcgtctgattgacggcgagcctttattggtcgtgcagcatggcaaaattcgtgtagagacggcgactcaagtcggtctttcggcaaatgatttggcttacaaattacgaactgctggcgtaaacgatcttcgcgatgttcggcaagcctatctagaacaaaatggtcagcttaatgtcatcctcaaaggcgatgaaaccatcaaatacccgttgattctagatggccagattgatcccgccgcacttgatgccattgatcatgatgaagactggctgaaagcacagctacaggagcaaggctatgaaactggcgacgtttacatggccaactatcttagtggcaaagtcgttgtcacgccgtacgaccctaacaaaaactagcgcatgccctcaccaaataaaattatcaaccgccttagccacctgcggattttcatgaagcgcactatgctgcgcttttttgccaacaaattctttttcttgataactggcggcgcgcccttcaactaagtactgcaatgagcgcgatgaattgtttgcgacacgaccgtctgagtctgaaccatcatccacatcgccataaatattcaaaacctttacattttttggaaaacgatcgcgcattctggctaacgtggcataattctcatccggcggcgtcggataaccgtttggagcaagtttaatacgatgaggctcatcgcccatgccgataataccgtcaaaatggccagcaatcgccacgtaagcccgcatttttggcaatttagggtgatctgagttttgagttgcatagaacatcactgccatattgcccatcgaatgggccacaaagttgacctggcgaacgccgtaacgttgataaagttcgcgattaatggtcgtcaaccaacccgctagcttggcgtaatccggattgacattatcctgaaaaatcacctgaacaatcggcttgctgacatgccgtgcatttccttgccagctaactttaccatttttagcgacagtggccgtgagcaccttagttgcgccagactgctcagcatgtcgaatcaaggtattagtcgagccagcaccccctgaatagccatgcaagtatagagttgcggtttgaccaatcgtcgttttctctgtcgtcggtgtatcggtgggttgttcctgataccagtaccaacccgctccagcgataaccacaaccgccgcaaatacgataacaacccagcgttttattttcataaagcactcctttcagccgttaataagtcatcgtcctcagcctgagcgcgcgggaaaaagtggctcacacccgcaacaagcaaaccgatgataatcgtccatcctgcgacgcgctgccataatggcgagtaagccagaatcagatcacgtgtcagttgttgattaatcgcaatgcgtgatacgacagcacctaagaaaggattcgcggtgacaaacatggccatgaatccgccaatatatcccatgacataggtcgaacgaccagttactgctaagaaacgccgccatgaatgagcggttttgatcataatgagcaaaacaaaggccatcaggatcgccgcgacaatcacagctgtttgcgtcatcaaaaccagcaatggataaactaatccccagccttgtgccatcacgtgtaaattaatttcgcgctcaagcgttgttttcaagctggcgagtacttttttttgatcaaaattttgatgctgcacagtcgctgccgtttgtaagcgacttgtgacactctcttcaatggtcgtcaacgaaacatgtggctgatgtagtgaactggccgccaccatattcttagccagtctctgggtatcatctgtagtgacgagcactgttcttttatccaatgatgccccacttttcgctgcagctgttaacaactgctgattcaacgtttgcgtcaattgatctaggcctttactcttgacgataaccgcctcggtccgcactggtgagccaattgtgagcatcatccctgtactaaaagcttcgacaaataataatacccaaaaaatcatcgtgaatagtgcaaaccagcttcgtgaaacggctcgccattgttgtgttttcgtgataatcccctctttgtaaacgcgtaaaactcctaccagcacagaaactagactggtttgcgcgctatcttttggctttattatacacgaaggtttgtcgatgcttgtatgcatgactaggtttggactacactatatatagtgttgtgcagcttaaaaaagcggacgcagcgacgtataggaactgttgaactgatgaatttggtttcttaactgattggtccgagcacttattcaatcccatcagctagtcatctgtgtcttgtttgactatgagcacatcttaaaggaggttcacaagaatgaattacaccttaaacgacggcaacgtcctaccagcaatcggttttggcacctacaaacttaatggtgctactggcgttcgagcaatggtgggagccgtcaatgtcggctatcgcatgttggatgccgcttttaactacgaaaatgaaggtgccgttggtgaggccgttcgccaaagcggcattccgcgcagtcagttaacgattgcttcaaaactgccaggtcgtcatcatcgttatcaagaagccatcgataccatcgaagaaagtctttatcgtgctggtttggattattacgatctctatttaattcactggccaaatcctaaagaggatctttacgtggaagcttggcaggccttgattcaggcacaacggtttggattggttcgctcaattggcgtttcaaactttttgcctgagcatattgatcggctaattaaagaaaccgacgtgacgccagctgttaatcaaattgagttgcatccttacttcaaccaacaagcgcaacgtgagtatgacgcagagcacaatatccaaacagttgcttggagtccattgggtcgcggcgcggttttacaggaaccaagcatcaaaaagattgctgcggcacacggtaaaaatgtcggtcaggttatcttacgctgggatctgcaacatcagatcttaccgattccaaagtccgcacaccttgcccgtcaacgcaccaatcttgatgtgtttgactttacactaacgaacgaagaaatggccgccattgacagtctgacaaaaccggatggtcggctcaaggatcaagatccggcagtttatcaagaattctaacgccgcaaaaaagagccgtggtgcaagcacttggctgctgtaccgcgactctttttagctgttcttcgtttggcatatcggcaaaaagcaagcgactgcaaaggcttgtgccatgctcacaatcatgaaaagaggccatcacaatgactgaacctatccacgttttatttatttctatttctggcaatactcgggcttttgcccatcgcttggcagcctatgcacaaacgcaacatgatcaggatgctgctaatccaacaattgtgctgaaagaaatttctgatgccacacaaagtgacggtgaaaccaaaccattttttgtcatggtgccgacttatcttgacggcggtaatggtattgataacggcgtcaaggagttgatgaccactgccatgggtgactatctggcagaaggcgaaaacgctgatcaatgcattggcatcattggttccggcaatcgtaactttaacgaacaatactgtctcacggctaaacgctatgccaaagaattcgatgcgcccttcttggccgattacgaattacgcggaaccccaagtgatgctgagaaaatctacgcgattttaaagcgggttgctgccaccaatgccgcccagtaacgttgcgcttcaccagtttgcgttaaaccagccaacaactcgcttgctgtaggcttgctgatgatcaggaaaactcttcgcgtgccctgcccctttaacgacccacaaggccttcttcgattttgtggctgctcggtagttttgatacaccatgctggttggtacaaacttatccttgctgccgtgactaaacaaaatggggcgggtatttttgtgcaacgcggtgatggcactggcatcaaatacgttataaccggctttgatcgtggctgtcagtgccactgacggaatcagcggccatttaggcagattgaacattgctttggcttgataagtcagttcatcaataatactggtatagccacaatcttcgacaatacttttgacttgggatggcaatttttcgccactcagatacatcactgttgcgccgcccatggagacgccatacaacgcgatttgactttgctggccctgtttcttgatgatttgattgatccacttcaaataatccagccgatctggccagccgtacccgatgtagttcccttgcgattgtccatggccgcgatcatctggggccaaaacattaaaccctgcatcatgaaacattttgatttgcggcgccatgaattctttggtgttcatgtacccgtgagcgaccaccaccgttttgttcgttggtttcgccgctggcacatagtcggcaaccaggttcaaatcggcaccagccgccttttcggtccacgtttccttatgaacgcttttaagccacgccttaccgtccttgacaattcgactttcgccaccactcaaaaaagatttttttgatggcacaaatgcatattggtagaaatacagactggcgccaactaatcccataagcagaacaccgaagattgataacagcccaatcagccaagcttttttatgttttcgcacactaatagcctccataagtagttaaagccctttacataactaaaaagtgtaccgcaacttttaataatttcaagttacagttgcggtatgatttgttaagataaactttggaggaagaaagatgactgatgaatctttgctacaggcatatgtggatgcctatttttcaacattcaaaagtattaatgagctaatctcggcaccgatggcaaaataccatcttagttttgaacaatttcggattctatctgatattgcccatgatcccgatattagcctgactgccattgtcgccaaacgaggcgtcacgaaaccggccgtggcccgccaactgcgcgtactgcgcaatctcaattacgtgacccagaccaagtttgcagctgaccgtcggcgtaacactctacgattaacgccgcttggaaaacaagttgaggcggagatcactaaaactgctactgatcgcttcgatcagtgggttactgcacttggcgaggacaaagccaaacagtttgttgacttgctcaatgaaattggtgagaaactgattcatccccaacaaacttctgaggacaatcaataattcggtatctcgtgccagacaaaaaagacgtgccatttacaggcacgtcttttttgtctggttccttaatcaagcttgattagggcactattttgcgttgatctttgctagcttcgccagtcctgcaggaatatctgcaggttgatcaactaagactttggcaccggcttcttttagttctttagcagaaccaaagccgtacgtcacacccagcaattgaacatgattggccttgccaccaatcatatcattggcccgatcaccaatcatgacactttgatcgagcgcaacttgactgtcttttagcgcataggtcaaaatatcggttttcgtgacccgggtttcctcatcgtcacttgcaccgtacgcaccagcaaaatattggtccaacgaaaagtgctttacaaggcgatgcagcattgtttctggcttagcagaggcaatgtaaagttggttgtcttgttgcttgagctttgccatcgtgtccagaaaattaggatacaattcaacctgataaaggccttcctcttcgtaataatgatggaaagcatcaatggcccgcttaacttcaatgtcatcaagttctggccaaaccttgggaagcatatcaatcagcgctggtccgataaattgcgtgtaggccgaattgtccagcggccgcaatccgcgatcctgagccatatattttaatcctgcaacgataccgacttccgaatcagcaacggtgccatcaaagtcaaaaaacaaattagccatttgaatccccctcataaacgcggccgccagtcccgcaatgattgcccagtcaacacatttttaagaactcgcacgcacgctcggctttatgtcgcgttaaatagacgcgcatctttattatacaggttcctgttcacgccgtagcgcatctttcaagataattggggcaatcaatgtcgtcaggacaatcacaacaataaccgccgagtaatattcagcgtccatgagtttggcctcgaacccaatttgggcgacaatcaatgccatctcgccacgagaaaccatgccggcacccacgacattactctgtagccaactcgcaccggccaaacgatcaccaaccccacagccgacccattttgtgactaaggctaataaggtcaaaatcgcaataaaccctagatcgcggccaaaggtatcaaaccgcatattcaagccgacactgacaaagaacaccggaataaacacggcatacccaatcgcactcaaactaccatccacttcatggcgatgacgtgtctggcctactgccacgccagcgaagaaagcgccgataacggcggacattcctacaagatcagccagataggccataccgaggcaaatgagcagagacataatggtcacagccgacgacggaaacattttttctgccaaacccattaagtatggcgcagcccacctgacaaccaaataaatgccgacaaagtagagcaactgttcaatgatttgcacccagaaaggcaaactcgcggtcttttgctcaccaaggactgctaccgtgaaacttaaaatgaggacagtgagaatatcatcaaccaccgccgcaccgagaatggtcgcaccatttcggccttctagggcatgtagctcttttaaaacctcaacagagatcgaaacagaagtagcggcaaaggtaatgcctaagaatagactgcttgtcatgttgaagccccaactgcgtccaaaaacgaacacaacagccaccggtacaatgacgccgatcatggcgaccaacatgcctggtttgaagtatttttttaataaatcaaggtcactttccaagccagcaagaaacatcaaaataatgacaccaatctccgcaaataatgaaatcgtgtgacttggtgccaaccagcccaataacgccggtccaatcaaaataccagccaataattccccaatgacagcgggcatattcaacaatcggcttaaatgcgctaaaacaagcgttgtgactaagatcagtgccaagttgccaatgtcctgcatgtcgatctcctccatttcgtgtctttctgttagtgtgccaaacgaacctcataagcattgcgttcaggaaccggttcatccatgtaaacaatgccgcgatattcgaagcccattccggtgatggcatgctgcatgatcacattttgggcatgcgtatccacgcgcaggtcatagacaccgcgtcgataggcttcactcataatattactaaagaaaactttacttaattgatgaccacgaatgctgccatcaagcgcaaatcgatgaactgccaaatagggcacatcggccaaccaaccagcaccatcaattttgagataatgcggatcaggcccttccaccaaagcggctatgccggcaacctgcccatcaacgaccaaaactcgcccgatgcctgtcgctacatcttgttcaaccgcagcctgatcgggataggttccttgccattgtgaaataccttgttcgcctaaaaattgccgagcagaagcaataatcttcatcatcgcgggaatatcttctcgggtagcagtacgcatcaacataactggcatcaacatcatctcctaaattatcgtgcacccattgtcccgcatcttgtcgcccgtttcaatgacggcgcataaaagtgcgcggcagtttttgtggttaataatatgtaaaaaaatgggcaaaaaatttttttacatacggctctggacacggcgataaacatgttcacaggtgaaaaatcaacacgtaaagctgcgcatacttaagcaaaaaagcctgagcaatagataattgctcaggcttttggtctattcatgtatcaaatcaacctaatgccgacgatgggcgtgacgatttttaccagccggtttctccaaatattctggagcaaaaacatcctgctcgccgcgatgttctggcgccagccgccaattacgccgaccatgatgatgtttatgcatctccagcttcaagctcaactgcttcgtgcgctctttttcggcacgcagtttctggtgaccccgaatgatagcaatcccgccaccaagtgtcagagcaattggaatcaagtgaacaactgccaatggaatgattaaatccggctgttgttccaatgcccgatcaaacgctcgtacaggttcgaacaagcttgtttttaattcatcatattcagacatgcaagcacctccatattttgaaaaacttaccttaccattcttattataacgttatttagaatgaaaagccgtcttcgtgtcggttttgaccagccaatcacctaaatgactgaaatagtcagtggggttatccagcatttgtccatgaccagcattcggcgtgacatgtaaggtagcgtctgggattgtcttcgccatgcgttccgcggctgccagcggcatcgtttcatgaccgccgaacgtcaggtaggtgggtacggcgatacggtggatatctgcacgccgatcccaatctttaagcgcacccaccatcacaaattcattgtcgccttgaaaataattgtaaactggcgtggccagcgtactgattaagtgacgcggctggggatcttttgcatgatgcaagtagtgttcgcctagctcacttacaagcgcctgatattttgcatcatcgaacgcgtgctgctgttcaatttgctgcatgtaagcgacatcttcttttgaaaacatagtttcccgaatccgattgatgttcacaatatattcgtcaagattgtcaatcatcgaactcagaatgactccgttaagatgctctggatatttcaatgcatattcaattgccagcacaccgccccacgattgaccaagcagataaaagtggtcaatcccaagctgctgtcgaacctgctccacttcgctcagatagtaatcaatgttcagaaactgctgacgatttgccggatcggagaaatccggctggtcggagtaaaatgaccccaactgatcataacgggtcacgcgcacaccataaggcgctagccgctcagcaaaattttcaaagacttcattggtgccgcctgggccaccatgcaaggtcatgagatggatatcacctttcccttgcgtctgtgtccacaaatggtacccactcgataacgtgatgaattgcgtcccgtctggattaagttttggcatacaaccgcttctttcttgtcgtttgtcttccattatgcgagtttcgtggttgatgaacaacattaagccacttcgcaatcttataagactcttcaaagtttaataaaaacaggtcgcttattcgtcatctaccgggattgattggtaaaatgaatgaaaagtattggagggcatgcgatggctgagcagaacattttgccggatcagggattatcaacaaagcaagttgaagagcggtttgccgcgggtcaacataacttgccgttaaaaccattaacgcgatcaattagccaaattatcaaagtaaatacgttcaccttatttaacttggtgaacgtggttttaggtgctttgattgtgacaacgggcagttataagaacttactctttctcggtgtcgcgatcatcaacacagcgatcgggaccattcaagaaattcaggcgaagcaccagattgataaaatgtcaattttggcagctgctcgagccatcgtcattcgtgatggcaaaacacaaaaaatcgagcttgaacaattggttatggatgacatggtgcacctgaaacgcggtgatcagattcctgtcgatggtgtggttgtcgcaacgaatggtctcgaaagtgacgagagtcctttaactggtgagtctcgacccatcactaaaaaagtgggcgacaagctgctttctggcgcatttatcgtttccggtcaggcaaccatgcaggtcaccgcagttggcgccgcaacttttgcggcaaagcttgctttggcagccaaagccgaaaaaggtagcaaaagtcaactgttggcaacgatcaatcgcatcattcgcgtgttaacttatgtgcttatcccgattggcgcaattcttttcaccgtctcgatgatccgccgaggcaactataatcgggctattttaacaaccagtgccgccatgatcggcatgattcctgaaggtctggttttgctaacaaatgtggcactagccgtatccgcccgcaatcttgccgttaaacgagttctcgttcgcgccttgccggccattgaagcactcgcacgagttgatactatctgtcttgacaaaaccggtactatcacgagtggcaaacttaaagtcgccgaaacattgccgatgattgggcaaactgaagcgacagtcaccaaagccgccgccgctattgtttatgctctaaatgacgacaacgaaacagcaatggccatcaaagccgccttccaaaacgataccaatcagcaagtcacgcagacaatgcccttctcctctgcgcgtaagtggtcgggtgccgttgttgatggtcaagtattgtttatgggcgccccgcagttcacattcggcgatcaattaccaacaccgattgcaaatcaaattaaggatgcagctgctaagggctaccgggttttagccattggcacagcaaccaaattagtgcatccgttggttaatccccaactgctcggtctgattttgatcacggatgaattgcggccaactgccattaatacgttcgacttcttcaaaacgcaaggggtggctttaaaagtcatctcaggtgatgatccgatcacggtcgccaacattgccaagcaagcccgccttgaaggagctgatcaaagtgtggacatgagcaccattgcagacaacgcaaccgccaaagattatcaaacacttgtgaaacgctataacgtttttggccgggtcacacctgaacagaagaaatctttaatcatggcctatcaagctttggggcacaccgtcgccatgactggtgacggtgtgaatgacgtcttggcattgcgtcaaagcgactgcagtatcgcaatggcatctggtgccgatgctgccagctctattgcggatttcgttttgttagattcaaacttcgatgccatgaccggcgttctaaacgaaggccgccgagtcatcaacaacattgaacgcgtggcatccatgtatttggtcaaaacgatgtattcagtcatcctagccactatttttgtcttcttgccacttgattatccgattgtaccgattaacctcacaccggtttctgctatcggggttgccattccttccttcttcctgactttggaaccaaacttcgaacgcgtgactggtcaatttatgcagaaggtcatgaccattgccgcacctgctgccattagtgtcgtcatctacacattactgctgacatggatggagtctttcttccacttgagttttgagtctacttcatcaatggtagccatgttgattggcactatttcattgaatgttctgctcgtcgttgcccgacctttcaaccgactcaaggttggcctactgggtggtctcagcattgccctgtttcttgtcttcttcgtcttcagctcaattttttcacttgtcaatctctggcagtggcagctcgcgttaatttatttgccactcatgatctcaactgttccgttttacttgttaattcaagaatttcttggtcgccgtgttttgtcaaaaatcaattggcgatgaaaacgatgaaaatgcccaacgaccttttttgttcgacggtgactcgtgtatactgagattgcaggaattttctgaaaatagttaaggaaacgaggcacacacacatggcagaagaacaaactttagtcttggtcaaaccggatggtgttgcaaacggacatattggggatgtgatcacgcggattgaacaccgcggcttcacaattgatgcactgaaagtcacacatgcaacggcagatcagttacatcagcattacgcagcacttgttggtgagcctttctttccaagaatcgaacgcttcatgacgggcggtccgatggtggcaatgatcgtgagcggctccaatgtgatcgaagcggtgcgtaaaatgacaggcgccacgaatcccgccgaagcagcgcccggcacgattcgtggagattttggccgtgaatgggccgacaaaactattcgcaacgtcattcacagttccgatagtgagacaagtgcccgacgtgaaattccaatctggttccctgatcgtcaatacgcccctcatcagccagaaaaatagggtcaataattgaaagaagtgaggatcatggttaaacgacagacgttaactttgatcaccggtgccgataaagggataggctttgaaaccgcaatggcgcttggtaaacgcggtcagcatttgcttgtcggtgcgcgcaatcaggcacgcggtgaacaggctattaacaagttgcacacagctggcgtatcggcagaattggtcatcttagatgtgacccaagccggcaccattgcgacggccgcgaaacaaattgaagcctcacatggctatctcaatgttctgatcaataatgctggtattgccctagatgcccatcaaccaccttcacaattgcctgtgatgacaatgcgtcaagactttgaggtcaactttttcggcttagtcagtgtcacacaggcgatgatcccgttgttaaaaaagggtgctcccgctaaaattatcaacgttagcagcaacatgggttcactcggtttggctagcgatcctgacagtcgcttctttcaggtgaattcacttggatatcaagcctcaaaagcagcggtgaacttcgccaccattgattttgccaaagagttacagccagatcacattagtgtcaactcagtcaatcctgggtggactcgcacagattttggtggtaatcgcagcggcgaacaaacggttgcagaaggtgctgctcaaatcgtcaaactcgccgctgacgatagccctgatttgaatatgacatttacagaaaccgcgggtaaattgccatggtaatgtaaaaagagtcccttgccgtgctaaattccgcaatttccggttagatccggcttgcaacacatagctagaacggagacggtgcttcgagccccatctggcctacgattgttcagcgttggcactggcatctttagatcctaacaagttatccatatgacgcagtaaaagaggcatgatttccccaagtcagaaaatcatgcctctttttcggctctacgccaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgaatttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcccgcactgaaccatcgtcccagacgtattctgaactatcttcgcccatgcgattactaccgatgcatggcgtaacagcctagaccactatcaagaattcgttatcatcgttgcacttgacttgaaaattgaggctttttgcttgactttttttattgcaaaccttttacaagttgacagtgggtttgcagaaatgacaatcactgttacaatatgaacatatctgaacgaatgtctattattcaaggacatttagttttagtcaatcgttttggaggttttagcgtgaagcagttttatattgttgacagttcgatgcttccggaagtcgtcggtaaagtcatagcggcgcgcgcacttctccaaaatggcgaggttaagcaggtgagcgaggccgtcaaacaggtcggcatttcccgtggaacctattataaatacaaagattatgtttttttacccgacccagaaatggcatcgcgtaaagcggtcatctcgttgatgttgcatcacgatcgcggcattttatcagaagttctgacaaccatgtcgcaagcgcaagctagtatcgtgaccatcaaccaaaatattccgatccataattgggctagtgttgtgatgtcatttgatatttcggcactgcagggaacgttagatgatcttgtaaccaaacttggcgacattcgcggtgtcagtgatgtgcatctggtttctgttgaatgagcgccatgattatttggaggctgtatgaaaatagcatttaaactattactctgggtcttagtgaccggtgtgattttatttcccgcgctactgttgattttgtttgtcattgggttgagcgtggtcgtttctggtgccatggcaattagcgctgttgggctggtactcggtatcatttttgtggccttggtgggtctcagtatcatgattccatgcttattgctggtgattcgctttatgactttccgaacagtgaatgttcgttttcaacatcatggtgaacgggtggtattgccggtgacggtcaagttgacgggacggacgatttaccacgcgatttatgaaaatttccgtgcgggtcgacggcgcgggcggcatcttttatcagcctgggggtttgggtttgagacttacttccacgaagacttgcaggcgtatcttgctgatcagattcttgctcagcacggccctgaaatggcggagtcctttgtggttgatgagcggcattcctactcaattgcgtattaacaaaacgaatttaaaataccatccgcaagagtgctgtgccagcgctcttttttcttggctactttttgaaattgacgcgtttattcatcacgccgcggccgccattgaatcacccgatttgattcaggccagcgcatctcttcaaagccgacatattcaatcgtgagttgcgtgtgctgacgaagcaggccaatgaaggtttctaagtctgccagatcatagttgatcaggctgtgtaagggaatggaacgttggcgctgatccttaggttgaacgttcatgaaaaaattgtatcccggtgtataggtttgattgaccagtgatagccagtaacgtgtttgacggcgtcgtttgaaaaggggggttaatcgcgccatcattagcttcaaatctttagtcatagctattgccgccattatgtcctcctactagtgatgcccgttgaatcgccgttccgccatgcatcgcacttttagcgtagatcaagcccttaaagccaaaacgatcgcgaatagtatctagcgtgcgttctaaattagttgctttaatttgttgatcaaccggctcaaagaaattgagttgttcgccggtatctggggctaagcggccggtataaacggcaacgttacgaatgacctcaccatgccagttttgccgaaaaatcagttgcagtgtggcaacaagatcgccgtcccgattcgtcggtaaaattcgtttagtttggtgaaacccgccatgcccgtctttttcactttcagcataggaaaagccgatacctagggaaatttcaccagctcgtttgtgatgatgccgcaaccgtgcggcaacctgttcgccgatttctttaataacgatttcgatttcaacttgattgctataatcgcgcggcagaacctgtgagttgccaatgcttggttcgcgggtgatgacgcgttcgctgatttttgtgcggtcaatgccccatgctagcgcaaataactgcgtgccaatgatgcccagttcttgctttaaggcatacggatttgcgtgagcaagttgtttcattgtcgtgatgcccatacgtgcgagatgcgctgctgttcgttgaccgatactccaaacgtctgtcatattggtgatctgccaaatggtatctggtacagtttgataggatatttgaccaatcaaattaggatcatgttttgcataaacatccagcgcaattttggcttgaagcggattgtcaccgatcccgactgttgtgtagagaccaagtcgatgccgaatagtatgttgaattaattgcgcaactgcacgtggtgttttgccaaagagtcgccatgtgtgcgttaaatcgagaatggattcatcaatggaataaggccacaagtcttcattggcaacaaactcacgaaaaatatcattgatggctagattctttttgatgtaaagattcatgcgtggcggtaccacgatcagatgcttatccacaggcaagtcccgttgacggctaacgttacttttaaggccatatatttttttggccattggcgaagttgccaagatgaggccgccatttgtattctcttgttcggacatgaccacgagaagggttcttaaagggttcagcccgcgttcaatgctttcaactgaagcgtaaaaggatttattgtcaatcaggaaaaccgttcgatgcggttcgtgggaataatcgtaggccatcaaaatcacctctgcaattattatacgaacatacgtttgcataagcaagcataacgtgatttcagcccagaaaaaaaccgctgcgtcaaaaaacgcaacggtttgattgaatcgacgttaagcaattgtttcggttagcgcatgcaaccgccgatatgactgccccatgaagagacgttggacatcatattgctgtggaagaagcccattcccatgccactgaaggcctctaggacaaagaaggctgcaaaaattgccgcgatcacgatcaaggtgaccatcaatggccgccatttttcagaatgtaacatagcaacgaccccctaacaattaaaaacacatgacagcatgtagtataacaccattagataacggaattgggagaaaataaggcggcacgcaccagtcttatttctgaacaaaggggtgttcacctcagtcaagcattagtctcgatcccacttaatcttcagattagtttcaatcaaatcaccatcgtccaatgcgaaaggttcgacgacactgctgccatcatctttggtgaacttgatattcaagatgttgccatcgcgataaacaacttcccacttaccatttgttggcgtgccattgctggtcgccgtataagtaccgtcactgttgaagttgaaagtggcagtgtcgcctgattcccagcgaccgacgacgccatccgttgaatgattatcattgcgctttgaagcatcagaaggatactggcggttcgttttggtcacaccattgtcatcataatcatcatcgtcgtcatcatcatgagattcagatgttgaagaaccgcttgtggcgtcatgcgttggtgtaactgtcttagcagcggttgcggcatccaaggtcagtgcttccggttgccctttaagcgggacgatgacttcacgattgaagtctttcgtacttccttcgtgcgtaccgctcagcttgagggcgtacagaccaggtaattgactggcgatggtataactgccagaacgattttcaggttgaatttgattgccatccatggtgaaagcagcggcgtcaaggttggttttgactgtgacgttggcggtaccaagcttaaccttgtatttcgggaaaagtagcaggtaactgccttgtttgacgacctgaaccatgccattggtttgcttgtccatgatcatggttcgcaaggtgctgcgataaagccgattcttagtcaaacgggcgagcggcttaagatcactttcagtcaatggtgtgccatcgtttgcaatggcaacttcagccatgtcatcggcatctccactagtcatttcatcagccaactcagcgacttgtcgattttgaccatagtacattgatccgccgagataagccgcacctaaaagaacgacaaccgcaccaacaacgatccatggccagcgccggcgtttatgtacttgttgctgcgctggctgggttgaagcagcaactgtcgcagactgagttgcttttggtgcctcggcaggagacgtcgatgctggttcttgggttgattgggcttcaagtcgggctttccgcaaatcaaacccgcagttaggacaaaagtcgtcagttggtttaattggttgaccgcagttgggacaaaattttaaaacatcttgcataagttattcctccaaagttttcttgagtaaggcagcaatctgatcatgaccgcgctggttggggtgaaaagtatcgcgcggaccgttaccagcgaagtcggtgatggctgtaccggcagggcctgtgacgtcatcatggttttgccagatggtcgccagatcggcaactggaacgtgataagtttgaccgatttgtttgaccacagcatcaaattgcaaatcggcggcggcataaggaccatggtttggcgaccaggtcgtcataaggatcaactcggctgttgtttgcttctgcaaggttgccacgatggttgtcaacgcctggcggtaatcagccagcgccgttggtgtggcgccgccaaccgcatcgttcgtcccaaactcgatggtaatcaaatcaggatgctgggcaatcaacgctggcagagcagggacaccaagattagtcgcggtttttcccacctctgcaatcccttcctctgtcaccgtcttgtcagtcaaacggtgtaattggtcagcaaaaagggtggtaaaccggcttgttttactatccgcaaacaaaccaacagagaggctgtcgccaaacggtgcatacacgagcgtcgtttgtgattttgccttcagccgggcgagcatgcttgtctgcttaatcgcagctgaggatcgcgaactaggcgacttgcggctgcgaagcgaagccgctgaactgctcgatttagccactttatgttgtaccccgcagccagctgctaaaatgagcaataaaagaccaaaacccaaccaaaactttttcataacatgccttctccaatgcaatcacgatgcgtcagctaacaaaccgcgtgttcttagctttccagtcttctaatttaataaaaacccagaagccatagatccccaacgtgataattgtcagcaacaaccatttaatccaattgccgaacaagctcacggccgacccaaaaaagtgcatccgatgaccctcaatcacggtatgattgattttccaaccatatagcatggtcaaagaccatggataacaaatgcctagtgtaaaaatcgtgatcaaagtgccaagaatcgtccagccgacataagccaacaagccaccatcaaaaaaagagtgccgcccatatttcgtctccataatcgttgctgcctccaacttgttttctctagtgtagcagaactgataggcagggtggaggaggatgcttgaattgtagcctttgatttattgcctacagccacaacagagaccggtggcaatgcgttttactgccatttgaatagaaagagagagctggcggagcggcgatgggctcagtggtgacattgttcttaaacgggtgggcttcccgttttagaacaaggccagactttgaaaccgcgcactttgcgggttcaaagctgtgcccaccacgttccagcccaatcgccgcggagccagctcggaccacaggtgaagactcacgtcagataggacgagaaaccttgtacatctgattttaaagaggtcatgattgaccactcgctcacgctccctcccaaaatttggtacaataggtcaaggaatttttcacttggtttttctgaaaggacgattcgttaaatggtaatggatgccgcattaaagggtatgaatgataagcaatctgaggcggtgttggcgactgaagggccagtgctgattatggctggtgccggttcaggcaagacacgggtattgactcatcggattgcttatttagttgaagaaaagcacgtcaatccatggaacatccttgccatcacgtttacaaataaggccgcccgtgagatgcgcgagcgggtcggcaagttggttgatgctgagattgcgcgcgatatttgggtatcaacgttccatgcgctctgtgtccgaattttacgacgcgacattgacaagctgggctataaccgtgcctttacgattgctgatcctgctgagcaactgacgctagtgaagcatattttggctgatttcaatcttgatccaaagcgctacgatcctaaatccattttaggtgctatttcgagcgctaaaaatgaactcgtggatccacaaacttatgccaatgagcaggctaacagtcctttcaccaaagttgtggcgcaggtttatgcggaatatcaaaagcgtctgcgcagtgatcaggcattggactttgatgatctcatcatgcagaccatcgtgctttttgaaaaagacaaagaaacactggcattctaccagcgtaagttccgctacattcatgttgacgaatatcaggacactaacgaagcacaataccagctcgtgcatatgttggcagaaggctaccataatttatgtgtggttggtgatgccgaccagagtatttatggctggcgtggtgccaatatgcagaatattttggatttcaaaaaagactatccaaaggcgcaagtcattttgcttgagcagaattatcggtcaactaaaactattttgagtgcggccaatgatgtgattcagaacaaccagaatcgccaagccaaaacgttatggacggaaaatcgcgaaggcgacaagattacctattaccgcgctcaaagcgaaactgatgaagctatttttgtcattcgccgaattgaagcagagatcgctgataatcatcgcaaatatggtgattttgcgattctgtaccgaaccaatgcccagtcgcgggcgattgaagaagcgtttgtgaagtccaatattccatataaaatggttggcgggcataagttctatgatcgcaaggaaattcgcgatgcgctagcgtatttccggttagtggtcaatccggaagacgatatgagttttaatcgaattgtcaatgaaccaaaacgcggtattggcaacacaagcgttgaaaagttagaggcctttgccaatgagcatgactggtccttgctggaagcagcggcgaatgctgaactcagtccgattgctggtaaagctcgcggacagttagctaagttcggtaaaatgatccagcaactgggtacacggcgaaaagatctaaacgtgaccgagatgatgcaggcaattcttgaggatagtggctatttatcaacactgcgagcggcccacaatctggaagccgatacccgcatcgaaaacttagaagaattgctttcggtgacccaaggattcgattcccggtatcagccggaaaatgaagacagcgacattttcgttgattttctggctgaattggcgctgttatcggatcaggatgacgttgaagaagatgcacaagaagttaccttgatgaccttgcacgctgctaaaggactggaatttccggttgtctttttagtggggatggaagaaggactctttccattgagtcgggcttccatggatgaaagcgagctcgaagaggaacggcgcttagcttatgtcggcattacccgcgccaaacagaagctgtatctgtccaatgcctatggccggatgctgtatggtcaacggcaaaacaatcctgctagccgtttcattgaagaaattaatcctgacttgttggaagtcattggcactacccagccaaaaagtgacattccatttattaatcgtactgaccgcgcattcagctccccgtatagccggcacgctgatcaaaaaacagcaacacccgttactgtgcaagccgcgccaacaacaggtgcaggcaaaaccagttgggaagctggcgacaaggtgaagcatcgcaagtgggggactggtaccgtggtgaaagtcaccggtaccggcgatgatcaagaactcgatattgcttttaaagacaacggcatcaaacgactgctagctgcctttgctccgattgtcaaagtggcatcataagcgttcgcagtttgactcagaaatgtcgggatgcatatttttagaggaggctcgctgtgttagcaaaaccagctgcacaattcacacttgaagaagctcaggcggaagtcgaaaagcttcggaagcaactgaatcaatggcgtcttgagtattacaccaaagatgcgccaactgtgaccgataacgtctatgacgatcattatcgcgatttacaggcactcgaggcggcttatcccaagctagtcacgcctgattcgccaactcaagaagtcggcgatgtcattaattcggactttgccaaggtgcaacacccaattccgatgttgtcgatgggcgatgttttttcgttcgaagagctgagtgaatgggatgctcgcatgcaaagcaatgtcggccatccggtggattacaatgttgagttgaaaatcgacgggttggctttatctctgatttatgaaaacggcaaactcgttcaaggctcaacacgtggtgatggtaatgtcggtgaagatgtgaccagaaatgtgttgaccattgcgtcagttcccaagcagttaaagcagccactttcactcgaggtacggggtgaatgttatatgcctaaggcggcgtttgccaagctgaatgcgcggcaggaaactgagggcggcacgccttttgccaatccacgtaacgcggcagctggatcactccgacagttagatgccaaagtcaccgctgctcgagagctggataccttcatttatacgttaattgaaccagagcagtttaacgtgaccacgcagcatgaggcgattgcgtttatgcaggcacttggatttacaacaaatccaagttcagaagtggctggtgacatgcaggcgattgacacctacattaagaagtacaccaccgaccgtgatgcgttgccttatggaattgatgggatcgttttgaaagtgaacgatttggcgctgcaagcgcaactaggtaacaccgttaaagtgccacgctgggaaattgcctacaaattcccacctgaagaagcagagaccgtcattcatgacattgtctggacagttggtcgaaccggtgtggtcacgccgactgccgtgatggacccggttcagcttgctggaaccacagtggcacgggccacgttgcacaacgcggatatgattcgtgataaagatattcgcatcggcgacaccgtcatgttgcacaaagcaggcgacattattcctgaagtttcgcgggtactggttgctaaacgtccagcggatacgccaccggcgccgattccagaggcctgcccgtcatgtggccaaaaactggtccatctcgacgatgaagtagctttgcgttgcatcaacccgatgtgtccggcacaggtccaagagcagctcacccattttgcgtctcgcagcgcgatgaatatcgatggcttaggcccgaagattgtggcacagttgcaggccaaacatctggtaaaagatgtcgctgatttgtatcacctcacagctgcggatctggcgaaattagataagtttaaagaaaaatcaattaataatttgttaagtgcgatcaacaacagtcggcaaaactcggtagaacgcttaatctttgggttgggcattcggcacgttggcggtaaagccgcccgaattctggccgaacatttcggcgatttggatcatctgatgaccgccagtcaagaggcgatcgcagatgtgccaaacatcgggccgaccattgcggaagcgatcgtgacgtattttaaagccgcaacggttcaaaagttgatcactcagttgcgcgaagctgatgttaacctgcgttacaccggaccgaccaaaccagtggtcaaagatagttttgttgcaggtaaaaccgttgtgattaccggtaagtttgccgagttttcgcggccagcactcacgaagcagctagaaggattaggagccaaggtcacaggttcagtttcaaagaaaacggacctcctgatcgctggcgacgcggctggcagtaagttggcaaaggcacaaagcttgaatgtcccaatcatgaatgagacggaattgctggcgaatttgaaggattgaggaacatcaatgaagaaatttttaacgttaactttgctggctggggctgcggtgttgttagcagcctgtggcaagttgaattttgacagtggcagcagcagtactagtggcacaaaaaccggtagttaccaaaccaccggcacggttgataatagtatgtatcaaggcgttatcaaaaacggacgttatcagacgagcagcgcccgtggtttgacgctgcagcagaatgatcaaggcgagaacaacttcaatattaaaagtatggaaagtggtctcgaaaacctagccaaagcacagtttccaactgacaaatatagttttgaagaaggtcagttgttaagtacggcaaccgctaaaagttggctgaaacgtgaagccaaggacaacaaagacggacttaatccggttgataatggcaaaactgatcctgatacccgcaatccgatttatttgcagcagattttcgagcaggattttatggtgcaagacggtaatagtatgaagctgggcggaatcgcaattgcgcttgggatgaataaggttgattactatacaaagacggaatacggtgcccagtatcaaaccgaaatttccgatgaggcgatcaagaaacaaggtgaagcaatcgctgccaaggtcgtcgctcgtttacgcgccatgagtaaagtgccgaataatattccgatcattgtcggtatctacaagaatgctgaacaagatagcctcgttggcggtgtttataccgagcagacaaccagtaaaaccggcaccaatttaggcgattggaagaagcttgatcaacagaatgaagtgctgccagtggtgagcgatcataaggcgattaacagtaccgtggccaatgacttttcgaattttacgaaccaagtgaagggcttcttcccgactttagctgggattacggcacaggcgcattatgaaggtggtaatctagccggcatgaacattacggttaacacacagttttatgggttgaccgaaattcagagctttacgcaatatatttcaacggccgttagcaagtatttaccttctggcgtgccgattgagatcacgattcagagcacgcaaggcatgcaggcctttgtatcgcgaagttctggcgacaaaggcttttatacccatgtattcgggagttattagccgaatctatggtaaactacgaatgataatgaaactgaaagcggggatagcatgatttctaaagacagtgttgcgcatgtggcaggattggccaagttgcaattttctgaaacggaactggagaaatacaccagccagctctccgagattctcgatatggttgaacaactagaaagtgttccgacgcaagatgtgccggtaactactcagagtattcatctggaaaatgtgatgcgagcggatgtcgctaagccaggcgaaccggtagcggacttgttgaaaaatgtgccaaccaagaagggcactttgatccaagttccagcgatcatcgataaagaggaggactagcgcgtggattactttaaaaccagtatcgatcaattgcatgagcagttacgctccggcaaggtgaccagcagtcaattggttggcgagacattggccggcatcaaccagttggatgctgaagtagatgccttcttagcgctgaatgctgatggcgccaaggaaaaggctgctgcagtagatgcagccggtattgctgacgatcaaccactagccggtgtgccaattgctatcaaagacaacattgtcaccaaaggcgttgtcacgacggcagcgtccaagatgcttgccaacttcaatccgatttatgatgcgaccgttatgcaaaagcttgatgcagccggtgcgatcaatgttggtaaaaccaacatggacgaattcgcaatgggctcgtcaacagaaaactccgcttttaaaacgactaaaaatgcttgggatcacacgcgcgttcccggtgggtcgtcaggcggctccgcggcagctgtcgcagctggtgaagtgattgccgcactgggcagtgatacaggcggttccattcgtcagcctgctgcttttaacggcatcgtcggggtcaaaccgacatacggccgcgtttctcgctggggtttgattgcctttagttccagccttgatcagatcggaacgctgactcgacatgttaaagacgctgcgcagttgctgaatgtgattgctggtcatgatgaacgtgatagcaccacagcggacacacccgtaccggactttaccgccaaaatcggtcaggatatcaaggggatgaagatcgctttgccaaaggaatacttaggcaaaggggttgacccagcggttgcggacaagattaaagcagctgccaagcagttcgaagacatgggcgcgacggtgacagaagtgtcactgccacatacgcaatatgcggtgccatcttactacatcatcgccagctccgaagccagctccaatctgcagcgctttgatggcattcgttatggtttccgcgccaaggatgtcaaaaatattgaggatgtttatgttcgttctcgatccgaaggttttggcccagaagtcaagcgacgtatcatgctgggcaccttcagtttgtcagccggtttttatgatgcatacttcaaaaaggcagggcaggttcgaactttgattacccgtgactttgaagatatcttcaaagattatgatctgattattggaccgacaaccccaaccgttgcgttcaaaattggcgaaaaagtcaccgatccagttaccatgtacatgaacgacattttgacaattccggtcaatcttgccggcttaccggcggcatccgtgccagctggtttcgttgatggcatgccagtcggcttacagctgatcggcaaacattttgacgaaagcacgatcttccaagttgctgcggcttttgaagcacaaaacgactacttagcacagatcccggggggcaagtaagatgaactttgaaacaacaatcgggcttgaagtccacgttgagttgaaaaccaaatcgaaaatgttctcaccatcacctgtcacttatggtcaggaacccaacacccagacaaacgtgattgactggggattcccaggcgttttgccgagcatcaatcgcggagcctatcaacttggcatcatggtggggctggcattgcatgctgacatcacgcgtttgactcattttgatcggaaaaactatttctatcctgacaaccctaaagcttatcaaatcacccaaagtgagaagcctttgggcaccaatggctgggtggaaattgaagttgacggtaagaagaagaagattggtatcgcagaactgcatgttgaagaagatgccgggaagaaccagcacgaagacgatggttattcctatgttgatttgaaccgtcaaggcacaccgctggtcgaaattgtttccaaaccggatatcaccagtccagaagaagcttatgcttatctggaaaccttgcgccaaatcgttcagttcacaggggcttcggacgttaagatggaagaaggctctatgcgggttgataccaatttgtcagtgcgaccaattggacaggaacattttggtaccaagaccgaaatcaagaacctgaactccttcgtgcatgttcgcgatggcctcgcatttgaagaaaaacggcagcaggctgtacttttgagtggcggtgaagtgcgtcaggaaacccggcgctgggatccagatgctaaagaaacgcttctgatgcgggttaaggaaggcgccgatgattatcgttacttccctgaaccagacctgccaccagtggctgtttcccagaaatggattgacgacattcaggcctcgttaccgcaaccgccagcagagcggcggcagcgttacatcgaagactggggaatcccagcttatgatgccggtgtcttgacgcagacgaaggaaatgtcagatttcttcgaagcaactgtggcgcaaggcgctgatgccaagcaagcgtctaactggctgatgggtgaggtttccggtttcttgaatgcccaacacgttgaactggggcaagttgccttgacgccagcgcatttggcaggcatgatcaagcttattggtgatggcacgatttccagtaaaatggccaaaaaggtctttaaggaaatcattcaacatgataccgatccggataagtgggtccatgaaaaaggtctgatccaactttccgatccggctaaattgaccccgattattgacgaaattctcgataataaccagcaaagtatcgatgacttcaaagctggtaaggaccgggcaattggcttcctagttggtcagatcatgaaacaaacacatggtcaggcaaaccctaaagtggtcaaccagattttgatggctgagattaagcaacgataagtgatactgactatctagcaattcagttcggataatagcctcgacatgtagacaatgttctttgttgtttacatgccgaggctattgcgcaaattgctagtcttgctattgtggcagcagatgggaagtaccaagaagaataggctcaaaagttgctcatgaatgaagcttttgagcaagacattgacgattcacgattatgagaaagactgtttccgccagcaacgggcctgcagtccagtattgttaaaacgtttaaggagcattgaccgatgagaaaacgggcgcgtttgatatacaaccctacatccggcaacgaaggtttaaagcgcttcgtccccgacattttggatatcatggaacaggcaggatatgaaagttcaacctttcaaacaaccccgaagcctttttctgcacgtgaagaagcaaagcgtgccactgaagcgggtttcgacttaattgtcgctgctggtggcgatggtacgattaatgaagtggttaatgggatcgcaccagctaaaaaacgccccaaaatggcgattattccagcagggacgaccaatgactacgcgcgtgctttgcggatttcgcgggatgatccggttgaggcggcccaagtgattctcaaaggccaaacccttgcgatggatattggccaagccaatcatcattattttatgaacatcgcggctggtggtttgttgagcgaactcacttattctgtgccgtctgaagttaaatctatttttggctattttgcctatgtgattaaaggcgccgagatgttaccagcggtgcggacggtgccgatgaagctggaatatgatggcggggtttatgatggacccgccagcatgtttttcctcggccttaccaattctgtgggcggttttgagcagatcgtgccggatgctgcacttggtgatggcaagttctccttaattattgttaaaacagcgaacatggcgaatttgctgaagctaatggcgcttgtcttcaatggtggtcgccacgtggatgatcccaatattatctatacaaagactaaaaagttgcgggtgaaggccggcggagacgatccgttgaaaattaaccttgatggtgaatacggcggcgatgcgccgatgacgtttattaatttgaagcaacatattgccatgtatgctaatctagacgagatcccgaccaagaatcttggtacggacgcgcagaagcagaaggactacatggccgaagtcgaatccatttctcatcaagatattgatggtgatggacagatcggctcacaagacgaaaaggatgactaatttggcccaaccagctgtaaccaagaaccaagatctggaagttaccattcaagatctcacttatgaagggatgggcgttgccaaggttgacggctttccgcttttcattgaagatgccctgcctggcgaaaaaatgcaggtgcatgtcctcaaaacgcagaagcaatatggctttgccaaagttgtcaaacgattgagcgactcaccggatcgtgttcccggtgcagatagcacttatatccgtacggggattgcgccactgtcgatcttggcatatccggcacaattgcaatttaagcagaaacaaattcaagaactttataaaaaagggcatcttgatattgcggtgctgccgaccatcgggatgacgaatcctttaggctatcgcaacaaggcgcaagtaccggttcgtaccgtgaatggcgaactgcaaactggcttttataaaaaacacagccacgacctcgtaccaattgaagactttctgattcaagatccgaaaattgaccaagccattgtggtggtgcgtgatcttttacgaaaataccatgtgccagcttatgatgaacgcgctaataaaggcgttattcgtaacatcatggtgcgccggggccattatacgaagcagatgatgattgtcttggtgtcacaaacttggcaagtgccgcatctcaaagatattgtcgaagagatcaccttagcattaccagaagtaacgagtgtggttgtgaacttgaatgacaaacgaaccaacgtcattctaggccgcaagtcacgaaccatttacggcgaggactatttgctggataagttgctaggcagtgaattccagatctcgccagtcagtttttatcaggttaatccggttcagactgaggtgctttacaaaaaggccattgaggctgctggtctgactggtaaggaaaatgtgatcgatgcttattcaggtatcgggacgatttccttgacgatggcacgtcatgccaaacatgtttacggcgtcgaagtggttgaacctgctgtgcgcgatgcacgggcaaacgcggtgcgcaatcacatcgataatgtcacctttgaagtcggcaaggcggaggaggtcatccaacgctggaaagacaacgaactgccagtggatgtgctcatggtcgatccgccgcgcaaaggactggataaaagtttcatcgacgctgtcggttatatgaagccgccaaagatcgtctatgtgtcctgcaaccccgcgactttggcgcgggatttgcagctgctagccgcctttggctacacagcaaaggaaacccagccagtggacatgttcccgcagacgcagcatattgagagtattacggcgttgacgttggcgaagtaagactgcacaactatcatggcgcaactcaaagaggcacccgcacatcaattgattgctgcgggtgcctctttttgactgtagcaggtatgaatatctgttgattcagtatcagttctatttcagttgagatttcgccttagtccgagctggctccgcggcgattgggctggaacgtggtgggcacgacttcaagcccgcaaagcccgcggtcttgaagctcggccttggtctaagcggagaaaaccactccactaagaccaatctcaccactgagcccatcgccgctccgccagctctcatgattctattttagaacacgatcagcatgtcgatcttattgttgattgaggctcgtatttggcacaagcactgactgaacgacaagatcttgattctttgtgagtttgcagttgtgtccaccactcaagcttcgcagtcggcacccctgaattgccgcggaaccagctcgaacttttacactaggcttttattttgggcaaatcatgataacaccctaaatatttgctcattcaagttgctataatagggccatttcccttatgatcagtagcagtgacaagaaatgggggagtatggtgcagcaaaagactttagcaatgaaatggttatttctgggttcgttgattacgaataccgggatcagcctgatctggccgttaacaacgatttatatgcatgaatatttaggtgaaccactaacggttgcagggattgttctttttgctaattccatgtttatggtgatcggtaacagttttggtgggtggttatttgatcattggcagccatatgggacagttcttgctggtattggcctgaatctttttgcgaccggtatgctgattttcttccatggatggccggcttatccactgctgctagttgtgtccggtcttggcagcggtatcacaacgacggcgattaattcctatgcgactcggattcagaataaacgaccgagtgtcgtgttcaatattctctactttacatcgaatctagggttggttatcggcactttaattgtcggatttgtgctgccttatggtattggcgttgttttcgctttggcaactggcttatttgccttatttttagtggttgctttgttgcattatcgaattgataaagtggcgattgcgactgcgaccacgcaaactgttagcagcgagcgcaacccagccaagccgcggttagtcatgttgatggtgaccttatttgtgacctggctaatgtatgagcaatggcagagtaatatttctgctttcatgttaggcgaaggtttgacgattaaggattatagtttcttgtggacgattaatgccttactgattgtgctattccagccaattttgacggcttttgatcgctggttattacaacacatacgcttgcgtttgattggcggatttgtcttgtttgccggatcatttttgcttttgttgaacggttcaggacagtatataacgttcatcgtggcgatgattgttttaaccatgggtgaagtcttggccttaccagcagtctcgacttatgtcaccttgtttacgccattggcacagcaagggcgttatcagggattgattcaaggatttgcttcagctggtcgcgcattgggtccgttgttaggagcaatggtgattgagggcaccggcagctatcagttgttgtttgtcggtgccacaggcttaattttgttggcggctttgggttttgccttcagtgttcgccagagtattccggccctgaacgatccattgcacccagttacccaccagcagtcgtgaaggctgaaaagaatcgttcgaggggattatgaaaaagagaggggcttttgatttgcgttatcgactgattttaagtgacattgacgggacgctgctgaattcaaatcaccagttgaccgatgaagttaaaacggccatcaaggaatacgcggctgctggcggaacctttgtgctggcttctgcgcggccgcctttggccatgaccgctttggcacatcagatgggtctcgacgtgccacttgccagtctcaacggcgccgtcatttgcaaaccgcaacattgcgatttaaaaatcctgtccgcaacgccttgggccgctggcattggtagccaagcatacgaagcgttagctaaactggcactcagtctgaatattttcagtggcgcgcattggtatgtgaacgtggtggatgcgtgggtccaacaagaagccgcaatcacaggctttggcgcagaaactgcgcctatggaacaaatgctggcggaaggattgccagtgcataaaatgctgtgcatgggtgagcctgctgtggttgatcgcgcggaagccatcattcttgcccatccagagtggcaattggtcgctagccgttcgaaacgaacctatctagaaattgtgcggcaaggcgtgtcaaaagaagccgctcttcgccaactcagtgacttgtttgccatccccatgactgagacgatggcgttgggcgatggtgaaaatgatttgccaatgttaaaaactgctgcacttggggtgaccttggccaatgggttgcctgtggtattagatgcaattaaaactgttgtccctgacaacgatcatgatggtgcagcagtcgccatcagaaaatatgcgatggccaaagcataatcaaaaaggcgccttgacaggattcaattttgtcgaggcgtctttttattctgtataaaatagttttaaacgaatctatttagtctttcaaagcctcaacagcatgttcaagctgctgcttttgagcatcggaaatctccggatattttagcggcaaagcggtgacttcttgattgataatctgcgaaacaatcagccgtgaataccatttatcgtcagatggaatgatgaaccaaggattggctttagttgccgtgttctgaatagcctcttgataggctttttgataatcatcccagtagcggcgttccttaatatcagccagtgaaaacttccaattcttttccggaacctcgatacgcttaaggaatcgattcttttgttccgccttggaaaggtgcaggaaaaatttcaaaattaaaatcccgttgcgccgtgcgtaagcttccaaagctttaatatcattgaaccgttcagcccaaagactatcggaaacgtcctgaacactgtcgatactaggcaggttttccttgagtaacaattcgggatggacgcggtcaacgaggacttcctcatattgcgagcggttgaaaactgttaattcgccgccagcggggaaggccttgtgaattcgccacaaaaaatcatgatctagctccagctcagtcggcactttgaacgagacaacagaagtgccttgtggattaaccccagacatcacatgctcgatcatactgtcttttccggcagcatccatgccttggaaaatgatcaaaacactgtactgtttttgcgcggctaaatgttgctgcacttttgataatgttttgatgttattctcaatatctgctttaatttgatcttttttatttttaaaactatctggcggtgtggtcgtgaagcctttcatatcaaacttgcctttaccgtcaaaccgatattgttctaatgccatctcatcaccctctctgtcttattgcttttaagatagaagtttcaaggacattgtgcaagcaattgacgcgcttgcttagtcaaactatgcttgcattatcgcatttaaaaaccgcaggagcagcatcggattttggttcgacgaatgcgcttaaaaggaggaattttgatgtcattaccacgtattcaagatgatttatatatggcggtcaacgggacttggcagcagaccacggtgatcccgcctgacaaaagcgtcgtgagtgctgacagtgatctaactgatagcattcgaatcaagttggtagccgatttgaagaaaataaacgcggcaccacaagccgccgattcaccactgcaaaatgccgcacgactatttgctaaggctaatgataaagttcgacgcaaccaactcggcatgacaccggttcgtgcacggctggataaaattgctgggcttaaaacgctggcccagtttcgtgcagcactgccaaaactactagcggagcaatatgtgttgccagtaagcccgtacgttgatgctgatatgcacgatgcggctcacaatattttgaatcttggtggtccggccacgattttacctgacgctgccatgtatcaaaccgatgatgcagagaatgcggcagatttagctgcatggtcgaaaatggtcgcgacgcttttgggtgaggccggttttgaccagacagcacaagcgcactatgtggcggcggctaaaagctttgatcgccgattggctgcgttcattccggcaaatgtcgattttgccgttgatagcacctttgacaatccgctaacctggactgaatttgtagaagatgctggtttcttaggcattcccgaagctttggctgctaaaatgccgcagacaccgacgaaggtcaacgccgtggtgcctgcttatctgccgcatctgtcgacattaatcaccgaagcaaactatccagaatggcaagcatggatgctgattagcgaactattggcttgtgctgattatttaagcgatgatagccgccaacttgctggtcaatatgaccgttttttggctggacagcctgagcccgaagcttgggaaaagcatgcttttggagttgccaacgactattttgatgatgcaattggtcagtactatggccagacttattttggcgcggatgcgaaagcggatattaccgcgatggtcaaggaaattttgcaacaatatcaggttcaacttgaacacaatacttggttaagcccagcgaccaagcagaaggctatccgcaaattagcgactatgaaaattaaaatgggttatccagatcaacttttcccgctttacgcgaccctgcatgtcgagccagaggctgatttactgccgaccattttgcaattgagccagcagacgcaagacttttggcttcagcaggtgggtcagccagtggatcgcaatgtttgggggatgccggggcaccttgtgaatgcctgctacgatccgatgaaaaatgacatcaccttcccagccggaattttacagccgccatactactcactgaactggacccgagcgcaaaatcttggcggtaccggtgctaccatcggtcacgagatttcacattcgttcgataataatggcgccttgtatgatgagtacggcacgttaaataattggtggacggttgaggacaaacaagccttcgacaagttagtgacagctattgcggatcagtttgacggtttattgtatgaaggcgtcaaagtgaatggccgactgacggttagcgaaaacatcgccgataatgccggcatggcggtggcgttggacttgttaggggattcggctgacccgaaagtgctgcaagacttctttattgcctatgctcgttcctgggcgaccaaaatgcggccagagcgcgctaaaacggtgttgcggcaagatgtccatgccccggcgaccttgcgggttaatgtccctgtgcaaaactttgaggcgtggtatcaagctttcgatgtgcagcagaccgatggtatgtatcgactgcccgcaaagcgcgtcacgatttggcgtcggtagcatttaaacacatttgttttaaataaaacagatattagtaggcctatcttgtccctgaaatcgcctcataacgctgtgtgtcagttattagttgtctttaaatctaaaatgaaactgagatgatcaccatgagcgccagccgtcgttggttgattttgattgcaacttcaattgtgtcctttatggctacattggatgccagcatcgtcaatattgctttgccctacattgcccgggagctgaaggtgccgatgagcaccgtcgaacttgtcacatcagtttatatgattgcgatttgtgtcctgcttattttctgggggaagttgtctgacagcgtgggtcggatctggttgtttcagttggggaccattttgtttgcactaggctcgcttttttgcggactatccatgaccttaccatggttattaacggcccgattgattcaagccacaggtgccgcgatgacgatggcgactaattttggcattatcaccgccatttttccgatgaatcagcatggtcgcgcgctcggggtcaacagtgccttgttgcaactgggcaatatcgctggtcccggtattggcggcggggtgttggctgttttaagctggcattggatctttttgattaatgttccggttgcgctggtggcgtttttaattggcgtgctggtttttccaaggcagcggccgtccttggcgggtgcccacatggattggccgggatatggcagttattcggtaatcattttgggctttttcatcacggtgttctgggcacaaacagccggactgtcgtgggtgacgctgttaccagggatgcttgcgttcgtcgctcttgtggcttttgtgcagattgagcgatatgcatctgacccgctgattccgtttgccattttcaaaaatccgggtttcacgattggtattctgactgcgatgatcgtctatatgctcggctattttaatagcgtgatcatgccgttttatctggaagaaacattaggcttgagtgcgttaacggcgggcttttgtatgatggcaattccggcggccaatgttatcagtgcgccaattggcgggaatctgggcgatcatttcggagcagaacgggtgtctttcttcgcgctgtttctctggtgtgtgccgatggggttgtttgccgcggcaaccccgaactggccgttgggttggatcgtgtttggcctcgcgtggtcaggattggccaatggcgcttttcaaaacaatccgatgatgatggacaatgtcgcgccgaagtttcaaggactggcggggtccatggccgcacttggccgtaatttggggatgacaatcggtgttgccttggtgacaagcttgttgtacctgaatatgagtacgcaggctggtcggtacattcatgattatccgcatggccatccccagtggtttatctatggcatgcaccgcagctatgattttgctctgctactcttattgctagctgtgctgctgttaggctggttgaacctgcatcggctgcacgagcgtaaacagtcgttaagttgaaaattaaaaaaagagacaagtgctgcgaccgattatcaagcgaaaacgcatggtaaatagccgaaaacttgtctcttttttcagattaatctttgccagcacgataataatgaatccagccagtttcgcggacgccaagctgatcatacagatgctgggcgccatgattgctgatccgtgtttgccaactgcagcctgcataaccgcgctcatcagccagttgaaaggcagcctgcatcaattgtcgggccaaaccgtggcggcgaaacttaggggcgacataaacatcgttgatgatcaacaacggcttgagcgtgcgggtgtcaaaactacgataaagaatcgcaaagccgaccagttgctggtccaactcagccacaagcaaagcccctaatgtggcatcagtccgtagctgattcagatgagcagccatggcactttcatcaatcgtaagtgggacagggctgtcatgataataaccttgaacgagtgataataaaggcgagacgtcgttggtgatggcagggcgaatggacattgggaaaacctccttggccataatctggtcctattttaccttgaagtacgcctaattagcaccttttcatgcttgattgactggcttttggacattctgaatagctaccagacagattaaaaaagactgatttgccatatctaggcaaatcagtcttcgctctcataaatagtctgttggaatttaaagattgcatcatttggcatggcaaggaagttttagcctagcacttcctatgattatttgggctctgacaaattgtaggtttcagaagttatcgttcagcctgagagacagtcattgccgatcgtcagtagccatcgagaagaccgcgacacaaccaaagccggtgtggctggcgatggtggggccgatgttgccgacttgcagcggtgtttcaggtgagacggcatgcaatcggtctttcacgaagttggcggcgtcataatcgcctgacgttgaaatgatgacccggtgcgtcggattggctttaacagccttcagtgtttcatcagttaagtcgatcagtgaccgttttcgggcgcggactttgcgcacaacgcgaagtttcccagcagtatcgacgtccataaccggcttaatattcagcatcgttccaagggctgctgatgtccgcgaaacccggccgccatgatacagaaaatctagcttatcaacggtgaaccacatccgataatgcaaccgatgatctgtcagccattgcgctaactcagcaatcggcatgccagcatcgcgtttatcaatcgcatccaacacaaattggccttcccccgcgcaagcggctaatgtgtcgattaaataaatttgggcatcaggatgcttttctaacaacatcgctttagcctgtgttgcagaatcaaacgtaccgcttaaaccactggagaaaccaatgtatagaatcggtgttttggcttcaacataaggtgtgaagaaatccacaaattggccaacgttgacctgtgtcgttgttggcatcacattttgcttgagctgctggtaaaaggcattgatatcgtatttatcttcgccaagatcgtcttcgtattcctgaccatcgattgtaaaatgcattgagacaaaatccacatgatgatcgtgtaatgtttgatagggtaagtcgcagcaagaatcggttaaaagctggtacattaggttcacctctcgttgcccgtggttagccacggggtatttccatcaatgttacgctgttttatctatttctgaaagtgccgcacggcttttcaaacacagtgagtgttttttaacgcctaaaaacaagagctagttgcaaatcattggccaacaacggcctgttaagacggcattttgtctagcagaaggaaaaagctgactttttgcccaaaaaagccgaatagcagtcatcgtgctattcggctgtgaccggatcagttattgtcggtcgtcttcttttggttaaataaggtaccgactgctgggatgctaccgagagaatcaatggcagtgcttggcagcacaactgtgttagcggtgccctttgccagcgcttcaagtgcttcgacattcttgtattgcaagtacagattgccgttatcaatcaggccggcattaatcgaattgatctgatctttgacggcatcggcaatgagtcgctgactttcagcatgaccttgcgcctgcaaaatctgagtttgtttgttggcttcggcttcaagaatagccgattgtttttcgccttcagctttggcaatggcagcctgtttgtggccttcagcttccatgatgttggcttccttttcacgagaagcacgcaacagtttgttcatggaatcctgaatcgtggcgtcaacttggatggaatcgatgttcacccgatcaacattcaggccgtaaccagcagtcgtttcagcaatttgctggaacagcgtttggttaatcgtctcggttccattcaagacatcgtttaaatccatattgccgataataccacgcaagttagcgcgggtatcttgcaccatagaaagcacggaatccttgttttggtaaacataagcattaacgtttgtaatatgatatttcaatgtttcggaaatgcggacgacaacattatctttggtaatgacttcctgttcgtcaaccttcaacggaatttgcttcatgttgacaatttcggtaatccgataaattagcggtggcaccatgtgaaaaccaggctctaaggtcgccacatatttacccaaccgttccacaatgccgacttcaccagtatggatgatggcaacgctggagaaaagaatggcaacgacaatgactaggacaacaacaattaacgagatcaaaataatgctattcataaaaatcactccttcaaaacatctaaccagatgtctatgaatttctactgatacgggtgacatgtattaggaacttggcgtggtttaataatgcaaagcatgttccggttttaccacgctgagatacaacggcgaaatagcgttgacaacgaccttgtcgccagcggctgcatcatcttggactcgataatgataatgaatgccataaagggtgatttcgccactcgcggccgaagttggcaacgtaaaaatcgttcctaagagccgttcatcaagcatttatccgtctccttcccagttccgcgattgcgtttggtggaagcctcatcagctttgcaaagcaatcgctatcacacgctaattctaaagcacgggtgagggaaagacaacgatgacgacttcaaaaagcaagttatttgcttatgttggataaaattactattgtttttgctcgcttctattcttattggcctttacttaacagactgtgacgttgataaaaccaaatttcgcgaaaatgatcgactttgctacaatggtaaaaaaagagcgtgagctgacccgattagaaaccggcgtgtaagcggcgtcaagcgcaatggccgcacttgggccattgcgcttgaggtccttacacataggtttctgggtccgcgatcgcgtttaaaaagagcgtgagctggcgcgggtagcaaccggagcataagcggcttggtcgttgcggccaaggttcttatgtgaaggatgatgcgccagtgaaggcgtttatacgaggaggggacactgtgcgcagtcgggtcatttatgctgatacctatcgcaaacgtcatcaaagacgcttatttttgctggccgttttaatcatcgctttgggcgcactgtttgtttggtggcatcagcgcaatccccgccctgatccgcagacctatcccgtgttgggcgtgcgccttgaccaaaccgatggggtgcaggattttgacagtttgcgcagcagcaaagtcagttttgtctatctcaaagcgactgaaggcagcagctatttcgatgataattttaatacgaattttaatcaggcagctggcagtcgactgagcatcggcatttaccatgtgttcagctttgaaacgacaccccaagcccaagctgcccaattcacgcgccaagtcggccaaaatatcggtgatttaccgattggcatttacttaagctattacactgaaaagaagccaagcacacaatggctgacaactcagttacaaacttttgtcacattggtgcagcaacattatcatcgccaagtgttgctgatgggtagcccaagtattttaaaagctgtccaaaaagtcgacccgcaagcaccacgctgggttgtaagcgacaagaagccgacaacgagcagcggtttctggcaatacacgtctggcgcccggttgccgaatgggccgcacgcagattaccgtgctgccgtatttatgggggatcgggcggcctttttaaaactgtctcagcagatagtcaattaacgtcaaacacgggaattgtcagctaatcataatttttgtggctgtatatgacaaaagtgttcgttgattgttcgcgaaaagccatgtcaaccttgacaccaatgcggcataatagttgcgaggtgaaactggatgaagaaagttttgatcggccttgttgtgctgattgtgctggtatttggcggcttgaaaatttttgaaatcacaaattatggtggcacgacttattacacgaagatcacaaacgctggtcaacaggccactgaccatgatcaagatggtaataaatacaccatctacgcctacgacttgcccggctatgatgaaaaaggcagtttgcagcagctgaagttcaatgctaatcaagaccgaccacttaaaatgaatgcttatttgaaagtgatatacaatgataaaaaaggcgtcactgattggcagcgtgtcccgcgagcagaggtgccaaaagcggcgctggcaaagttggactagtcaataagatgccaaaacacttcataggcgagagggttaattcaactaaataaaaacggctgattttccgtattggaaaatcagccgttttttgatcgctcatagataacccagcagaatttacagaatacagtgccaagattgagccacatctagccaaagattgcggcgtttggcacggcaaaaatctgttgatcaacttctgatgacttcaaacactcggaacaataatcgcataagtggcatcttcagcctcgtcgtagatcgtttgcggaccattatcgtcggccgtgatgaccaacttatagccataatggtcgagaaaagtcagctcatggatggtgatgccgacgacttgaccgggaagcactttgttgtcgattgcgatctgcagttgtggcgagatcgccagcgagtgggtcttgttggtttgctcatcgagaaatgcaaaattccccgtaaaattcttcgccaatgccaatgcaggattggctgccttggtttgcgactcctgatgatgaccccgatgcgcgagtgcatgtttcagcccgcgtaaaaaactcgccatgttattcgacctcccattttttcattacattaagtctatcatgactttttcctttagtggttacagtgatgctgtttttctgttactgggctgttacaataatggtaagcggttcagagacttgtcaaaaatactttgtttttaaaaggatgacggcaactgaatcgggataagcgtgcgtgatgacgcttgatgattgaccgtgtgagttgaagaccgccagtttatgaaggccacggcttaggcggtttcgcggtgtctggcatgtgcatcagcacgttaaaaaacagagcacgattcagccggtttctgagctgaatggcgtgtctgaaaagggggatttgccatgttaaaactcggtgtgattggaacaggttggatcaccaagcaattcgtggcggcagcgatggcgacgaaagcttatcagctcaccgctgtttattcgcgacatcaggaaagcgcgcaatcatttattgacagcacggcaccagctacttcttatacgacgatggatgcttttcttggcagtgatatcgatgttgtttacattgccagtccaaatagtttgcatgcgtctcaagcgttggcagcgttagacgccgataagcatgtaatcgtggagaaaccattggttgccacgaccatggagtttgaaaagttggacgaagcgttgcggaagaaaccttctttatatctgtttgaggcagcgcgtcacgtgtatgaacacaactttgaagtcgtcaatgatttcacccacagtcaaccggttgatggggccaccttaacgtatatgaagtattcgtcaaaatacgatgcctttttagtgggcaagttgccgaatgtgtttaatcctgaatttgccggcggcgctttaatggacctcggtatttaccttgtatatgatgcgattgcgtggtttggtgtaccggagaatgccgtttatttgccgcattttctcaaaagcgggattgacggcgatggcgttgctcggctcgactatggtaagtttgcggtgacattgatcacgggtaaaacgactaatagcgagttgccgtcagaaatttattctggcaagcaaacattgatgatggacaacgctgctgagctggagaccgttaagctcggtgatcaagtgctgagcacagaaaagttggctaatccgatggaagctgaggcagcctattttgcaaaagcaattgtcggcaaggaccgcaacgcttttgacaaggcatggcagctcgccaaagaggttcatcaggtcatgtcaattctgcggacctccgcaaatctggatttttagtgaggacaatattgtgacaattgcaaccccgttccaaaaacgctggcaagcagccggctatactgaacagacgccgattcaaaccgccgtgtatcaaccgctgaaagccgatgaagatgtggttgggcttgctccaacaggctcagggaaaacattagcttttggcttaccactacttgaaaaaatggtgccaggcgatggcttacaactcttaattttggcaccatcacaagagttggcgattcaaacccgtgatgtgctcaccccttacgccaaagatattggtatcaccgtgcaaggggttattggctcggcgaatgtcaaacgtcagcttgataggctaaaagaaaagccagaagtcgttgttgcaacggcgggtcgcttattggaactgattcagtcgcgtaagttgaaacttgatgggttgcaaacgctggtcgttgatgaagccgatgaaatgttgcgtgatccaggatttgatcaggttcgagaaattgcggcagcagcacccgcggaagcacaattggcctttttctcggccacgccaagcccttattttaaggagctgcataagtggtttggtaaaacaccagacatcattgatgttcgggcaattgatcgaacccgtggcgaagtcaggcatctgtttttgcagacggatcgggcgcatcaggttgattggttacgcaccttagcccataccgatggcttcaaagccttggtcttctttaatcaaaattcgtccttggaacgcgtggcggggatcttgcgtcatcaggcggttcgctttgcagtcttgtcacgcgaaggccggcaaacggttcgacagaaggcattgactgattttcggcgcggacgaatcacgctcttgctggtgaccgatatggcagggcgcggattggatattcctaagttgccggctgtggtaaactttgaaccaccgaagcgcgcggaagtttacattcatcgggctgggcggactggccggatgggtgaagcaggtctggttgtgaccttgggggatgatcatgatcgccgcgacctcagcaagttggtaccgcagtatcatattcatcgcggctatatgtcagagggcaagcttgtggacacgccgccagctaaaaaagtgtccgaggcgtcggcaccaacgatggttgaaaagcctgcatcgccagtcgctaagcagcagccagttaagccagaagtggtgcaagaaccggctgttcgtccgcgtcgcaagcataagaaacatcgcctgcgagatcagcggaataaaggcaagcacaaggataacgcataatgcagcatcggatgtatgatgaagacaagggggcagtcatggtgagtatgaaagcagaacaaatggctgccatgatgacattgatgagcgctgccggtgatgcggaaaatgcaaccatgacggcgattgacgaagccaaggccggccatgctgagcgcagccgtaagctgttgaagcaggcagatgccaagttgaagcaagctcatcaagcgcagacccagatgctgacgtatgaagcacgaggcgaaaaagttgacgtgacattattgatggtgcacagtcaggatcatctaatgagtgcgatgaccattcgccggcttgccgatgagattattgatctttatcagcaagtgcaggcgcgtaaataacggctggcacagcgcggttgacgtgcctgcaaccgcggcaataacgcgctcgcaatcaagagaggtaatccccatgaaaatcgaaaaaacattacagacaccagcagcttttttatatagcaagattattgcgcccgtacaagctgatattgcggcggctaacaatcaacaggttgcggcggcagaactcggtggttatgcttatcgcaagcaatttccagatggcgagtgggccaaagttaaggttaccaagaatgtgattgatcgtgaatttgcgatgttgaccgtcacccgtttctcgcggttcaaggttcggtacctgatcacgccgttaaatgccaatgccagccaagtccgcgtcagtgaaaccgtgcagccggttaactgggcggcgcaactgaagcaaatggtgaccgaattattggtcggcaataaacgccgccgtaattacggccggatgttagattcgattgagcggtcgtatatgacggcttaggcgttgttcgctgcatgttgaacactttatagtcaatatttgcaaatgaatttgaattgccctgtggcttttggcataattgactttgtctggtgcccttagctcagcaggatagagcgactgcctcctaagcagtaggtcatcggttcgattccgatagggcacagtacgaagcacagtcttgatggctgtgctttttttggaaatcacattgcacattctaaaaagtcttaaagattaaaaatgggtgcaatcgcatttttgcggtagctggatttgtctaaaaggagattacgcgatgcaagccttcacagccgtttatttgccaggctggttgattttcattggcggtatgctgatcattagcagcgtgaatgcagcgacggtgcaagccatggtgaatcgggccgggcgttcgaatacgcagctctggtatatgaaaccgggtgtttttgtgcacgagctgttgcacgcggttgttgcgcggctcttcggattacaagtgactaacttttccatgcgagctgatgtggttagcggcagcgcagcgcatgtcagtctgcggtacaatcggcgctcaccttgggcacaactgggattatttctgtccagcagtgcacctgtctggggcatcagtaccgtgttgctgatcatgggacgatgggccttttttccgacagatggccggctttggccagtcttaactgccgccacgagtctgaatgaaaaatggctcgcgatgcgcggcttgattcagatcaactgggtttggtttgcggcttttatcgtcactgccttggtgctgacgccaggcattgcgctttcagctcaggatctgcgcaacatgtggcggagtgccccgatcgtgttcttgctgacaatcgtgattttttatgtttttttgacgttttggccagctggatttgcttggtggtcgctgttgaacttgaatgtgttattgttagatgcgattatgctgcttttcagtatcttgatttggttactggcaagcattttgtgaatgaatgttgacaagtgagagggcaaatgtgcccgatgtcataatctataagtgaagccttttgttctttagtagggggaagacgatgattgcgccgcaagcggagacaattttaaaggaaaaatttggctatgatcattttcgtgctggtcaaaatcaggccatcagtcgcgttttggctggtgaaagcacgctggttgtgatgccaacaggcggcgggaaatcgttgtgttatcagattccagcgatgttgttgtcgggattgacgctcgtggtgtcgccgctcatcgcgttgatgaaggatcaggtggatgcgctgaacgataacgggattccggcggctttcattaacagcacgctcgattatcaggagattgctgatcgccttgatcaagcaagaggtggtcagattaaattattatatgttgccccagaacggtttgacacggattggtttgtgcaacggcttggcagcaccgatatttcgttatttgcaattgatgaagcccattgtatttctcaatggggtcacgattttcggccgagttatttgaatctggcgaatgtggcggctcaattgccttcgcagccaccggtcattgccttgaccgcaacggccacaccgcgagttgcgcaggatatttgccagcgactggcgattccggctgacgggatgattaatactggttttgagcgaagtaatctgagcttcaaggtcgtacgcgatcaggatgaagatcggtatctactagattacctgaaactgaatgtcgatcaggcaggcatcatctatgccagcacccgtaaagaagttgaccgtttgtatacctttttggcacataagaagttgcctgtggccaaatatcacgccggtatgagtgaagcgcagcgtgctgctaatcaggaagactttttgtttgatcgcaaaccaattatgattgcaacgaatgcgttcggcatgggtattgataaaagcaacgtgcggtttgtcattcacgcccagattcccaaagatatcgaatcgtattatcaagaagccggtcgggctggtcgtgatggcttgccgagtgaggcaattttgctgtttaagccgcaagatctccaggttcagcggttcttcatcgatcaatctgaaggcgatgacgagcacaaacagcggcaatatgagaagttgaaaatgatggaacggtatgcgaacacagatcagtgtttgcaacagtttattttgaactatttcggtcaaaacgggacaaaaccatgtggtcggtgttcgaattgtttggatgaccgggaatcagtggatgttacggttgatgcgcagaaggtcttatcttgtgtggttcgcttgcatgaacgttttggcaaaggcgttgtggcacaagtgctggcgggggcccacaatcagcgggtattgtcgtttcatttagatcaattgtcaacttatgggctgatgagcagtcgtcgtcaacgcgacattacaacgttcatagattttctggcggctggcggttatttagaaacccgcggtggtcagtacccaactctgggcttaacggccaaaggcgctgaggttcttcgcggacaagcgcaagtattccagaagacggcgcaaaaagccgagcagcatctcgaagtcgacgacactgtctttcaggaactgcgcagtactcggcgacaactggcggagcagcagcatttaccgccttatatgattttctctgataagacgttgaaggcaattggcagcgccatgccgcaaagtcttgatgagttgatggcagtcaaaggcgtcgggcaggcgaagttgtataagtatggccaaatctttttggatgtcctgcaggcgattaaggccaaggcttgaatggctagtgtcgatcaaaaaaggtcgtgatcgcgtctttcccgttttgaagcggggggatgcggtcacggcctttttagctttttaccaggttttctccgccactttgctttatttggcggagaaaagacaatttacggcggagaaaaatacctaagcccagtcaccattgcgaaaaatcggaacgacggtgccatcggccttgatgccgtcaatattcatgtcagctgagcccatcatgaaatcaacgtgcgtgttactttggttgaggccagccgcggtgcgttggtcggtggtcatggcaacgccgtctttgacggagaatggataagcttgtccgagcgccatgtgatcagaggcgttctcgtcgtataacgtgttgaagaaaatcaagccggattgggaaatcggggatggatcagggaccagcgacacttcaccaagcgagcgggcgccggggatctttagcaggttttgcaaaacggtatcgcctcgatcagcatgggcatcgacgacttgaccgtttttaaaggtaaaatgcatcccctcaaggatattcccggagtaacttagcggtttagtggaggcaactgtaccatcaatgcggcggaaatccggcgccgtgaagacttcctctgtcggcatgttggccatgaattcctcaccgcgcggattataggcgccagcaccttcccaaatatggtgcttgggcagaccgacaaccaaatcagtacccggcgcgacataatgaagccgatcgaactgctcagtattcagccagtccgcttttgttcgcaattgttgatcatgggctttccaagcagcttcaggatcaggctgatcaattcgggtggttttgaaaatggccgcccaaagtttatcagtcgcttcttccggggtcttggcatcagggaaaactttttcggcccattttggacttgcggcgccgatgatggtccagctaatcttcattgaactgattgcgtccattaggcgggcgtaagcttgattgagggcattttgatagttagcgatgcgttgtgaatccagtcctgcaaggttgtcaggatcggcagagatcaccgtaatccgtttggcattgtgatcgacccagtaatcaaactgacccttaatgaaatcggggatgttgtacaggcgggatgttgccatgtgggccatgtccaaccgcttgatcagatcatcgtgccactgaacttgcacttcagcggcaccacggtcataagccgcagccacaatcaactgcgcaagtttggcctgatccacggcaatctgcaaataaaccgtgtcaccgggtttcacggcgacgccaatatcaaccgcgagctctgcatattgtttgaggcttttgtcaaagttaggtaatgtcatctttcgttccctccaaatccgtcgttggcaatagtctaccatagcagtcatcatcacgtgctcaacagttctaaaaaacgtccgtgctttatgttcaaataaatgacaccacaaagcatggcgttctctttaaaaaatacttcgaaaaaaattaagaaaaccgtcaatttgtttgcaaatagtgtttctttctggtatgaggtctggtaaaataacagcataacatctagattgccttttggagtggaggcgtatccaaagatgtttgtaaatgagttgtgtgcaagctagttttaaataactaaagaaagcaaggggaacattatggcacgaaagaaaacaattacgcatgatcagattctcaatgcggcgtatgaccttgttgtggaacagggcttcaagagtttcacagcgcggaatatcgccaaaaagatgaactgctcaacacagccaatttatttagaattcaaaaacatggctgagctgaaacaggctgtcatggatcgaattaaagaactactttcactgaaaatggcaaagcattttaccaacgatccagtcgttgatttggggcttgcttatatcaattttgcacttgaaaatcggccattgtatcgcgccgtttttgtggaagatcacttcggtgttgatgaaatgcgcgaatatgcgatgagcacctcaatgcgcgtttttgattcttacgaaccagcacagcacttgaacgaagcgcagttgcgcaacacgatctgcggggtatggatcgttgcaacggggatcgccaatttaatggcaccaggcttcattgatattacacgagatcaaatggttgatatcctaacggctgtgacacaagacttcattgttaacggccgcttctcagacgacccgcgcatctcttggtttcaagacgccaagatcgctcagggatactaacgatcattaatagcaaattggggataaccgttccgatgtggagcggttttttttagagcgtgagcaggagcggttagaaaccgaagtgtaagcggccttgggcgtgatggccgggctttggccattgcgtccaaggtccttacacggaggtttctgcgactgcgaacgcgttttcgacgagagcctgggccagcgaacgcgtttaaaggcgaatgctttttcaacgacaatgagtcccaccggttaacaaagacggcaacagtgcaaattctgatcttgggccaaacactgctgccgccttttacatagttgccacttcaccgaatcactggaaaaccatctcacaatgcgctactttaaaactaacgatgttgtctaccgtctcacaagacaacacagaaaaccacaagggagcttattatgggaagttcatcagacctaaaagacctattacgcgaacgaatcgccgctaaatataccattgacgatttaaaagatactgggaaaaagattcgtaaaaccgcgccaattgaaagtctggctgccgtcagtaagattgatcgggaccccgttcagttgattaacagtgttgaacagaacttaaccaaatcactgttgcctatgcgtcatagtcgcatgggcgcttcgcaggcagctttttttcgcggcactgctgagttgatggcctatgacctgcagcaaggggagaagtctggcatcaatctgttaattgatggtgacgcccacttacagaatttcggtttctacgcatcgccagaacgcaacctgctttttgacctcaacgacttcgatgaagcgcagatcaacagctttgaatttgacatcaagcgtttgctgacaagtgtttatttgttaggcgaccaacaaggctttgatgcagataaattggatgaattggtgcagacagatgcatcgatttatcgtaaaaccttacgggatcttttcaaggttggtgcattggatcgtttttatcagtccaccgaagtcagccatcttgtgcagtcgatccccggcgctgaagattcggcgttgctgtcgaaatttgtgaaaaaggcgacgaagcgtaataatgactcggtgatcaaaaaatacaccacgactatcgatggcaacatgcggtttaaagacgatccgccaagctctgtcaggttggataaagcgacttatcaggcgatctttgacggctttacccagtatcgcaagtccacgcggccggatattttggtgctactgagcgaatatcggattacggacatcattcatcacagcgtgggtattggcagctttggcacgaattgctatctcgttttgctaagcggattaggtggcagccatcttgtgctgcaagtcaaagaagccttgccgccgcgacctgaattaattccaaatacggaacgcatcacgttgcaacaagaagtcagtcagggacagcgtattattgcttctcagatgattttgcagaaagcctctgatccattcctcggctggttcaacgtaggcgataaaagctattatgtccgccagttccgtgatatgaaggggtctgtggatcttgaggaactgactttccccgagtttcagtactacacccagatcaccacatatctattggcaatggcacacgctcaaacccctcaggctgcagtggtgaccggctatctcgataaaagttttgacagcgccgttcagcgttggagcaaatggtatctgaatcaggtaaaagcggattattcagcctttatgcgggcagttcagacgcacatgctggcctgagccatcttggaactgattgacagatcagatttttcttgtcctgatgacgctcactctggcaaaataaagttaagacgctaatcacctaacttaatgacatgcctgaagagcagggcgtcacagaaaggaggcaagtgattatggctcgcaaacaacatcaaaaaaagccgccgctgctttccgccgaacaagaagtcgcgattcaatccgggcgtgcagcattggcagatttggcgttgccacgccgcaccaaaatgcgggtgtttgttaaacttgccatcaatcggatcaccgaatcgaacatcggccaaagtgctgctgccttggcgtactataccttgctgtccttattcccattgattctgtttgtcgccaatgctttgccttattttggcctaacatacaaaggccttgctgcctatttgacacaggcaatcccatccaatgtcatgaattggttggacccagtgatcgccaatctgttggattccagcagtggcggtttgctgggaattggggcggttgcgactttgtgggcggccagtttaggcgtgaatggtttgaaaatgggcttcaatcaaatttacggcgtcgagtcatcgcagaattttattattcaacgcttattatcgatgctcatgaccttcacactcatcattgtgatgggcgccattctgattgttttcgcatttggccgccagtttctggaatggctgatcccactgcttcgtctcaacgatgactggctgcgaacatttaataccctacgttggccagtgacgattacggcgctttttgtcattattatgtttttaaattattttctgccgaacgtcaaaatccggatgtggacagtcttaccaggcaccgcctttacggtcgccggttggctgttaattgcccaggcgttttccttatacatgaaatattttgggacacgatatctgtcctatggcacgattggcaccttcatcgcgatcatgttatggcttaacttctccgcactggtgctgttgtggggcgccgttatcaatgcactcaccgctgagtatttcattggccgactacacggcagtaaggggaaagtacacgactttgtcaaacgccgcgtgcgaacaccacacgaagaaaaagaagcgaaaagctagtcattgagtgagcaaccatggctgagagcagcaaaaaaggacttgcgttcatctgagagcgcaagtccttttgctttaaacggttttattgcaatgcctgatacttttcaacaagttgtttggtaaaggcctctaggtgcttaatatcgtcttcttcaggggcgagatcgatcttaatgtcttccgcacccttcgtggccccggtcttggcaaaagctttgtcaaagtcgtctaccgaagtggcaaagtcatcatagaagcgatcaccgctgccgcagcaaccgtagaccttacctttaagatcgagttcttgcaactcttcatagaagtcaacggcttcatcaggcaactcgccatcaccgacatctgaataggtgtaagtcgcggtgacacaaatatcgacatcttcaaaatcgctggccagcgcttgagaaacttccgttgtcgtcacgtccacccctaagtcctcaaaagcttcttcaataataccagcgatatcctcgttgttgccggtcaaactggcatatacaatccttgcgcttgccatttttcttttattcctcctaaaacacagcactcgggggcttacacgtcggcgaggctgccttttcttgttcatttgcctgattatagcataggggacacgactctggggatgtgaatcgaaaaggccaatgatccctgatgtcataaccgacaccgacactgtttaaccaaccattctcagacttctgttgtttatccctgattaatgctacactaattgcgaactaaacttgtattggaggcagaaaagcttgatcacgatcaaatcagcacgagaaattaaaggcatggcaaagtccggtgccattttggcaggtatgcaccttggcctgcgtgatattatcaaaccaggtatctcaagctgggaaattgaaaagttcgccaaagaattctttgaatcccatggcgccaaggccgaacaagtcggttttgaaggttataagtatgtgacttgtgtcagcatcaacgatgaagttgcacatgcggttccgcgtaagggcctgaaactcaaagatggcgatgttgtcagtgttgacacggttgtcagctggaatggctacttcagcgattcttgctggacatacggcgttggcaaggtgtcagaagctgaccagaagctgatggacgttaccaaaaagtccctgtacttagggattgatgaagcacttgttggcaatcggatcggtgacattggcgctgctattcagacttacaccgaagatgataacggctacggcgatgtccgtgagcttattggccacggcattcagccaaccatgcacgaaagtcctaatgtgccgcattatggcgtgccaggtcatggtttacgactaaaagccggcatgaccattacgatcgagccgatgatcactgaaggtacttggaagatcaagggtaaacaagtcccaggcgacacttgggaatactacgtcaccgctgatggcagcatgtgtgcccagtacgagcacacgctggtcatcacagataacggcccgaagattttgacttctcaaggcgatgccattgacgagaagtacaagttaaccgaggccgatcttaaaacacttcctgaataacagcggccaacgcgatcattcagaaacaatagggcacgaaaaaacggggtggcgatgatgattgctcaccccgttttgtatgtgagcgcgaatcagcccggttagcaaccgacgtgtaagccgccttgggcgtgatgatcgggcattgaccattgcgaccaaggtccttacacgcaggcttctgggctgattcgcgcgttatcgcaagttacaaacgaatggtacttaatcaaaccagttcacgttatactaaaggaaaggacgaaaagagggagtatatggcagatcctgaagcgctgatctcggttatcatgccagtctacaatgcagagaagtatctcgcagaggccttggacagtttattggcacaggattatccgaattatgagattatttgtgtagacgatggttccatggataccagtaaagttatcttggcggcttatatgcgagaaaatccccgaattcacgttgtgcgggttcaaaatggcggtcaagcacgggctcggcaaattgggattgatcatgccaacggggacttgatcacgtttatggatagcgacgatcttgtgcatccgcagtggctatccaccatggcagacgggatgaaggcaccacgggttgatatggtggtcgtcaattattacaactacattggcagtacgaagatgaaggcacgcgcgtttcgtgaatcgacatttaaaatcgaaggcgatgacaagtatcgctattggttagaggatcgtgatttgcgcggttatttgtggaataaattattccgtgccgagttatttgaacagcctgtgcctgtcgcgactttcaatttgttagaggatgcttactttatcggccatcttttgccgcgaattgatcaaatcggcttcattgacgaacctcggtattattaccggttcaatgcgaccagcagtgtgcatgccaagtttcaaaaacgcgacctagaggcgatccatcaactaggcgctgttttcttgacccttgcccgcgaaaaaccggaattgacctcgctggcagtgcgccgttatgcagccctgagtctatttgtgttatcaaaaatgtcaccacgtcagcttgttaaaaattggggttatgtccgccagcttgggatggtactggggcaatatacgcgcgagtttcaagatgtcatctcggcaggcgatgtcaacgatttagcgacagaaaatccagacaagcccaacaaaacgagcctgacaggcaggttgcgcgcatggtcgcagttgctgggcttgccgaccttcgatgacttgaataagcttgccaaggcggacgatgatccagaagatgtgaaaagagaatcttagtgagggacaaccgcactcacagccgcaacaatattttgcgtgagtggcctcagcgttcaatgactgagacacagtcactagacgctgaggccactcacgctcttgtttctaagtgactcgcacaaaaaagccgccactcacgtgtttcgcgagcggcggcttcctagcgatcatcgaaaaggggctgatgggggtttcagcaagtggcggtgcttcggttatgcctgtggttctgcaggttgtggttccttcttctcatcaatatggtagatttcagtaacctgtgtctcggtcatcttggcgcctgtcggagtcgcgtacaggttgacgccatccttgacgaaggccttggcatcagcgacaatctgcgcgaactgtttggcttggtccgccgttgcgtcagcttcgtacttgtttaaacgaatactggtggtcttaccaagtgaagatttgaaactgaaagaaagtgttttcataagttagccctccgtttaggcgttcagttcggtttgctgttgcaagaccgtgctgtgcagttgagtacccgggtacaaactagcgaaggcactgccgatcgcgagtaattgaccatcgtcagcttcaagcgcgacgttgttcatgcgccggacttgtttgtaatcctccttctctgggtcgatcatcgtatagacaatggcttgtgctttgattgttcgtggcatgttgcttcctccttgttttcagcgcttgcgtgcgcttttcatcgtcaattgcaactgtgtgactagacttggccgaagtcaggtcacgcggtctttaaaatacaactaggtggatcaaaaggtgccatggcatcgtaagacatttttttgccttacacttatacaaatcggtgaacccttggatttgacaaccctaaatgatcgaaaattcggaaaccattgcacaaagttgaatctctgctaaaataattaaggtgattctttagaaatagtaaggtttttgttggtttacgtcactgtgacgtaaggtcagctttacttacagtcggattccctctggggtcctatataaatgaaaaattgaagggttctgattgtgtgataacagcgcaggcgccaggcaagctttatgttgccggtgaatacgcggtggttgaaactggcttccccgcaatcattgtggcgttagatcaattcgtcaccgtcacggttgaggcaacgaagcatttcggcagtatcgtgtccgagcagtatcaggaaaactcgctgtattggcagcgtcaaggcgacgagatggtctttgataatcgggataatccgtttcattacattctctcggcaatcaaattgactgaacaatacgctcgagagttagacaaaccgctcgcgttatataagctctatattgattcgcagctggacgccaaggatgggaagaagtatggcctaggcagttcagcagcggtgactgttgccacgattaaggcattagccaagttttacgacttgaaaatgtcgaaggatcagatctacaagctggctgccattgcccatctagacgtacagggcaatggctctttaggtgacattgcagcatctgtctatgggggatggattgcctaccgttcgtttgataaagcgtggttggcggcagcacgaaaccagatgtcactagccgacctgatcaacactgattggccagagttgtcgattgaattgctgacagctccggctgacatgcaattgctggttggctggacaggttcaccagcttcaacttctcagttggtcgacaaaattacgctggccaaagcgaagaagccacaactttaccatgacttcttaactgctagccgcgaaaccttagaaaaattaattgatgggttccgcaaccgttcgttgagcagtattcaagctggtattcgccgcaaccgtgagttgttggatgaattagctcatttctcgggggttgcgatccaaacaccagcattacgtcaacttgttgaactagctgaacaagcaggcggcgcggcaaaatcttcaggtgccggtggcggcgattgtgggatcgtcttgattgattctcatcaagccatcaaaccgctacttgcggcttggcgcgaccatcatatcgagcctctgaaatttaatgtgcatgaaattaatgattaaagacaactcgattgctaatggtgatcgagttttttattttcagcgatgagaatgtgaattctttgttagaattcaggatttccaatacttttcgcaagcggtttctagtatagtatagtaggtagtcaaattagtaagagaagggacttgtgtacacgtgaaagttcgtaaagcagtcattccggcagccgggcttgggacccgctttctgccagcaactaaagctttagccaaagagatgttaccaatcgttgataaaccaaccattcagttcatcgttgaagaggctaaggccagcgggattgaagacattctgatcgttgagggtaaacaaaagcgttctattgaggaccatttcgattctgctcctgaattggaacagaatttgaaagaaaaacataaagatgccttgttggagttggttcactccaccactgacatcggcgttaatctcttcttcgttcgccagccatatccgcgcggtcttggggatgccgttcgtttggcgaagtcatttgttggcgacgaaccatttgttgtcatgctcggcgatgacctgatgcatgacaaggtaccattgaccaagcagctgattaacgaatacgataagacccacgcatccatccttgccgttaaaaaagtgccacatgacgaagtttcagcttatggcgttattgaccctgaaagagaagtttcaaagggactcttcaacgtcaagaaatttgttgaaaagccagcggttgccgatgcaccaagtgacttggccatcattggtcgttacttgttgacaccagagatctttgatattctcgaaaatcaaaaacctggcaagggtaacgaaattcaactcaccgatgccatcgacgccttgaaccaaacccagcgtgtcttcgcccatgaattcaccggcgatcgttatgacgttgggaataagtttggctatgtgaagaccaacatcgaatacggcttgacccacccagaagtgaaggatgagctgcgtgcttatattcttgacttggcgtcaaaactgcaggcaaataagcctgtggggaagccggcaaataagaagtaaattcataacataaaagttcaactgtcaataacagagctgtttgacgatacacagatgagtgttcgatcagacagctctgtttgtttgcgcttaggacacaggaataatgctataaaatggtttcaagtatttagtaaagcaatgacaattaaatcgatattataaacagttcaatattggaaaccgttttctatagcgttaaaataacatataggaggcgaggatcatgaaaaagttctggaagactttgttatcagcactgattatcgcaataagttttggtgcatttagtacagccaatcaagtggatgcaagggttaagttcacaagaaacgccgatttttacaagaatgagccagaaaatgctaaaccaagtgttctatcgaccattacgacaatcaataaaaatggcaccatgatttatgatgcagatgctgtgaagcaaaaagatgtgatcgcggctgctgctgcgcattggaataaggcagtcgggattaacttgattatgagttatcaagaggcacatgttgctaaagccgatgcgggtgtcgtcattgaacctacagatttaccggcgggtattggtggggtaacaggctacgacggctatgtatatgaaacttggcagaatatcatcaaaatcgctaacaccacgttagatgctgctagttcacaaaaaggttttgttcaagctgtttcaacgaccagtcacgaaatgggacatgcattaggtctcaatcatgatccgggcgcactgatgggaacgagtggtgcggctgaactggcaaatggcattttaccggccattcctgactataatgtgaatgccgttggcgcgatcttgaaagacttggatcagttatacccaggatcgaagccgatcacgattccgaacatgaccgatggcagtgcttatcgcgatgctggcacaactgaggaaatattgcccactgaccgagttgcacaactagtactaggtgttgatcacttggcgacacgtaactttaatggtggcaccgtagaaattctcagcaacgaaaatgtctatcaagtcgggcgaggccaagttggcaccacgaactcattcaatttgactaaaacgaagcagccaattgtaactggctagatgagtgctggttcccaaaggtattatcagatcaaagttggcagtcaatattacattattggcggcggtagtcgcgtcatcattactggagatgcgtatcgcgataacggcaccacgacggatgtcctagataccgacttaatcagtaaactattcaaggatgattctcgtttagtatcacgggatcttactcataaaacaattgaaattacaggtaatgaagatgtttaccaagtgggtgttggacgtatcagtacaacgaacgcacttttgttgacaggcactcaacaagaagtcttaatcacttatgtgaaggtaaatggctttcatgtttatcaaatacatgtaggtgacagatacttgattatttcaagtgattttaccaaagtagtaaattaagccgggctgttgctttttattgacgaggtattattagatcaaagtggataatcagtactacattattgaggcgatagtcgcgtcattattactggtgatgtgtatcgcgataatgtcaacactccggacgtcctaagtacagatttgattgttccaaagcagcaagctctgacaactatcacaaatgctggtgagggacatgcttatcaaattcatgttggtgacagatactttatcatttggagtgactttactaaggttgctagttaacaaaaaatctgcctactatccttaaattaaaaagaggagtctcgttctttgtcagtcagcgagagtcctctttttgatggtgagaattgtaaaggaaaacacaatcttatgaatcactacgttttaaaactgatactgtatagattattaaatctgtatctagttcttgttcagttcactttggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattatagaaagcatgcacatattcaaaaaggacggcagcggcagtttcataatcttcaaagaccggcactggataaacacaggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggaatggcgatgatcacgccataggccaaaaccagaccagcagaagcgcctaatgcagtcgagatcgccgttggagctggatgtggcggcaagaacccatgggtcaccgacaaagccgctgccatcgggataccaagtgtcagaattggaacgcctgcttcagccgcaatggcgaaaacaattggaaccagcaagacaatcccaacttcaaagaacaaagcaataccgataatgaaagatgccaaaacaacggcaagttgcaatccgcggcgaccaaaggcattgatgagggtatgcgcaatgcggtaagctccaccagcatcagcaaccaatcgaccaagcatggcaccgaagccgaagaccaaggccagctcacctagttgcgcgccaatcccattttgaatactggtcgcaatcttggctggcgccattcccaaaccaagggcgacgacgacagctgtgatgatcaaggaaacatacgtgttgaacttaaacttgatgataagcaccagtaagagcaggatacctaagaccaggacgagtatatccatttctattccccctaaattttgcagattaagaaatcgcttacaattttatttatgaaaaacgttcattgacgtttttctcgaggcatgtcgtttgatctgtgtacccggttgcttcattctcgctattttcccatcgaaccagcatattccgtcttagcacggacaacaggcgcagtgctggcgactaatcctcagcggctatatgggcattcggatctggatgcgcccgctgatagtcggcaattgcttgatactcgctgccaagtttacgcgtcaatcgaatccagattggcaacaactcacgataagcttgaaaattgtcagcattgggttcatgggtattggtgacaccaatcatatctttaaccacgttcaaatcgtcaatcagtcccagtgacttcattcccaaaacaactgctcccaaggctgaactttcaaagctttccggaatattgacttcctgttcaaaaacgtcagccaacatctggcgccacagtgcactgcgcgcaaatccgccagtagcctggatggcttttggtttgccagtaataccttcgatcatcagcatcaccatatataggttgtaaacgatcccttcaagtgctgctcgcaccatatgcgcacgtgtatgctgccgggttaagccaaagaaactgccacgagcattggcatcccaaatcggtgcccgttctccgcctaaatatggatggaaaagtaagccatcagccccagcgggtatcttgctagcaatttctgtcagaatttcataggaatcaacttgcagttgttcggccgttaatttctctggtgcaaaaagttgatcacgaacccagcggaagacaataccaccgttgttaactggaccgccaacaacccagtgattcggtgacaggtagtaagtgaacaggcgcccttgcggatcaactaccggcttgtcagtcacaacccgtactgcacctgacgtaccaatggtcaccgccaagacaccaggatcaatcgcgccaacgccaaggttgctcaatgtcccatcactggcaccgagaatgaaaggcgttttagcatcaataccggtcaccgccgcatagttggcatttaatcctgtcaactgataactggtgtcgaccagttctggcaattgatcgcgccgaacattggcaacatcaagtgcacggtcatcccaatccatggtgtgaatattaaagagcccagttgcgttagccagcgagtaatcctgcacatatcggccaaagaagcggaacaaaataaagtctttaatgccaataaagtgggaagtctgagcgaccaattctggatgttcggcactcaaccaaagcaatttaaccaatggggacatcgggtgcgtcggcacacctgtgtttttaaacagtgtcatccctaaatcgctttgcttcagcttcgttgcataggctgctgctcggttatcagcccacgtgatgacgcgcgtcagcggcttatcattttcgtccatcaaaatcagactgtgcatcgctgcggaaaaggaaaccccgccaagttcatcgggttggacattaccgcgatgcatcacttcagttaaaccgccaactgtcgctgcaaaaatctcttccggatcttcctcagccatgtcgggcgtatcttgatataacgggtagggattattggcggttgcaattgcgtgacccttgagatcaaacaaaacgacctttgtgctagtagtgcccagatcaacgccaatcatatatttgattgccatgcttatctcctttacttaatcaatttttgacttagttattaaaatggcgatatcacgatggttctgcaagttattttgacttaattggatcaaccgcatggccgccaaactgattacgcaaggcagcgaccactttacccgtcatcgtatctgcttcttcagagcgatagcgcatcatcaacgaactggcaatcaccggcgttgcaacatgtagacgtaaggcttcttcaacggtccaagcaccttcacccgagctgtgcatgataccctgaatcttttcaaggttcgcatcctcggtaaaggcattggcggccaaatccatcagccagctgcgaatcaccgagccattgttccacatgttggcaaccgccgcattgtcgtagtcatacggactgtgggctaacacatcgaagccttcaccaatcgcctgcatcatcccatattcaataccgttgtgaatcattttcaaatagtgaccagatccagctgggccagtatacagatagccaccttttgcagcgatcgccttgaacagcggctcaatcttgttaaagatcgccttgtcgccaccaatcatgaaattgccatcggcgcgtgcaccggccatgccgcctgaagtgccgacatcaaagaaatgaattccctcagcagctagcagctttccgtgtgcgattgaatcctgataataggagttgccgccatcaatcacaatatcatctggccgcaacagtttagctagctgactaatcgtggcttctgtcggtttgccagcaggcaccatgctccagatgatccgcggagatgccaagctcataaccaaggcatccaggcttgccactgccttggccccatattgccctacctcttctcgcgctttgtcgttcaaatcaaatgctgtcacttcaatatcatgatcgcgcatatttgcgaccagattcatacccatttttcctaaaccaaccatgccaatatgcatgtttgctgcctcctcgttatttgaccctgtgaccatccgttttctaaaaaacaaaccgcttctgtgatggttatcttatatcctgatgccattgtatgtaaatcgtttacaaaaatcaagtaatttgaccgtaaattattttcacgctgctatcattcatgctatactgaattcgaaaagtggtgtttggcttggtgcaattaaccatcagccttagacaataaacgcactctgacaatgcgacttaaaattctgacattctcgtttctgctctggtgaatgtatttttaggagggatcaagatgcatgactttctggtacaactgcaaatttataaaccgaatctaagtggccaggagaaaaagctagctgcctatcttcaagcccacccggaccatgccagtcaggccaacatctcggaactcagccaattgaccggcgtcagtacagcaacgatttcccgctttgctaaagccttaggttacacaaactttcaggccttgcgcatggcgttggcgcagacttcaccagaggatgatcatgcgctttttgctgagttgagtcccaaagattccgttgatacgctagcgcaaaaaattttcacctccaacattgatgcactgagaacaaccttagcaaacctagatactgatgctttgaccaaggctgttaaatggattacccatgccgagcatctcggactttttggactaggtgccagtaatcttgttgcactagacggttaccataagtttttgcgcacggcgattcccgtggcctatgcggctgactaccacatgcagctaatggccgccacacatcttggcccgcgcgatgcgatgatcctgacatcgcattcaggagaggacaaagatgccattgcattagctgaactagctaagaaacaacaagtgcctttaatcgtcattaccggttccccaacttcgcgcttagtcaaaatggcagatgctgcctttgttgcagttgctgaagaatcacgctaccgcactgaggcgcttcatgcactgattgccgaaatcagcattatggacacgctcttcatgatcagtgccatcaaaaccgatagtcagacagcaccgcttttccgccaagtaagagcaacaattgatgcaacgcggcactaagcgcttgagctcaccgccttgcccttgctcaatctttcaaagtatataaaaaagcatctgccgcaacctcatggcagatgcttttctcatggaaaaaactaaaaacctaatatcgctgattttgccttagaaatccgttgtatctgggtcagttgctaagccggcttcaccgtgcaaagcatcaatcaaggtcatatcatgatggctcagttcaaagtcgaacaactcggtgttttccttaatccgatcgtcatgaacggattttggcaatggtaagaaaccatgttgcaatgaccagcggaggacgatctgagcaacactcttgtgatagcgtgcggcaattttctttaaggcatcaacttggaaaattttgcctgtgccaagtgggctgtacgcttcacttaaaatatcatgggcgtcattatacgccacaacttctggctgcaaatcacttggattcaagaaaatctggttaaccattggcttgacagtagctgtttttagcaaagcgtcaatgtgcttggcgcggaagtttgaaaccccaattgctcgaactttgccggctttgtacgcttcttccatggccttccatgaccctgcattagtttcttcccaattatcacggaacttaattgggtttggccaatgaattaaatatagatccacataatcaacgcccagtttcttgagtgatttatctagcgctgctttagtcgcctcgtaaccgtgatcaccattccaaagcttagtggttaagaagatctgatcgcgaggtacgccggatgcgcgcaaacctgcaccaacgctttcttcgttaccgtaagcagccgccgtgtcaatatggcgatagcctgcagccaatgccgcttcgacactatgcttggcaacgtcgccatcaggggtctgccaagtgccgaacccgacgatcggaatcttaacaccattacttaatgtatatgtgtcggtcaatttggttaaatgtgccaaaatgagcatctcctttactgggtactactataagcttaccacaagtaagtagttgattgaatgtgttagcagcccagcgtcacacttgcatcagtcaaaaatagcgatatcctgatcagttgtctttcttagcattcaaaaaatgcttggttgctaagacatctagcaaaaccaagcaccttcttttaacacgctattaacgcgccatcatttgattcaacaatgcctttccagctgcttcactttgacggaaagctttgcctaacgcaattgttttatcaacaataatactttgcgcatcaatcacatgatacggatgatcaccggctttttcctgtgcaaacgatagctcagtacagccaaggacaatgacgttgacattaaaatcatcatgcatccgttgaagaatacgatgatacagggccgcgttgacttcgcccttttccttgacgtatttataaatcaactcagtgaccatgtcttgcagcgcctgatcgccaagaacgacttcacgcccgctagtttcgatttcatgactgtaaatgccgtcttggatcgttccttgggtcgcaatcagtcccacccgcttttcatctggaaaacgctcacacatatcgctgatggctaaatgtggcatgtgtagcaatggaattggtgtcgctgcggctaattggtcatagaaataatgagccgtgttgcagacaatgaccatgaactctggattgagtaaactttgatcttgaatgtcttccaacaaatccggataaaagctaggcttgctatgatccaaaatgtaatccgtacggtcaggaacagtcgcatcgttaaccagaatgtaattcagatattcctgatcgctgtgcgcgtgggtacgctggtttaacaaacggacataactctcggttgccggcgtgcccatgccgccaataacggtgaaaaattgacgcattcgtatcagccttcctgtagcgatttagcgacttgctttacaacagccatgtctgttggccatggtgtgttgacgccgcgtaccttttgataggggtcggcccctttgccagccactaccacgatatcatttggtccgctgtcgctaatagcttcagcaatggcctttttccgatcaagcactttgtgtactttaactttgctatgatcgattttactatcgatttcctcaatgatgtttgctggatcttcgtacccaggatcgtcggtagtcaagaatgcctcagttgcaaactcagtgagaaccttagcaaatccgggacgacgagaaacacctttatcaccgggggatccaaccacaaccagtaatcgaggatccttgtaagcgtgtttcaaaaacgacaataacgccttcatactagcgtaattgtgcgcataatcaacatagacagcaccatgtccggcaactttcgtatgctccatgcggccggggattttaacttttgcaatacccggaacagcggcagatgcatccacgccagccaatccagcaccaataatagcagccgtcgcgttactttcgttaaaatcaccaatcaaagcaagcgagtagtgaccgccgatgttcaatgctgctgctttttccgtgactggtactaaagtgaaacgacactcagcaacgtcagcttcctgactatcaaagcgaaaatcaatatcgatatcatcgcgtttaggtctgaagccagcactggcaaacaggtagatgctttctggataagtggtggtcgttgcggcagcataaacctggtcaaaatgctcggtttcggcattaatgaccactttgcgcgcattgaccaacaattgcagcttgttgtgtaagtaattagcaaaggttggatgttcattcggtccgatgtgatctggcgtaatgttcaggaagaagccgacgtcatacgtcaatccaaaaacgcgattgcgcaaatatgcctgactcgacacttccatcacgagatgggtcataccgttttcgacagcctcgcgcatatcgcggaaaagatcgaggctctctggcgttgtcagattagacttgaaacgctgatcgggctcagggccaacaaccgtatcaattgtagaaaaaagcgcgatgtgtcgtggacgagcctcatttaaaatagcttctgtaaaataggaagccgtggttttccccttggtccccgtataagcgatcacaaacaaatcatcttgcggataatcaaagaaagcagcgctcaaaatcgccattgctttagtaatattccgcacgatcaaggcgtttaagccgttgccttcaacgtaaggtttctcggcaacataagttcgcgcaccgttgtccttggccatggaaagataaattggtcggaacttgtcgcctttgcagaaaaacagcgttggtccagagaccttgcgtgaatcataggcgatgccggtcatatcgacatcttcagtattctgaattgctgcactctttagcagatgatgttcctttaataataagatacatgctctaagtgatagtgccattgggctgctactcctttttatatgccgtgaattcaagcttcattatagcataagcgcggtactggcattaaaccagtcggactgtcacaactatctgtgtgccgtcttggttcatgctcaaagttcattgattatcttttttatgcagatgcaatgttcattaacgtcacctgatacgaaccgcttggcgctgtcacctgcgtggtgctgccgaatagcggcgcccaagggagaattgatggcaagcttgtcttggcccatcccagcttcggcagggccgacaagttcataagtcgcatggtcctcgtcatcatcgaacttaagtgtgatcctattgccaatatcggcaatatcactagcggccgggtgcgtgactttagcataacgaatgagtttatccagatatcgcaatcggccttctagctggcgcaactcacgcttagcagcgctatattccgcattttccgagcgatcccccaacgctgccgcatcggccaagttcttgatctttgcaggccgaatagttttaaggtcttcaacttcctgcttcaagttagccaaacctgttggcgtgatctcgtgataggtgaccatttcaatgccttctttttatctgaaaactaactctctacttgttgcaaaaaaggtgaacgtgatgatctccattcggagttcaggacattcaccactttttcgtttttggatcaatgaggtaactgctggactagaaaatattgctgaagaaatcgccaatgccacggaagatcaggacaaagaagtttgctttgttatcggtcttggtggtctttaaggtaatgccttcgcttgctgaactgccgacaaagccaaggttgtcacctttggcgctaacttccagctgcgcaatcgtggtaccttttttgactggtgcttcgacagtattcttcttcacgccttttgctggcgtgtaagtatattgaagtgattgtttgctgctgttagatggcacaacagcaacagccttggttgacggcgcaatcggcgttgtccgtgattgaccacgattgaccttgacgctgtcgtaccctttaatcccctgaccagcttcagctaacgtcatcgttttccaattttccaaaacattggtcatcaattttttggtttgatcaaaacggcgagttttagcatcaccatttgcatgcaagataaccgtaataattcgcatgccatttttctcaaccgtccctgtaaaacaatccccagcggcatcagaagtacctgtcttcaagccatcaactgggaggttcttatcataagacaccaggcccttgagcatccagttccaattttccatatcgatcgcatcactggttcccttacggaatgtctgtttagcaatactcgtggtcttaaggacttctggatgatccttcagtaaatgttgtgccacctgggccatatcttttgcggacatttcgttctccgcgttatcatctgtaccgggtaccttagcatctttcaattggctgttattcaaaccggtcacgttgacaatttttgcatcggtgataccccagctattgagttttgcagtcatctgactgacaaatttctcctgactgcccgctactttttcagctaataacatcatcgctgcattcgccgaataaattaaagaagcatcgtacagttcgcggactgaataagaaccatcgcgccgcaacggtacattactaagatcacgattctgactgagttcccagattgcgttattcagtgtcactttgtcatcccaattgatcttaccggacttaattgcgtcaagcaccagctcaatgctcaacattttggtcatagatgcaattggtaaaacactgctggcattcttagcatataatatcttgccagtagtcggttcaatggctactgctgccttggcgtcaactagattggtatcgctgctctctgccgcagataccgacattgctggcgcagcacccccaatcattaataccgccaccactgcggcaatcaacccgcgcatcaactttttcattttgactttcctgcttcctcattagatttatttttattgtctgtcagcgaagcgccaacttttaatggtaaatgaatcacaaagcttgttatctccgggctagaatcggcataaatatacccgccatgcaaagcgatgatactttgggcaatcgctagcccaagaccagtcccgccagtttcctgcgatcggctttcctcaacgcgataaaaacgatcaaacaactgactcaaagcatcattcggaatttgtgcgccatcatttgagaccttaacaacgacttcactaccgatacgttgtgcatcaagaaaaatgtgacgcccgccttggccgtacttaagcgcattaacaattaaattgttgaacacccggcctaatttttcggtatcagcttccatcatcaacgggtcaggttcaccgctgaccagaatccgcatatgcttcttatgcgcctccagctcaaaactagctgccagttgctctagcatcgcaatcatgttaaaacgtacgggattcagcttggtcgtggtcgatttaaccttggtgtactcaaaaaggtcctcaaccagtactttcatctgcttagccttcaaataagccgtgtgcgtatacttgagtagctcttcttcactgcgatattgatgatcttcaatcaggccaagataaccgataatggacgttagcggcgttcgaatatcatggctgacattagtaatcagctcatctttactctgttcgatccgccgttcctcggccattgaattgacggttgaatcaacaagcgcgttaatactgctgacaaccttttgcaactccgtattgacctcaaacttaatccgatgatcaagatgaccatcggcaataaaatgcagctccgcaataacgtgacgcatttgcatttgccgatatcgccgagcaagtcgccaatacaccacaatgacatcagcaatcgccatcagtgctaggaaaagattggaccagctccacaaatgaaatccacggctgccaaacgtcagattcgttttcacaccccagatagcattttccaaaccaggattgtgcgcgatcatctgattaatcaacaccagcaaggcaaaattaagcattaacagcagaatcaccgttacgatgccttcaatccaaagttcggatttttccttaccagttagtttgactttttcgctcatgatcgttaggcctcaaccttatagccgacgccccaaactgtttcgatcaccttctcgccatcggtcgcttcttcaatcttgtcacgcagatgcgagacatgcaccataacggttttcgctgagacgattgattcctgttgccaaacgcgttcaaaaatctcatcagccgagaaaacacgattcggatggctagccagcaagtacagaatgccgaattccagcgcggttagctgaatttgcttgccggtaagggtggtgacttcatgactatcttttttgatcgttagcggaccgacttcaagcacatccggttctgtattggtcacctcattttgacttcggcgcaacaaactcttgacgcgcgccatgacctctagcggattgaatggcttggtgacataatcgtctgctccagtaataaggccttgaatcttgtccatatctgctgttttagccgagacgataatgattggaatctgtgaatctttgcggacttctttgacaacatccatcccagacatattaggcatcataatatcgaggatcatcaaagcaatatcaggattggtcacaagcttagtaatggcttccttaccggaatacgcctgaatcggttcgtaaccttcgtttttaacgtaaatacttagtaattcgacgatttctttatcgtcgtcaacaattaaaattttcattgtattggctccgtttatgagaagaactgtagggtctgttacatcaaagtccattgtaccaaagttgaccggggaattctttacgaaaagcctaagaaaacagggctagaataggtacaaaagtgttgatttaatcgcgaaagaaggcggctaattgaaagatttgacaaaaatggtcacagcaagtttaccctcaaccatgcacatcgctggcattaacattgcccgctcaagcggaagtacttactggctattaaggcaatcctcccaatggctcaccttacgccttgccacacatccccattggttacgaggtgttcgtcagctacaggttgtcttaccagcatcatcagcccgccacgactcaataaccatattgacaaaagccttagcgagtcctgccgcggccaaaaacacatatacctttacagcaattgacacggctcttgccaacatgctgctgtggacagcgtcgcgtaaactggtcttcatgctgcgcctgacccccgagatggccacgactcataaaatgaccccttttagtttacaacaagattttgcgccgctaccgcttttcttgggtgatcgtaacaatagtaatgacttattgctacctgtccatgatgccaagttgcaacaaagtctgattgatttttatagtgctaatttgctattcacacaattctccagtcatcagttagtgaaacttttgccaactgcacaatggctgcaaaccattctgacaactgtacccactaatcccgcttggccattgacattggccacaactttcggcacggaactacttgacgtgattcatcgggcacgaatgtagcctcttaatcatagcgcgttcaccaaaaaaaggcccgcactgcaaccaatggcagtacgagcctttttgtgacaccaatcttttattgaacggaatagttaggtgcttcccgcgtgatctgcacatcatgcggatggctctcgcgtaaaccggcaccggtaatttgaatgaactgcgcattatcttggagttcttgaagattcggtgcaccgacataacccatgccggattcaataccaccgagcatttggaaaatcacatcgccgagactgcccttgtaagccacgcggccttcgatgccttcaggaaccagtttgtttgcttcgttaaccccgctctggaaataacgatcactagaaccgtgggcctgcgccatcgcgccaagtgagcccatgccgcgataagtcttgaagcggcggccttgataaatttcgaactggccaggtgcctcatcagtgccggccaaaagggaaccgagcataacggcattgccgccagctgccaaagcctttacgatatcaccggaatacttgatcccaccgtcagcgataattgtcttgccgcgcttacgagcaacactggcggcatcatagatggcagtcagttgtggcacaccgacaccggcaacgatccgggttgtgcagattgaaccggggccaatgccaactttgacaacatcgacaccagcatcatacaacgcttccgttgcttcagccgtggccacattaccggcaatcagagttgctaatgggaactgttcccgaatctctttgattttccgaatcacgccagcactatgcccatgggccgtgtcgatcacaatcgcatcggcacccgcatcaagcaaagcttgcgcccgatcaaaggtgtcagaggtaacgccaaccgctgctgcaaccaacaaacggccatgcgcatctttagcagcatgcgggaattcaaccactttttcaatatccttgatcgtaatcagcccactaaggcggccttccttatcgatcaacggtaatttttcaattttacgagactgtaaaatagcttcggcatcttcgattgaagtgccagccggcgcggtcacaagcccttccttggtcataaccgtgtcaatcagcacacttttatcatcaacataacgcagatcacggttggtgatgatgccggtcaacttgcgatctgtggtgttattaacaattgggacgccgctaatccgatattttttcattaaatcttcagcatcactaaccggtttatcggccgtcaggaagaatggatcgacaatgacaccattttcactgcgcttcaccttcagcacttcatctgcttgtgcttcgatgctcatgttcttatgaatcacgcccaacccgccttggcgtgccattgcaattgccatagcactctcggtaacggtatccatccccgccgagatgattgggatattcagcttcaagttgtccgccagttgtacagacagatcgacatcgtgaggtaaaacatgactttctgcaggtatcaacaacacatcatcaaacgtaaaaccgcgccgggcaaactttgtatcccaaagactcatagcgtaatccctctttcaatttttagttgttgactaatgtactaccggaatttaggcacgtcaaacaagtctaaccatttttttcgaaacgccggtatcataggcttaaaaatgaaagaaagtctcataatcgttcatctggaaccgaacaaaattttatcagctatagctttctcaaaataatgttcggtttttgtcgtgtgttgcgacgtgtcgtttaatatcattcgttttttacccgctaaaaccttcgcatgtaaaatgacaagaacatttgccgttttccctcactggcaatacaaaaaaagccgccattttcggcgactgttggattttttaaaaagtagatacccgatgttgaaatctgactatcagcttatctctggaaaaagcttttgaggtgataccggtgctgtaagacccagtgaatcccataggcaatggcgccaataatgatattgacgaaccacggcattgggcgcgtgaacggcgtgtcaagcatcgccaaggcactgccaatgaacgtgatcgacacgactaagacaacaccgccgcccaagacaagccaagcactgcggcgcttctttttatcttgctgcatccagtcagcataataaacgaagaagagaccagccattagactcaacatcactaagtaaacaaaactgctgctggcggcgttttgcgacttggtatcgaagtaggcaagtgccccatacataaccgctaaaatcgacatgaagaacagactttggtcaatgaccatcaaccacattggctttttaggctcaggttttggcgtatgcagaatttcgtctgcctttaccgtgaccggtccgtaaagctgattggctggcttgccttgtcgttgtgctgtgatgatctcgggcaacatcgttttgagtagttcttcttcgtccgccgcgttcataccgccgtcttttaactcacggcgtagtttgaaaatatattcatcatttttattagtgagccgtgcaatcagctctggcacagtggtcgcaggcttttcctgtttcacatgtgcatttttagccgccgttgcttgatctgctgacgactcatcagtggctgtcgactgtacttttgatgctgtttgttcagtcgtagcagtatttttaccatttactgcagcatcggttgccgtctgtttcgtctctgcttcatgtttctctgccattggaaactcctatctcctaagtcgttatgcgttagacattgaaccggaattcaatgatgtccccatcctgcacttcatattctttgccttcggatcgataacggcctgcttctttaaccgcctgaacagatccgtacttgtctaaatcggtgaaggacattgtctcggcgcgaataaaaccgcgttcgaagtcggaatgaataatcccagcaacttctggagccttcattccctgtctaaatgtccacgcacgggtttctttgccaccggctgtgaagaaggttgccaatcccagcaaatgatagctagccttgatcagcttatccaacccagactcgtcgacaccttctgctgccaaaaagtctgccttttcatcgtcatccagttcagcaatttcttcttcagttttggcagaaatcgcaatcacttcggcgccttctttggcagcctcggccttgatttgcttgacgtaatcaaccgaatccggatcagccatcgcttcttcagcaatgttagcgacatacaaaattggcttgctggtcagcaagaacaagcctttgacaatcttcagctcatctttatcaaagtcgatgctgcgaaccatcccgccatcttccagtacgggcttaatctttttgagcaccttgaattcagcctgcgcttctttgtcattggtttgtgttcgcgccactttttcaactttagcatagcgtttattgacagcatcaagatcagcgatggccaattccatattaatcgtcgccatatcctctaacgggtcgactttgccagttacactggtgatgttgtcatcatcgaacgctcggacaacatgaacaatcgcatccacctgacgaatgttttcaaggaacttgttgccgagtccttcacccttagaagcacctttaacaatgccggcaatatctgtgaattcaaaagttgtatgaataatcttcttggccggaatcaattcatcgattcgtgccagacgtttatctggcacttcgaccatcccgacattcgggtcgattgtagcgaatggatagttcgccatctcggcgcctgctttagtgattgcgttaaaaagcgtggacttaccgacgtttggaagtcctacgatacctgctgttaaagccatttggttacttcacactttctatttagtctgtctactctacatgacccaacacttttttgagtcgtttttcaaaatcgcgccgggacatcatcacaatatgaccgcatccggtacatttgatcttgatatcagcacctaagcggataatttcccatttgttggtaccgcaagcatgcggtttcttcatctgaacgagatcatgtaaatcatacatttgtccacctccagcgttgttgtgcttgtcggaccggattaaacgcgttcgcaagtttctaaacgggcctgctcacgctctgcttttaaacgcgttcgctggcccagaaacctgcgtgtaaggaccttggacgcaatggccaaaaacccggccatcacgtccaaggccgcttacactccggtttctaaacaggccgctcacgctctgctggttagtcaatattgacgtcaagcatggccaagatccgattcaaatctttttcggaagtgaagtcaatctcgatcttgcctttgcctttgttgccttcattaatattcaccttggtgccaaagcgttcgccaagttggttctcagttgcccgcacgtatggcgactttggcttttctttggttgccgggcgcgtgttgccagcattcatctgattaatgagccgttctagctggcgcacagtcaggttttcattgattgtcttcttggccacactcaccattttggacttatctttgagacttaacagcgtccgtgcttgtcccattgacagctgattggcacttaacatttgtttgacttgctgcggcagtgtcaaaaggcgtaagtagttcgcaatataaggtcggcttttgccaagtcgtgccgatacttctgcttgcgtcagattcagacgcttgatcaaggtgtcataagcctgggcttcgtctagcggcgtcagatcttcccgctgcaagttttccagcacagcgatttccatcatttcgggatcattgaagtcccgaacaatggatggaatagtctccttgccagccaatttagacgcacggaagcgacgttcaccggtaataatctcatagcctgaaacactcttgcggacaatgatcggttggaacacgccggtttgtttgatcgaaccagccagttccttcaagccttcctcatcaaacgttttacgcggttggtagggatttggtcggatgtcaatcagcggtaattcttcaactgtattattggcactcagatctggactctcgaaatctttgaaaatcgcatcaataccacggcctaagcctttgttattcttattcgccatgagcagccagcacctccttggctaaagcctcgtaaacctctgatccccgggactttggatcaaaatccacaattggcagaccatagcttggcgcctccgccaatcgcgtaatccgcggaatcaccgttgcatatactttatcgccaaaatacttgcggacctcgtcaatgacttgtgcgccgagattggtccgcgcatcatacattgtcaacaacaccccttcgatcgctaagctcggattaaagtgtttctgaaccaaccgcaccgtgtttagtaactggcttaagccctccagagcgtaatattcgctttggaccgggattaaaatcgagtcgcttgctgtaaatgcattgatcgacaattggccaagcgatggcgggcaatcaatcaaaatataatcgtattgatcctccacaggatgcaatcccagcttcaatcgcatttcacgcgccatttggctggttaactcgatctcagcgccagccagttgaatggtggctggcacaatcgacatgttcttatgtttcgttggcagaatggcttcggtaatcggctcttcgttgactagcacatcataaatatccttttcaacttgggccttttgaacgccgacgccactagtcgcattgccttgtgcatcagcgtccacaatcaaaatcttcttgccaaggttggccaaacaggcgcccagattgaccgtggtggtggttttgccaacgccgcctttttggttagcgactgcgatgatatgtgccatgagctcctcctatctcttttctttcggaatctcgatgatcattcggtaagcgtcgtcagtatcttcttcttttgctgtgaccgtcataccggtttcccggatcattttaaccgaacgttttaatgtgttccaagcaatgcgcgtatcatggctcaccgcggatcgtcgaactttaggtttcggttttggggttggggttggcttcttaggccgcaacatctcattgataagggcactggtttctttaacggtcagatcgtctgaaaaaatctggtgtaaggcggcaacctgttgcttctcgtctaacttcagtagttcacgaccatgccgttcactgatacgcgacttcattaaagcttcttgaactggctcgcttagtttcaataaacggattttgttggcgacaaatgcctgacttttaccgagttgctcggccaaagcggcttgtgtcaggtgattgagtttcataagtgccacataagcttggccttcttcaatcgcactcaagccttcgcgctgcaaattttcaactagtgccatggatgcactttcgtcgtcgtccattttctgcacaatggctggcgctttttcccagcccagggtttgcatcgcgcgatatcggcgctcacccgcgatgatttcgtacttttccggtttatattcacggacaataatcggctgcaacaagccatgatccttgatcgtcgttgctagctcccgaatcgattccggcgtaaagactttgcgcggctggaattggttaggcacgattgcggttattggcagttgttgaacaaccgtttcgtcgtcaggctttttatggccaaaaatggatgataatggcacgcgttatgcacctcccaaaggttgcttattcggtatccccggcttgcgcggatatttgtttggtgttggtttaactttgtcgatgaccagcaaatgacgtggatcgccggtttccggcaacgtcaacgcagcatcttgggccaatttgccgccaagtaagccaatcgctgacttggccgcaattaattctgcgggtgtcgccgcggctttcatggccacaaagcgaccttgcggctttactagtggcaaacagagctcagccaagacatccaatgccgcaaccgcacgagccgtgaccaaatcaaaactggcacggtgtggcgattttttggcaccaaaagcttcggcgcggtcatgaaagagctgaacatctgtcagctccaaacgcgccgttaatcgttcgagaaagccaattcgcttttgtaaagaatccacgatggtgattttgagttgcgggaacgcaatttttaacggaattgatgggaaacccgccccagcacccacatcacaaactgacattacttgtgtctgaagctcaggtagcaccaacgcaagcgttagtgaatcgtagaagtgtttgaggtagacgtccccttcagctgtaatgccagtcagattcattttttcattctcactgatcagatactgatagtatgccgcaaactgatcctgttggtgatcgtttaaaacgatcccgtgatcagccaaggcttggacaaaagctgctggatccatgcctgcctccattttcgtaaacttgattttgtggaacaaacagggtttcacgtacccgtcaagtgtaacgtaaaagcggcctctgctcaaccgtctttatatggaaagaacaggcgttaagcgcaagttttttgacacacctgttatgccttcctgctcaaatcaagattcgctatctgggctggctgcggtcgcgctactcacctaattacccaaccacaagatttgtctgaacggtcccttgtcatcttgcaaaaacgcgttcacagttcgataatgaaatggtaactaaactcagaggcgagaaaaatggaattagacggtaaagaaatcaaagaaaatgaacaactgaccgatgcccagctggccgatttgcacaaacagtatgaggctttgtgggataagttaaaaaaagacaactaccgaactgaacatcaattcatggaagttttgtacgaggaacctgacaatagtcaaaactatgaagctgcctttttcacttatcaaattcgtaaagatactggcgataatcaatttgaccagttgaccatcacgttaaacaacaagccaaccttccacgatcaaccagatgaatttgtcttcgaaattagtgactacgcggatatggatgctcttcacaaggcaattgaggaaaaagcccaaccgtggattaaggctcacaaacgttaataaccagactaactcgaaacacttatcctgtttcgagtttttttaattaaaaccgcactatgcactttctttcctctcagccaacacttgtggtaagctgttgccagtcaaacaaacggagggacccggctaatggcggataaaattaaaatcgcttatctttatgaagacctcatgaacacatatggcgacagtggcgatgtcaaaattctacgttatttattaaatcaacaaggttaccaagtcgatgtcgataatgtcagtcttggcgatcattttaatgcggacgactatgattttatcttcttcggcggtggtcaggactatgaacaaaccgtggtagccaaagacttgttgcgccatgcccaaacacttggccggtatatcgaaaatggtaaaccgatgctggcaatctgtggcggttaccagctgcttggcgattattacaaaactagcgaaggctcagtcatcaaaggcctcggcattttgccgctgcacacagttttcaagccagacagtcgcatgatcggtgataccaagtacgaaaccgagttcgggacagttaccgcatttgagaatcacagtggccggacttattttgacgacaagcaaaagctcaaaccgttgggcaaaatgattgaaggttacgggaataaccctgaagacggtgtcgaaggtatgcgttataaaaataccattggcagctactcccatggtcccattttgaagaatcaaaatattgcgaaggcgatcgccaatatgattgtgaaaaatcacaaggcacggatgggtcagcctgcataattaaaagagcattgccgcagtagacgggcaatgctctttttatacgaatttcatatagctttggcgcccagttaaccccttagtgttgcacttgagcacgaacctgatcagcatcgccagcaaataagaacaacggtccatccgcctgtgctggatagctatctgatagactgccgagatcgacaacatcaaacccaattcgtttgatcaatgtcgtgaccgtctgcttagcggcattatcatccccggcaatcggaatggcaattcttcctgctggctgacttggcttggcaagactacgaattttggtcatcgcaattgtattgaatgccttgaccacttttttcgtaccaaaatgtttagcaacgagttctgatgaagtgacttgatgtgctgccagtgctggctggtcgccatcgcggctaggataatagttagtcgcgtcaataataatcgtcttcggatccacgcttgtcggcaattccggcaacgcattaaatggcacggccagcacgacaatgtcttgtttagccgcgtcagcaacggtcccagcttcgaccgtcgagcgcatctctgcaatgaccggtgccaatgatgccacgccatgccgatgtgaaataatcacctgctcgccaacatgactaaacagttggcctaatgcccggccgacattacctgatccaataataccgatagtcatctaatcaccctctctattgagatcacaccttcattataccgccttgcttctttaaataccggccagcaagcattctagcccactcaaaaagccgcacacccgtcatgcggtctgcggcagttcaaataaaaaatgatccacaactatctagtgattcttgccttcaatcgtttcgatatcgcctttgccgtcacgggagacgatggccctgatagcggcagtgatgcctaaaacatcatcatccaatgacaacgctggtgtttccggacgagtgacaacctgttccggcaaaaatggaatatgcatgaagccggccttaatatcgggaaacatcttatcccgcatatactgtacctgataaaaaatgtggttgcagacgtaagtgcctgctgtgttggagactgctgccggaacaccagcttcccgaatggctttggccatggccttaatcggtaactgggtaaagtaggcattctcgccatcgccatgaatcgtgtgattaagtggctgatacccggcattatcttgaatccgaccgtcatccaagttaatcgcaactcgctccggcgtgagttcaaaccggccaccagcctgaccaatgctcaacacatagtcaggcttttctttggcaatagcatctttaacgacatcggctgaaacattaaactttgtcggaatttccaatttaacgatttgtgccccagcaatttcatccggcaaacgtttcacggcttcaatcgcaggattaattttatcgtcgccaaagggatcaaatccggtaacaagaattttcatgagaagatttcctttctaaaatgccaagaagtacatgaggccgatttgaatgatcaacaatagtatcgcaattggcgcctgctgtttgataacaccaagtggatccttcatttcgagcaacgcgactggcaaactattgaagttcgccgccattggcgtgagcaaggtcccacagtagccagaggtcatgccaatagccgccacaatcgctggattagcgccttgcgcaatgacaaaaggaatgccaacggctgccgtaatcacggcaaacgcagcaaaggcattccccataataatcgtaaagagcgccatcgccacacagtatagaatcacgccgccaagatgacttccagttgggaataagccggcaatcaatttcgccgtgagtgatccgaccccagcagcagtaaaaactgcccctaaggttgctagtaattgcggcaaaatgccagcagcaccaactgaccgaaccatccgctgggtatcattataaaccattttgcctggcgccttcgtcatgatgatagccacaattaacgaaaccgccgcaccaacgccaatgccgacctgaccaccgagtttggtaaactgggcgacaccgatggaaacgactgcaagtaccacgcttgggacgaatacccaaccgccaagccgtttggccgctgttgccgcgtgtgcgccgtcaacgggcttaattttgcctatctgaatctgcttgaacaacgccaaaataccgataataacaactagaacaccaacgaccatcgcgggcatcaaggtcccaaaggcaaaaatcactgccatgatctcccaaaacaaaccggttccgatacgtgccggattatcttttgcgcgaaacgcctcaataccagcaatcgccatcacgacgccaatcagagcataaaggatcaataaaagggtattgaccatgatcatttgcctcccttatgcgactgctgttcaaattggcgatcaaaccagcgattgtagatagccacaatgaccaacgtgatcaatgccactggaatggatgctaaaacgacctgcatcggctcaactggatgattgaggctcttcatcgtgctcgcgatcaacaagacacccgctgttgcaacaaacaggttctgcgcaaagaaattgccaaagttgtcagtcgccgcagaacgcgccttaataaggtcgatatcttcatctgttagcttacgtttggtttcagccgccgccgttaccatcggcgtgatcaacggtcgcacgaactgcacttgaccagataacgagataccaaagacaccacctaactcgcgaatcacaagataaatattcaaaatacgactgggtgtcaatttctttagcttctgaatgccattgacggcaacttccttgagaccgtggctttccactaacccaatcatcggcagggtcagaaaaaataacgataccatgcgattatcgacaaagctctgcccaagtgtggtcagcaaagccgggatgctcatgcccgaaaaaactgctgtcacaactgctgccaaaaccactaccgctgtcgtgtcccacttcaatgcaaacccgacaacgataatgacaataccaagtaattttaagtattccatgtaggatccccctttgttctatgaaagcagtttacgtgttgttgttgacagcgtcaattcgttaagggggattatcaatcgtgcaaactataaaaataacttgtgcgtcactagtttcctaaccgagctggctcgcgctcacaaaaaaaccagttcaacgactgaactggcaatttatatcacgattatgctggctgaagatccttttctttgtcagcatctttgttcttagcctcgttacgagcaatttcgtctttggtgagcatatccttaacggtcatcttcacctcagtgacattaagtccggtcatttggcggacattcttgacgattgccatcgtgactttgttgaaaatttccggtgcattttcaccatatcgaacggtggcatcaagtgacacagagacattctgatcatcgctcaggtctacatccacacctttagtcggatcttcatctttgcggaaaagatcggtcatatttgccatcatgccgccttcaagcgagtatacgccttctacttcattgcaagtgatgcccacaatttttgcaatgacagcgtcatcgaatttcaattccttattgatgccagcgtttttcgtgttgtccatgtttatctctcctttgtcttatgaaggttcaacatcattttttttgccactcgcgtttagtcagtacatctttgacatgtagattgagttcaactagctgtaggcccgtcatccgggtaatctgagcactgattttttcgcagagttgtttaaaaatagcttgcgcatcactgtcaaatgccagaaacacatccatatcaattgctacttgtttctcgccaacttcagctgagatgcctttggtgatattctcgccgctagaaaaggtttcggtcagattgtccatcatcgttccgtccattcctagcaagccatcaatctctcgagcacaaagcgcagcgattttttcaatcactttatcttcaaacgtcaatcgactattggccatcaatgtttctcgtgtaacagctggtgatgctgctactggcggtgttgcaactgcgtccatccgttcacctactttcctttactgaaagcatctttgccggcggtcaaccaactggtaaatgcatgccaattgggtactaggtaacgctcaatcagccagcctgctgcgccgaagatcaagaccaacagcatacccataaacccgaatcgcatccaggcgaaggcaagcacgatcccgatcacagcaccgatcattcctcgctgcattgtcatctctccttctagctgagcacgtcgtcaaaggcatcgacatctttggaaagtgtccgctttgaatgccatttgcttgttgtcccagtgttgtcatcgttaaatcacacgggccgttttcgctttgacctttgtggctggcaagagatgcacccgcacatgcttcacaggaataccgagacaggcctgcaacttctgacgagcagtttcttcgatttgcttggcctctgccttcagatccttgctattaccggaaaaagcttcaatccgcattcgtgcgacttgcttcttgcgaatgctaacagctaccgccaccgatttggcaaaatgttgcgcaacaaccgctttggccacggtgttttcgatcgcacttttatcaagcgtcagatcaccatcttcaccagctagaatcagcgactgagcggttgaccgcctgaaaatggcgaccaatagcatgatgaggaaaaccaaagcgacaagcccagtcaggcctatcatggttggccgcagccaaacgacttgttgcagataaaatcgcgtaaactcacggcttggccaaagcaataacccgaaaccaacactttgcaataaaccgccaacggcaatgatgccaagcatgatttttgtgatgggtctcatggtcatcggcctcctatgccttgcgccgtgtggttcccagcaacagggaaacaaggaagacgacgatgatggcccctataatggctgggatcaaggccattccggccaatgaaggcccccagtcaccaaggagtgccgtgccgagccatgcaccgactaagccgccgataatgttaccaagccagccgagtggcatatcgcgcccaacgatcagctgtccaatacaaccaatcaccgcaccgatgatcagtgtccaaataaaatgcatcatggttctcaccctttcttttggttgactttcttctgactatcctaagcttaacgaaacgaggttattcgaagcaataaatatgctaatgataacaattagtattttactaggtatacaaaaaatgcctataaccatgcatatttgcaaagttataggcatataaattgtttaattaaaaatcatggcatcatgagctgctcgttttccgcgttaaagtccgggaatcagcccatcaaccttcaatcaagtcgccagcattaggaccggcatccagtttatagatacgatcaacattaatcaaaacggcactgatggctgctggcagatgatgtgccttcgcgaatgcctgagcatcttcaaagatcttgtcatcatgatggaattcaacggtcccttcaaaacgaaaacccttgagtgccttgtaatcaaccgtcgcaaccgcagccttcttagaatactgcaaattatgccatgcctgcttacctgtctcttcgttgtaaatcaggtgatgatcatcgaagacacgcatcgtgcctttgggacccacttgtggattaccattttcatcggcagtagccaaatagttcaattgtgcgccgatcatgtctttcatatcttgtgtcaaagttgccataaatgatcaatctccttttacttactttttgttaacagaaagagtgtaacacaatcagccacgattcgtcatatttttatatcagagcgttcgcaggcgcgcttagaaacctgagtgtaagcggcctcgggcgtgatggccgggtttgggtcattgcgtccgaggtccttacactccggtttctgcgcctgcgaacgcgtttcagtcaagagcgtgatggccggtttttggccattgcgatcaagatccttacacgtatgtttctgggctggtgaacgggagcgtgtatatctagaaatatggttttaggcaacggtttaaccatgattggatttctaagaagacaaaacttccgatgtgatttctttctttttgtctaacctgtactacacttaagttaggctcttaaaagtatcagttcgggaacttgtaacgcaatccgccatgatgatgctaaccgcacacccatagtgattgtgcagacgttaagactgatcaacaaggttaagggggaaaatgatccatggcaaaagtttatatttctgcagcattgccgaaatcggcgaatgctgccttgcaaaaagctggcgtggattttgaagcatataccggcagtggtttaatcaccgaaagcgacttacaaacacacttggctcatactgaggtgttgatcaccgccttgtccacaccagtaacggcggcaaccttggcaaaggccccacatctgaagctgatcgctaattatggtgccggtttcaacaacattgatgtcactgcagccaaggcccaaggtgtgcttgtaaccaatacgccaaaagtatcgaccacttcgactgccgaagtcacggtggccttaattctggcggtcttacaccgggtcacggaaggcgatcggctaatgcgcggcgctggttttgccggctgggcacccacctttttccttggtcacgaactggctggcaaaaccgttgggattatcgggatgggccaaatcggtcaggccgttgccaaacgcgtgcatgcttttgacgcaaaaattctgtatacccagcgccaccaactgacatcggccacagagcaaacactaggcgcaaccttcaccgatcaggccaccttgttacgtgaaagcgacatcgtgaccttacatttgccgctagtaccagctacgcatcatttgctggacgcgcaggcaatggccactatgaagccgactgcctacctgatcaatgcagctcgcggcccgttaattgatgaaaccgccttgcttcagcaattgcaggctcacaagttagcaggcgccgcgttagatgtctatgaggctgaaccgcatgtcagttcaggtctcaaggcgcttgataatgtggtcctgacgccacacatcggaaacgccaccgtcgaagcgcgggatgccatggccaaaatcgtgactgacaatacactagccattctagctggtaagcagcctgagtacatcgtcaatgcctaatcagtgctggatggttgactaaccataaaaaagacgcctgtcgtcacacaatgcgtgtggtaacaggcgtctttttggatgaaatgccatttcatttaatcaaggcttacgcgaattccgcggttgccaaatgcttgcgactaacaaagctaacacaatgccaagtgttaaaccaagaccgccaaccaaaaaaggattggcgatctgattttgagtcatgacaagatcaagaacgccaattaagcccacggcaatgagcaccaagacaatacggtaccacgccgttttcgtcatagatgagccagaatcgtatacttgccaactgctttatagtcacctttagcctttgaatcaggcgttccggcagcttcgtaaaaaacggaatacttgccgtctttatctttagcgacaaccaagccttcatcgacaacatgttcggctttgtaaatttgggcactgcgtcgagccgcggcgaaatcaaaatcattggcgactgcatcgccggggttgaagaaaacaatttcttcgctcatgaagatcccctcgctttctggcttcattataccacgtcaacatcgtctcacttatcagcttgaagcgcctcagccttggctatcaggcttttggtaaatgctgcaaactggggcatctcctcttgcttgacatttaaggcaattttcacagggtcagctccttgaaccgccccacttgccgccaacacggcttcaaacaactctggcgcggtattgtaatctttaccataatacggatcgcctgtgccaagcacaccaaataccaacggcttagcagaaaaatcaagcttgctgagatcctcgtaaaagtcttcggtttcttccggaataacgccgccagtccatgtataagtggccaaaaccaatacatcgtaatccttgatagttgttgggtcggtttgaatcatttcaccaagggtcacgtcccaaccataatgttcaaagaactgctgctcgatccgtgccattcctttggcattgcctgtaatcgatgcatataaaatgattgccttcatcgtcctcacctcattaccttcagtatactgataacatcagggttgtaaaagctttcaaaaaaagcatggacacgaaaagttgttttttcatgcacatgcttaaaaaattcagctttcacagcgggcaagttccatgaatgctcacgacgttgccactacaaaaacgttcaactggcagtttcaacagtaccttcaccttgcaagatgaaatgaacggcatctgccaactcattttccttaaaaaaccgaatttcctgatgacccgaaaaatcatcaatttcgataatcggttcaaaaccattaaatcgtcgtaactcttgacgcagccaagcatcccagacttgtgtggctaagccttgctgctgacccaaattacgccgaatgatgatattcttattgtcccaaattcgaactcgcaattgccgatcattttgatcagctgccaagtcctgtagataagcatagtgttccataagctcaccttacctttcaacaaaagacagcaagctaacagtgtctttgcgtcaagcaaacgacgaagcatcatcgcctaggtgtctatgctaaactagaggcaatgatccaaaaaacttgatacaaccaatgcgctaatggcgctagggggcaatatgacgaattccgaaactaaacaatattcatggcctaaattccggcgctcactgcgctttgggcgaccatctgccatcattcattttatctacttgctagcaattgccccatatgtgttttgggccatttacttcatcgggttaactgcactgctgctggtatcaaaaccaagtatgttgctcgctttgctaagttatattggcaagctattattacttgatcccatcttgcaaacctggcagttactgacatctttgaacttcgccgaaaccggttggatgctactgattgttatcagttattggtgtgtcatcgcaggcattgtcatgcatattgtccaccgcattcgcaaacggcagcttttccatcaactcatatcaggacaggcacagattatcacaaaagcagatcagaccttcgtcatggacaagcaccagcatcattacccactgcttaagcatcccgtgcgatggtggcaggccagtccggatcggcggtggtactaatggttgatctggttaataccggatcaagaacaacatggtgttaacctttggtacaacctcattatacaaacatacgttcgtaaatgcaatagctttgtttactgtcgctttgaaattggccattagaagtttgttttaccgctttaatcaagcaactcagtctgacaacgttacgattgaatgtcatacgtgcgcagactggtaaaaatcgttatactgttagtaaaggctcacgaggaggaatcgttttggctgaaaaagatcaaatcagtgcattttcacgggagattattgacttccagcgcaaaaatcatctaacagacacagagatggcgctaaacagccacgtatcagttgaacatatccacaatattaaatccatgcgtgagatgccggattcttccgtcgtcgccacactgaaggattacatggaacataagccaagcggcaaataatgatgccactgaaaagcgccgatgcaaactcattaaagtttgcatcggcgcttttcgtttgccggctcagaatagctaactcatgagctaccgattacccaagtagccaattgtcatcgcacccagcaagataatcaaaacaatcgtcgtaatccatacatataaccgatcgtgttcaactgcaaaagcgtaaatcgaaacgaccactcgcaacaccggtgtcaggatcagcaagaagatgcccgtcatcaaaaccgcatacggcttcagtgccagcgtcccagataaaatatcaccaacacgtgttggatgaacgccggtcgcgtatcccgttgagccagtgactaacaataaaagcaggccaagaataatcaccaaggccgacaaaacgaccccaatttgcatgaccttaccgatcatgatttcaacgtcatcaatttcagttttgagttttttgtccatcagatgttcaccccgaatcctttaagtgccatctgaatacccatgtagccaataacaggaataaaaatcagacgtaagacttttgttggcagcatcggcatgatgcgtgagccaacggttgccccaatcaaaataccgatagcgagcggtgccgcgatttgcggctgcaattgtccgccaaaatagtacactgtcgcacttgctgctgccgtaacccccatcatcagattactcgtggcacttgatggctttagcggcatatgcatgatcgtatccatggcaatcactttaaaagcaccgctgccaatgcctaacaacccagaggcaatgccagccccgaacatcatagcaaatccgcctggcacatttgtcacagtataattgatttctttaccagtcgccttgtcaaaatacgcgccattcaatcgcagtttagtcgcaatctcatctggttttgactggcgctcttcaggctccttcatccgcattttacgaatcatgttgaatgcagaaaaaatcagcaaggcgccgaacaagacgtataagactttgccgtccacaagaccagtgacaacggcaccaataactgcgccaacggtggtcgcaatttctagaaacatcgcaacgcgcaagtttagcatctcatcttttaagtaagcaatggtggcgcctgagctggtagcgataaccgatacaatactagcaccgatggcatattgaattggcaaccccatcaacatcgtcaaaatcggtgtaataatcatcccaccgccgatgccaagcacggcaccgagaataccgccaagtaaaccggtgaccattaacattatcatttgttccatttatctagcctcgttttccagcattttaggatggcaacgaaaacatcgccatcaatttgttttattttctaaggttagcccacgtggtaacaaggtttcaagccctcaatatcattcccgttgcttaccaactgccgccaaatccaccaccgccactgctgccaccgccaaatccactaccgaaattgtcagaaccgccgctgctaccgctgccggcactcgacccaaagtcggatacaacccaaagtggcaagtcgtattgacttaaatcctgatttttttctggatgccgaatatggaacaagataacgccaaacgtggcagccaacatttcagctgaaaaacgatccgtttctttaacattttcaagaaatttcgaccaagttgtcaccgcagcttgaccagcaacattcttttgttggcctaaccactgggcataactggcttcataaggtctgccttttgcaaaacgatcagctaatgcgggggttaataacgctgctaatgctgaaacagatggggccgccaccacatcttgatcggctaattgccgcagtggtttgcttgtttggtagtagtaccaataaggatatggtgcggtcaaccgcagcacgcgcgtccacgactcgaaaccacgacgagccaaattggccagaccgatttcgcgtagcttggcatgtgaccaagcgaatttgaatagtggtaaggaagctgtctgtcggcgtaccggaatgcctgctgccatcacagccgcatacaacggcatcgcctccaacgcaacggtatcacgcatagcatcacgcaatcgggcagccatcgccatgtggactacgaagaagagtaccagcaaggccatcaaaatcaaagcagcaatcaagattgcctgctgaatagcagcatcacgtgcccgtttagcggttatttgggcaggcgtcgcgatggcactttggtttgctgtcacgcgttgaccaatatgatcaagaaacagtgcgattgcctcatcgtagttctgcgccttcagctgtgttttcacgttcgaagtaacaatctcgtctgcgctcccgtctggcacgacgtcttctaacccatagccgacctctagccaatacttacggtcttcgcgggaaagcacaagaagcaagccattgtcccagccttttttgccaatacccaatttagcaaactgatcattggcatagtcttcgatttcgtcatcatcaagcgacttgaccgtgatgactgcaagttgaggatgaccctttaccttggcaaacgtctcattattcaaacgattgaccgccgcctggctcttagctcccatcatgtcaccgtcatcgcgataccatgttcccgaagccgcttgaaccgactgttgcgttgctgccccaataccaagtagcaagacaagcgggatgagccaccaaagatatttgtgcatgtgaacctcctttgacgcgttttgacgcattcatcgaatcgagtcgcgctgtcaaaatttgcaattgttgctctcatgataccatgagccttcgaccagcttacacgccatctggcaaaaataaccatgcagcaaaaacgaccttctcactttcgagaaggtcgtttggctaactttgactgaatttaatccttgacgggatcaatttccacaaacgtatcatttggtacccgtaaaatcgagaaacggtcagcaatgttgccaacatgcatacctaaaccgtttaaaaagcctggcttgtaacgagcagtgaccgttgccacgtaggcttgatcggccgtctgatccaattttttcaggtcttttttcgaccatggatagcctgccgcccgcggggtcaacggttgtgtaccggcactaacttcagcattgtgacttgtattttcgtatttagcgccgttagtccagtaagtgtagtacaaggttggattcttaccattccctgtttggacacgaacataaaaggaatgatcctcgccagtttgtaaaatgagatgttctgcgctgtggctaatagctaccgcacgactatcacgataatcaataggccgtaaccagctcacccaaaccatgccaatcgcggcaatcgcaaaaacaagcacttctgcaatgtcaattaacaccaccgagccacgaacttgctttccggatttaacaattgctttaatgtgccgttgccgaatgtgccagacgatgaaaatcaaataggcgatgagtatcacccatgccaacagtccgataagattccacgaattcataattttccccctacgccgtcgtattatctgcttgcgtcacagccaattgccctaacagattcaaataatgccacggtttatcataattcggattgaacagcatgtcgacataagccagctgatcaatcgtgttacgattttggatcatcacagaaatgagattagctgcatttacaatatcatattgactataaaactgggcacccagaatccggcgatcatcagtatcatagacgagcaccatcgtaattttgacggtgtccggcatgaatggcggtcgaaaatcatccgtcatcgtgacactggcagccgacaggtgattgcgcttggcgtgagcaagcgtcaaacccgtcacacctaagttatgatcgtacaacttcagcgcgcttgtggcttgcgttcccatatatttaatcgttggtttaaacaagttagcgccagccatcatcccttggcgcacagcattggtggccaaaggcgcataagcgtccttaccagtgggattgaaatggacggcgaccgcatcaccagctgcaaaaatatccggattgctggtctgcatataatcattcacgtgaatggacccatcaggattcatatcaacttggccgatcagcaactcggtcatcggccggaacccgacacaaaccaccgccaaatctgcctgtatttcgcctttatctgtttgaataaaaacatgctgatcatcactatcaaaatgcttggcaactgtgttggctttcaactcaaccccacgtgttgtcagggcctcactgatttcatgactaagtggtaagtcaacataatgactaagtaaaggcgaaacaccattaattaacgttacctgtttatggttgcggctataggcttccgccagttcgacaccaatatacccgccaccaacaatcgcaatatgctcagcatccttggcactttctttgattcgccgagcatcatcgtagtttttacacatcagcacccgcggaatactgacacctgaaatcggcggaacaacaggataactacctgtcgccatgactaatttatcatattgataatgttgttggttgcccgttttaagattttcggccaaaatccgatgatcagcggcatcaatgcttaaaacatcatgtttgagatgaacgtgaacatgcggccccagcgcctctaaagaagctggcgtagcataaaacatatcttccaatcggccaacggtaccttcaaggtataacgcgatgccgcaagaaagaaaggagatgtcttcccgccgttcaaagacatccacttctgtctctgggtgcttcatcaacagttcgcgcactgccgcagttcctgcatgcgtacagcccacaacgacaactttcatcagcatctgccttcctttcaagattgtcaataatgacattatgacacgaaaatggctaaacctaaagcatgtcgctaaccgctttctggcgcttacaagtataatgaaatcgttgcttcacaaatattcaactcataaaggagcgctgcacatgcacatcaccctcatcggcgccggccctcgcggcttattaattttagaacggctactcagctggcagcaaaatcgctttccaaaacgccaactcaccatcgttctgaccgatccttatccaattggcggacgcgtttggaaaatcgatcaagatccgaaccttatcatgaatacagcagcgtcacagatcaccttattcactgatcaaacggtcaccgatgttggtccattcttgaccggacctgatctgagcacatgggcactcacaactgcatctggttaccttgatgctcaccctgagttcaataaccgcgcgatcctactgcggcaggcagcagcactgggacccaacaactacgcttcacgggcactttatggtgtctaccagcattggttctttgacatgcttgtagcccgcgctggtaacaacagcatcacgtttaagcagcaaaccgttgtcagtttagctaaaaacgccgctaatttcacaattaccaccgatcaagaaagctggcacacagaccaagttgtcatggcgcttggtaacctaaagaattccttgacgcgcgatcaaaaagcattggacgattacgcccacgctcacgatttgttttatctttccccaggtttccctgaagaaggtgaccttagcaccatcgaaccgcaggcacctgtgatcattcgcggacttggcttaagcttctttgatttaatgagcaggttaactgaaggccgcggcggccgcttccagaaaacagcagacggcttgctggcctatcatcccagtggtcgagaaccgcacatttttactggttctcgacgtggttttccttaccgggcaaaaggtcgcaaccaaaaaggacccggtgaagaatgggagccacagtttttgacgactgaacagatcaatacttggcaagcacatggcgaagtgagcggtcaaaccttctgggaagcattgcaacacgaagttgaactagtttattatcggctcctgctagtgcaacgctaccccgatctagacgtaactgcctttgagcatgacttcgtcgccaatcctgttacgacgctaggcacattgccaattgccgccaaagatcgacttgattgggatgccttggctgatccaaccaagtggcatccaagcggtcagccttatcaggactttatgcggcattatctgcgtcgagatgcacgcgaggccatgcgtggcaccaaaactggaccattaactagcgcactagaagttttgcgtgatatgcgcgacccgattcgccagctcgtcgaacgcggtttgttgagtcaagatcagtacctcgatttcttcttgcgctggttcaactcgctgaatgactttctctccattgggccgcctgccttgcgaattgatcaattgcaagccttgctaggcgctgggatcgtcactattttgccaccggggatgcaaattaaaggcatcgatggtcaatttttattgaaaacaccaagtgatcccagcttttcggttcaggccaagagcttactcgaagcgcgtgtgccggctgtcaatgcgccaactgcgcaaaacgcattaattcagcaactcttgcatgacggctatgcgcacacatatgagctgcagttgaacgctgacaagcgattccaatccggcgccatcgccgttgatcgccaaacccaacaactgcttgacgccaacgaacaccctcaacctggtctcttcttctggggcgtccctactgaaggcgtacattggctcaccactgcaagcccccggccactggtcaatgacactagtttgaaaacggcagaacagattgtgcagacaatttgggaagtgtgaagttgtatgttgcattaaagcatctaagattaatctcttgccgtgccaaactccgcgatctccggccagctggggctgacgacgcgtagctagagcggagacggcgcttcgagcccgcaaagcccgcggtctcgaagtcgcctaacaacatcagcgccaagaccggtcgctgtgttgtttgcacggctgagccccatctggccaacgattgctctgccttggcactacggtctttaaaatcgcaatcaataatccatgagcaggcaaaagcgaacaaatttcctttaagtggaaaattgttcgcttttattttgccgactaagaattacgtcccagactctttatttgccggttgtaaatgatgttccacttctccacttctattgcggaaaagctctctatcttggtaaaaacactcactggaccctctattttcccaattcgatgaattgcaatatctcagggctcaaacattaccagcagaatcgttgcttgatattttcgtttcacttatgaacatcttcgcttgattgttgaaagcgacaaaaaaatttgtcgatccgatttctttttgaatttcaatcattcttttgacgttattttcatgttcaactgttggctctccgcagtagtcacaaaatgcgtctgcgagtgcaatcaggtatcgttcagccatcatactatcttcaacatggctatgtttcataacccgtaaaaaaagtctggcagttgtcaggtcttttgcggacaaatttaaaatcacgacgttatacagcaaatttatagtcaattgaaagttttgatgtatcgcccatgcttcattgatttgagcggctagctcccgcgccaattggttgacagtaaccaacgacaaagctgacatagtatttccaaagagcaacaactcaaagtgtgtccagccatcaacactaaataaatagtcggcgaggactttagtatcagcctttggaagggttcccttttccatatcgcaaatcatcgccttgaccatgatcaacgtgagctgattatactttccatggtgtttttttagatgttgctccgcccgttctttcacgagttgcgcctggtctttgttgttattgataactgcttttgtaatgtcctctaatatggcttgttcatacagtctttcttgaattgccaaagcgttcccaaactcagtaaacgtcacatggagccgttcaagtaaagccagaaacttatcaacggaaattttcgtcaaatctcgttcaaacttcgacagctgtgctttcgaaagaattccttcgctgagttccgcctgactcatacctttgttttcgcgaaaatgattaatgagttccccaattttttccatgctgcagttcccctttttcatatatgaaacaacatttaatggcaccatattagcacatatacttgagtcagcaaaaacaacaaagtcacaccccacaagaaagggagctgtctcatgaaatctacaagtaagttgttaacaaaccaaaaaacactaaccatcctgatgatattcctaacagttattgaatcactcggcagggttgcgagttctttaacacttgccccgttaactgatcaactcatttcaaaaaaccttcacggcgtggttttttggttattgtctaccattggtatttggggcgtcacattgacggttaattatggtaactcacttttaaaagcccagattattcgtaaggtaaccaatcagttgcgcgttgatattgccaatggtttgaatactgttccaatttccgaatacaaaaaagtcaatcataatgaatacgtttcttggctaacgaatgacgttaacatgattgatcagaacggactggaggcctttttctcacttctaagcagtgccactaccttgctatttgcaatcacatctctggctttctatcattacagtttagcgcttgccgctattatattaggcctcctgacgatgacaattccccagtttttctcaaaagtcatgacgcatgaaacgaatcgcttagcaactgcgaacagctcatttttaggcaaagcagatgacattatcggtggtttctcagtattttttagtcacaatcttgtcaatacactcacaaataagctagcgactgcgtctgatcatcaaggaaaagaaaaacttctttacgccaaaaatgtaggattggttaatttgcttattagcggtgttaatgtcggggcacagatgctagtcatgacattaacatgcttattggttattggtggctatttcagtgtaggggtcatctctgccagtggttcattagcaggaacagtgttcaataaccttgcaggcatgattcaaagcatctttcagatgaaatccgttgccgtattgcttgataaagacatacaagcaacaaaaattaagactgtttcagaagacgattcgtttaatcatgccttgacagttgatcatctttcttttggctatgaaggtaaacccgtcattaaggatatctcctataacttcgagaaaggcggcaaatatgctgtcgtggggaaaagcggcgccggaaaatcgacattgatcaaccttatcagcggacgacttcgtgattatgctggtactatccaagttgatggtgacgaattaaaatcaatgccggcaacactgcttaatgccaaaatcgaactggtagatcagaaatcatatattttcaatgagagtattgaggaaaatattacgcttggccatgcaaaatcacaggcactactttctaacgttgtaagcttcttagggattgataaattcacaaacctagcaacaaagattcacgaacacggcagcaatttatctggtgggcagcgacaaaagctggctttagcgcgcgcacttgcttttcataagcccatcttaattgtcgatgaagtcactgctggcattgatagtgaaaatgcccaagaaatagaggacgcactactcgctgagaaagatctaaccgtcattatgattacccacaatctgacggaaaaaacacgggcacaactaacagacacccttgaactagcataaggagatttttacgttgaaaaacaataaacggtttctctttaaaccttcgatcagaatgatggttccttctttcgtggcaccaaaattccttgattcattgagtggcaaaacagccaatctttataagcaacaattttagcccaaagttccctcatcagaaacgttcggacaaaaaaagcgaccaactggcgggtcgctttttcatttcaactaaaaagcctatgcgtaacgcaccatcgcaccgacttcgactggcaagtaggcttctgtcagcagttcaacttgtccgccatgactaaggacgatgtcagctaagtcatttaaaagattagcgtgctgtgcattgatcgaatcgcgttcaatttgggtgccttcaagacgcgcatgaatccgtgcgccggcttggacaaaaagaatggcgattcgtccggcaacggctgcttgaacgacttcttccaagtgatccgtgtagctgtcatttccgcgagcattttcgatgatctcggcaaagttctgacgtcggcgatcgcgcaaagtttcgcgtactggcgtcaacaagtcgtctaattcaacaaaatcaaggtttgctgggctcttaacaacagccagcttcggtaacagatgatggttcttggaaatttcgcggaacaccgccacgttttccgctaaccccatgagtaccagtggcattttatgtggattggagtgattcgccagcacatactgatctaccgcttgataaaaacggcgctgatcgctggctttttccgctgatttctcgttatgcccgtgatgggtcacacgtccgccaccttgggacacgctgttcgtttcgccaccacgaatttcggtgcctagcgttcccttcaaagtctgcggtgcatcgtctggcaacgatatcggccgcacctgatgcccgtggttatgatacatctgaatgctgtcggcatttaacgctaagatatcaaagtcggttgccgttgcctcatccagcatcagtggcagaatctgcggcatgtcagtaaccattgccacttcatcaaccgcttcatacatcggcgtcacatacgtctgtgcgccatttgtcaacatgccaaacccatttgtttcgcaggtttgccagaatgttggatcttgctcatatggctcaagttcagccgcgtatgccgaaaagtccgtttcaggataagtctcggtcatgacgctcttggtatgcttcaccatgtttttgaaccgcaacctcagggcctcaaccgaggtgttctctggccaagacatataaagcgaaacatacggtccatgtttcgtgtcagataaaaagtgctgcagtgtcggtctagtcgtcatatccatcatgatgtaactcccttccggcctttagcctaccttaagcgtatcaatgaaaacgatgaaaggcaaagtaatccgctttaattatactatttataattaggcgcttctgttgatccgagtatcaatagccttacctctctaccagcgtcaacctaagcgtcattctgtatgatggtcgacaaggtggcgaattgcatcgccggaggttaaaaactgtgccagtgatcgcagctgcaacatcctagctgcctttgcaaatgacagccactcaccctccaaaccttcctgccaaaccaagccagccttttgtgcatcagtcaacgtcacccgatgtaccatgatgagttgttggtaagttcgttcaggctgttgccaaaacgattccacgatccccaccagttgcggcaccacgttcagctttagctcttcatgaatttcccgagcagccgcttctgccgccgtttcaccaaatttaaccgcaccgcctggcacaagggcgataccgcttgccgagttaactgtcgctaaaagttggcctgcatgcaccaacaaaaccgccgcccggacatcgaatttagcctgtggattcacttgaaagcgtaaatcattcggttcttgcaccaacaccatcaacctcttttcagttaaacacagctcacataacatgctcttgccttattttctcgatgattcaaatggcacgatctgaaccagattctgcgagtttagcgcttgtggcaaggtcgtgatcacaacccgattgtcggtcgcccgactatagtacgcatccatcattgtgatcactttctgatcttgactcaagtcggcttgtggttcatttggtacttcccgcccctcccgctgttgggccagttgaaatttcatatgtttcatattctgtttagtgatcggttgtctaaaatgaagctggacacgccactgaccgtgtacgatagttgcttccactttttcaagtgaaaccgtccttcgatgtaacacaacttttgcaggcagacttaggctacgcgtcttcactgctggatgggccaatggcgcgttaagtgtttgataacgccaactaaacaatgctacgaaaatcataatcattgccaaaagcccaacagccaagagacgtcgatgcaactttttcatagtggttgcccagcttccagcttattaagttggccgcctgtcaattcaaaaatctgatcggctaaaagctgcagccacatgaaatcgtggctagctaccacgaccaatttgccttgatcacgaagctctcttaataaatcggtcaaaaaagccaccccttcacgatccaacgcattagtcggttcatcaagcaagattaattgctgatcttccatgatggcctgagcaatgccaagtcgctgaatcatgccaagtgaataatcggcaacggctttcctatcatcgcttaagccgaccttttccataatcgcccgtatatcggcgtcactaagttgactgcgaatgttgcctaatgccattaaattgtcgtgcccgttcagatcaccaataaatcctggatgctcaataatcgcaccaacgctgactggtagatcatgacgcgggtcaacccgtacgccattcatcttgacactaccagcagatggccgaataaatcccaacaatgtttttaacaaaaccgatttacccgttccatttgggccgacaatgccgtaaatgtttggtgacaccagtgaaagtgacagatgatcgagaatcttttttcgtttaattgtgacagacaactgctcaacttctaaatgaactgctggctcatgtatgatttgcggcataacgcccccaccttcccggcatataaaaaatctgaataaggactaatccaatgatcaaacccaactggtacccgatggcgcctaataactgctgatcgctcgcaaaggtactgccaatcgcaaagcgcaacggcatcaatggcatttgaagaaaactcaggaaaatcatgaccaaggggccgacgacaccgatgacgatgccaaaataaccttcaagaaccgtttccatgaccagtaatagcagttgactcatcacaatcaagccggtaaacaagccggctgtaaaaagctgttgctcttgccagaacaaaaaagaggctaatccaaacccaacacccatgaacagcaaaactcccgcttcaatcatccaggtttgcttcaatggccacagataagttaagactcgcgggcgaaatcttaaattcaaataaggatatagtccctgctgataagtatgcgtgataccagcactagcaaaaatcggtaacaacatgtagccaaaccaaaggagcagccacagtaattgactactggcaaaacgttcgggggacgcaccgataaagatcatcatgactgagtcgtgaacctggcgaagcaacccatttgtgcgatcttcaaaatacaacgccactgaccccatgagaagtccgacaaatagcagtatcacaatgatgactctttgtcttagcagtcgtacttgccatcgtttttgcatgccactcacacctctaccggtaagcgaatacgcctcaaagttaacaccatcaagcccgtcacaaaaatcatcatcaaaaactgtttaacaacactgattggccacatagcgtttacggctaattttggtgtgatcagaggcgcgatttcactcagattgaaaacaggtgccgcgtgaaaaacaatcaccaaactcaacccacagaaaatgccaattgctcgcgacctaaataaaagacaccctatcagtgtcagcatcgtataagtaaagagggctgttgcaacattcatgaccaaattgacattagccacgacggcggtgccactttgtccaacccttgaccataacaggacggcagtgaaccaaattccccagactgaaaaagtgacgacagcggtcaaaaaaatcaattcccccaaaatacgccgagcgatcatgacccgagcgtcaattcttattagaacactggtgttttgtaacagtcgtaagagcacagccgtcatcatgcccgtcataggtagaaaaagaaccaattgaccaaaaacgcgctgcaccgatcgattcgcatcaaagaaacccaactggaatcgcccggtcgtcagccctatagaggtaaaacaaagtgacaccagcaatgtcgccaaaagaaaggctactcgctgccaccgaggggcaaattgagctgttagaaagcaatttcttcttggcattgttcacgcctctatcacgggtatgcgaagtgctaatagactaatactaattaaagccactggccacaaaatgacatacgcgattgatggttggccaatcgtggggacaacttgcagataagcaatcggcgccaagctcacttgcgacattagactcacgctcaaaagtaacagttgcagtcccatcaatcccagcaaggccacaaccattttcctcgtgacgaaatagagaaagttagagaaaatggcataacttgcaccgtaaagagccaccaataaaacccaaccgagcatgtatagccaaatatgcgtatagaaaagattgccgccgaagcctaaataacttattgcgacattgttgttaagccactgactcggtaatacattcgggtgaatgacaagcagaccaagaaagtccaaccccaaaacaacaattggcaacatggcaccccaaaatccagccgcaagaaacgttcgtcgccggtaagttaaaaaactttggcgagttcggagcagccttgcatacccattccgaccttggttagcagcaaacataccaccagcaagtactgacaacaacggggctgccatgttccaagcaatcggtaaatttgaggaaatatcgactggtagccagttcatgtatggtgagaaaaagaagtatcccgccacttgcttaccaccattaacttcataaccaagattgcccaagagatgccctaagagaaacagcaacgccaataagaaggcagcaatcgtagatctagtcttccaatactgcttactgaacaccaatgttagcctccttacaagcctacactttttccatgtttctaatcggcagcgataaagcccttgatgtaacgccattgcattggatatggttaaaagtacatttcattcactaaaacgtcaatcatttatcgttttttatttttagagattcttcacaaccttcgattattatttccttttcatcattggatttataaacggatctcactatcattgtcaatgatacataaatatgattttgttattttaaagtgactggcgatacctacccacctcggtaccaacccaagacatgttttgtctgtctgcacagcattattcagaacaaaaaaacatccccatcgccagtcaacttaccttgcactgaacaaaatggagatgttttttgattttgataatattacttagccatataagccccaacaaagttatacatgttggctgggctgaaagtagcacctttcagcttaggattgcgcaaatggccttgaacagtttgataaagcgttgcaacaggtgattccttagaaagcagttcctgtgccttcagaagatcatcatatcgcttggtttcgctgttagcatccgttcccttagaagccttaatcaaatcatcatattgtttattggaccagtgactaaagttgtaagtgttgccagtcgtgtaaaggtccaagaaggaaattggatctgggaagtcaccttgccagccggagagaatgaactgagcactgccatctaatgaccgttggatccgggtcttgaatggaacagaagagatggaaaccttcatgcctggcaattgttccaaagcagattgcagatattcagcagacttcttagcaacgtctgtgtcatcggtcgtcagggtcacatcttcaccagacttaccggcttccttcagaccttcagcccaaagttgcttagctttcttaagatcgtatgtctgaacggtcttagattccttagcagcttccttagagaagtcttcgccagtctttggattactgccagagttttctggtgtaatcgttgagattccgaaagaaccatcgccaataaccttattcgcaaactcatcacgattaatagccatcgcgacagcttgacgcaacttcagattcttgaagtcaggtaccttttcttcgttcatatccaagtatgtggtccgaccttgcttatcgccaacgtaatccttgtccttggcatgctgcttagcaatttcaccggtcagaaccgcatcgtcaagtttcttcgtagcgaataagttagcagctgtgttggaatccttaaccacttgaacgtgaatcttatcgagcttaacttgcttggcgttccagtaagaagtgttcttcacttcatcccatgaattgccagtgccgttccagttagtcaacttgaacgggccattgaagaccaagtacttgctttgcgtaccgaacttcttgccatacttatcaaccgtcttctggttcaatgggaagaagaccggattgaccatcatcgtgctaaagtacggtactggccgatccatcgtgacaaccagcttataatcgccttctgctttaacaccaagggttgaagcagccttcttaccagcagtgatgtcatccgcgttcttaatgccagagaaaagataagcatattctgacttagttttcggatctgctgctcgcttccacgcgaagacgaaatctttggcagtaacaggatcgccgttactccacttcgtcttccgcaagttgaatgtataagtaaggccgttattcgttggcttaacgactttagtggcaacagcaggttccaatttcttgcctttataccgatacaacccatcaccagtatcaacggcggcttgcccactaataacatccgtaatgtgggcattatccattgtggaaataacatctttttccattcgattaaaagtttctgagctactgctgctactcttgctgccacatgcggccaagagtgcagctgaggcaaataccattgcccctgctaccaatcgtttaactttcatttactcaccctcaaaatgatattacgttgagaatacattagagtatgaagaaagtaaagagaaaatttgcagatattacttgttttcgtggcctttttagcagcagaagttactcatcaaagtctcacgtcccactttttaacctggattattcatagaatttcaaaaaagcagcgcaatcccacgattcacacgggactgcgctgctttggtgtttcatcataagggaaggcattccctatttctatacaattcagaaatcttttatgcatttacacaagatattttacgctctccaaaaaatgcacgcttaccttagtgaagaagtatctaagcaccatacagctatttagttgcaactttttttaaaaatgtcaggtcaagtaccttaaaaaacgaattctattgttaggtgggaaaagtatgcaagcagagattattgctgtcgggacagagatcctgatgggacagattactaacacaaatggtgcctatatggctaagcaactgacagcactgggtattgatagctaccatcaacaggtggtgggagacaacgggccgcgacttgaggaggccattaagttggcggaaagtcgcagtaatttagttattttgattggcgggttaggaccgacaccagatgatctgaccaagcaaacattggcagcgcacttgaaccgcaaattggttgaagatcctgacgctatggctaaattacaggcgcgcgtcaagcaacagcagcggccaatgacgcctaataatcaattacaggccatgtatccggaaggcgccgatattttggtcaatcgggttggcttagcggttggcgcgtggatcgtcaatgggcagcacacctatgtcttattgccgggaccaccgaaggaattcgttccgatggttgatcatgaactgctgccgcggctagcaaaatggagcggccacgcggaaattatggtcagccgggtcttacgtttctttggcattggcgaatcgcaactagtgacagatctggacgacttgattgccaaccaaaccgatccgaccattgcaacttatatcaaggatcatgaggtgacggtgcgcgtcactgccagtggcgctaccgaaaaagacgctgatgcaaagttagaaccaatgatcggtgccatcatggatcgtgatggtcaatatttttacggctacggtgacgacaatagtttggcaaaagaggttgtgaagacgcttgcggcaaatgatatgcaaattactgcagctgagagtttgactgctggcgcatttcaagcagcgttaggcgatgtgccgggggtatccacttattttaagggcggttttgtcacttactcacttgcaacaaaggccgcttttttggcaattgatgctcgcgaattagcggcacacggagttgtcagcgcatttacagccaaggcgatggctgaacatgctcggcgtaaggcagcggcggatataagtgtcagctttaccggcgttgccggtccagacacgctggaaggacagcctgctggtacggtttggatcggtttagcgcggcgtggccaactgcctgaagcacatgtttaccattttcctggcggtcgcaatgatgttcggcagcgtgctgtgatgactggtatgatgcttgcattaagggcgctgcaggcctaacagaatcattctttaacacgttaatacgtcaggtttacgcaagaggaggcggcaagatggcaggagacgaacgccagaaagcattggatgttgcactgaaaaagattgaaaaaaattttggtaaaggcgcgattatgcgaatgggtgctaaggcggacacgcgcgtttccgttgtctctagcggctcacttgccgttgatgatgcacttggtgttgggggctttccgcgcggacgaattgtcgaaatttatggaccggaaagttccggcaaaacaaccgtcgcgctgcatgctgttgctgaagtgcagaagcaaggcggtactgccgcctatattgatgccgagaatgcgatggatcccaagtacgcaactgctttgggcgtcaatattgacgaattattgctctcccagccagacacaggcgaacaagggctggagattgctgatgaactagtcgcgtctggtgccattgatattgtggtgattgattcagttgctgctttggtgccgcgggctgagattgagggcgatatgggggatgcccatgttggcttgcaagcccgattaatgtcacaggcgttacgtaagttatccggttccatcaataagacaaaaacgattgctttattcattaatcagattcgtgagaaagtcgggatcatttttgggagtccggaaacgacaccaggtggtcgtgcattgaagttttatgcgactgttcggttagaaatccggcggtcggaacagatcaagacaggcgcagatgtcgtcggcaatcgcactaaaatcaaagtggtcaagaataaggtggcaccgccttttcgaacagaaattgtggatatcatgtatggccaaggcatttcgcaaactggcgaacttgtcgacatggccgttgagagagatattgttgaaaaagcagggtcatggtacgcgtatcaaggtgaacgcatcggccaaggtcgcgaaaacgctaagacatatcttgataaccacgctgatcttcagcagacgattaaacaacaggttcgcgtggcttatggtatggcagccgcacctggtcgggagacggcttcggtcagtgaagatcaacccgaaatacatcaacaggctgaagtatgaatcatgagtcatgagtcaacttgctgttgtcggatgtgatgagtccgatggcgcaagtttttttatctgagcggtcttaaggagatttgatatatgttttatttttctcagttcgtaaaaagcatcacccagacttaagactgctttaatgctggtttttaggcgccgctgtgcgcctcccgcttcggttgacaccttgcaccctagcacgtaaactaatagaggtgtaataatttaaaaaagcatcaaagattttgatcaaaatttgattgaatcgcttagatgatgcggaggtgaaatgatgagttcagtaacactggtctcaataaccctcgcagcagtcatcgctttagcggtcggtttattgatcggatttgcacttcaaaagaagctccaccagaacaatttggatcgagcgacgcagacagcagaaggcattattgaggccgctaaaaaagaagcagcgactttaaaaaaagaaaaactgctggaagcaaaagacgagaatcatcgctatcgaacccaacttgaagatgaattgaaagatcggcggacagaagtccagaagtcggaacatcgactgaatcagcgagaggatactttggatcggcgggacgatacgctagatcgcaaggaacaaagtcttgctgaccgggaagcaaatttgaacaagcggcagcaacagctagatgaacgtgaacaagatatctcttcagaaatcagtaaacagcacacagaacttgaacggatcgccgagttgactcatgaacaggctcggcagcagattcttgaccagacacaatcagaactgacgcatgaacgcgccgtgatgatcaaagaaagcgaagatgaagctaaggaagccgcggataagaaagctaaagtgttgatcgccgatgcgattcagcgcagcgcttctgacatcgttgccgaaacgacagtgaccgtggtgaacttgccaaatgacgacatgaaaggccgaatcatcggccgtgaaggtcgaaatattcggacacttgagactttgacaggtatcgatttgattattgatgataccccacaagccgttgttttgagcggctttgacccaattcgccgggaaatcgcgcgaattgctttggaaaaactcattcaagatggtcggatccatccagcacgaattgaggaaatggttgataaggcgcgcaaagaaatggacgaccggattcgtgaaattggtgaacaagccattttcgacgtcggtatccataatatgcatcccgatctgattaagattttgggccgattgcacttccgtacgagttacggtcagaacgttctggatcattcgattcaggtcgccaaactgactggtgtgatggctgctgaattaggagaagatgtcaccttagcgaaacgcgcggggttattacatgatataggcaaggcgcttgaccatgaagttgacggatctcacgttgaaatcggggttgagctggcaacgaagtacaaggaaccaaagacggtcatcaacgccattgcatcgcatcatggtgacgttgaaccaaccagtgtcatttcggtactggttgccgcagcagatgcgatttcagctgcccgcccaggcgcgcggtcggaatcgcttgagaactatcttcatcgtttggagaaactagaagcaatcgccaacagtcatgctggcgtggatcatagtttcgctattcaagcaggtcgagaagtccgggtcatcgtccaaccggaaaagctctctgatgatcagagcgtcatcttggctcgtgatattcgcaatgaaattgaaaaagaactggagtatccaggccatatcaaagtcaccgtgattcgggagacaaggactgtggaatacgccaagtaaaaaacacagtacccaccagcacaaagttggtgggtactgtattttttatgctgttttagttcggacattattgttagacagttagatgtcctcttagagcttaggctttcttggtaaagggacttcgcggtattgactggcgccaatggtaggcgaaaactgtccattcaagaaatcatttagggccgcgagcgtcgcctgcaaatgctcatcatctagatacagggtgatggtaacagcagtcccgtaatcagtgttcgcaattgacaaatgattggttgtcaaaaaatgctgaattggatcaaagtcagcgtaaggaatggtaaaagttacagctttttgtttgatgcgcgccacaatgccgatggtttcgatcgccgtgttggcattgcctgcatacgcccggatgagtccgccagcaccaagtttaatgccgccaaagtaacgagtcgtgacggctaccacatcacgcaagtcatgctgcaacaaagcctccaatgttggggcaccggcagttccagaaggctcgccattatcgcttgcgcgttgaatttgattggtatcgccaagaacataagcaaaaacattgtgggtagctttggcgttttcctttgatacttgcgcaatgacggccttggcatcgtcttcattcttgatacgcgcaagatgggtgatgaaacgcgattttttaatggtatttgtgtagttgccggtttgttggatggtaagatattgctctgacatgcgtaatctccttatgaggtgatcatgatgaatcttgctggggcacaattgacagaaaatgaactgatgcgcttaaccgtttctaatatagcacaggccacatcactgccagcgttgattcaagaacacgggcgctggtgttgccaacgttgcggtgatcgaaagccagttcaattgcctgatgggcggttttattgttcagcttgcgtgagtttaggccgcttaacaaatcgtgatttgctttaccgctttgaacagccgcaccggcctgttggcgacggcttattaacgtggcacgggacattgacgcctgcccagcaaaaagcgtcaacagctttacaaacgagtgttacagcaggggctgatcatttgatttgggcagtgacaggtgctggcaaaaccgagatgctttttccgaccatttcacagatggtacaacaaggcaagcgcgtggctattgtttcgccgagaattgatgttattcgggagcttgcgccgcgactgcgaactgcctttgcaaccatccccatcgccgttcgatatggcggtcattttgatcaaactgacagtgatttgttgctggccaccgtgcatcaattattacgatttcatcgggcttttgatctgattgtcgttgatgaggtcgatgcgtttccgatggcgggaacacccatgctccatcgggctgttcaaggtgcccggcgtggaccggttgtttatttaacggcaacgccggatcggccattgaaggcggcgatgcgtaaagggttgatggtcagtcgattgtttcgtcgatttcacgggcaccctttgccagttccagcgattcggttgatgaattttaaaaaattaccgtcccagttgccacctgccatcgtgaagtgggtgcgtgatgtcgtggcgacagggcggtcatgtttgctgtttgttcctaagatcagctgggcgcctcaaattgctgcgcttgttcaacgtaacgggctaagggtagctggcgttgctagcacggaccgtctacgggcagagaaaataacggcttttcgtcagcggcaaattcaggttttagtcacgacgacaattttggaacgcggcgtaacggtgcccaagtgtgcggttggggtcgtggctgcagccgatcgggcattcacggcctcggcgctagtacagatcgctggtcgagccgggcgggcagccgatagtgccgacgatccggttgtctttttcacggatcgctatacgttagcattgttagcggccaaacgtcagattgtcatgatgaatggacggtgatggtgatgcgttgttgcgggtgtgatcgccatgttgatcgtagtccgacgttgaaggcgttgttagctggcagcaagttgatagcaccccgattgtgcagtagttgtttagcccgctttaagatgattactggagcgacttgtccaggctgcggccggtcgggtgatgcacgaatatgcgcggattgccgccaatgggagcagcaagggcggttgttacataatcgggctttatttgtttatgacgcagctatgaaacaatggatttaccagtacaagggtcttggcgattatcgcttacacgatgcgtttcaagatctcattgctgcacaattgcaaaatgctaggacactgatcgccattcctagcgaatccaaacattatgatgtgcggggatttgatccaattcagggactttttggcggtttgcagctgcagccatggctacgtaaatcaccaacggccaaaccgcaggcgcagaaaaatcgtcgcgaacgattacaaacgccgcaaagctttaccgtacttgtgccagcagcaaagttgaatcaaaccaaacaaattacattggttgacgatttatataccacaggacggacattgtatcatgctcgcgatgcgcttgtggccgcgggatttcagggcacggtgaccgcatttactttaattcgctgaaatgtggcttttgttgtgtctggcgacaacattcgggtataatgaaattgaagattggaagggttttatcccaaccaatcgacgtgtaagtgtttattacacgtaggaaaggggagaagttttatgctcacatacaatgttcgtggcgaaaacatcgaagtcaccgaggccatcagaagttacgtggagaagcggattagcaaactgaacaagttcttcggaggttcggttactgcaacggcacacgtcaatttgaaggtttattccgataaaactgcaaaagttgaagtgaccatcccgttgtctttcttgaccctgcgtgctgaagaaaccagcccggatctttatgccagcatcgatctcgtgaccgacaagctggaacggcaggtacgcaagttcaagacaaagatcaatcgcaagtcacgtgaaaaaggctttggccaaatcgacattgatgcgactgcaccagctgaaccgaaaccagccgaagatgatgataatctgacggttgttcgtactaagcgagtgtcgttgaagccgatggattcgcaagaagccattctacagatggatatgttggggcacaacttctttatctttgaagatgctgacaccaatggcacaagcattgtttataagcggcgtgacgggcgttatggcttgatcgaaaccgatgaataagcagttcttaaaacaaaaaacaagatcgccgcaaaaggtgatcttgttttttgttgggaaagtttgccatatggacttattgctggtaagtttttattaaagtttaatgacaatatacaaattggggcctggtatatgaacttgcaggcagtgaagattgaggcgctatcgtgctggtattcagttgttattgtgaacggcatcggcgtgcgctcgtcgatgtggatgatgcaagatctttgtactgctcggttttcaatacccaatgaaaatgttaagatactatagatatactgtcagtttaacgaagtttcgacagagaggaatccattcatggccaatattcttagaaaatgggtcgaaagcgataagcgagaaatcgcgcgcctaggcaaaattgctgataaggttcagcaatatgaagatgagtatgcagcattatctgatgaacaattaaaagcaaacacaccaaaattaaaagatcgtctcgcagctggtgctacccttgatgacattctgccagaagcctttgcgactgcgcgggaaggtgccaagcgtgttttaggtctattcccgttccgagtccaaattattggcgggattgtgttgcatgaaggcaacattgcggagatgaagaccggtgaagggaaaactttaaccgcaaccatgcctgtttatttgaacgcactcactggtaaaggtgttcatgttgtcacggtcaatgagtacctgtcaacccgtgatgccacggaaatgggcgagctatacaactggcttggcttgagcgtagggttaaacctcaattccaagaacagtgatgaaaaacgagaagcttataattgcgacattacctattccacgaacagtgaactcgggtttgactatctgcgtgacaacatggttgtttacaaagagcagatggttcagcggccactgaattttgcaatcgtcgatgaagttgactctattttgattgatgaggcgcgaaccccattgatcatttctggcggcgcagaaaaaacaaccggtctctacattcgtgccgatcggtttgtcaagacgctaaaagcggagaccgattacaagatcgactggccaacgaagacaatctcgttaactgaaagcggcatccggaaggctgaaaagaatttcggactggataatctgtatgacaccgaaaatacggccttaacgcatcatattgatcaggccttgcgggctaattacatcatgctcaaggatatcgattacatggtttccgatggtgaagtcctcattgttgatcagtttactggccgagcaatggaaggtcgccgatattctgacggcttgcatcaggcgattgaagccaaagaaggcgtccaaattcaggacgaaaataagacgatggctaacatcacttatcaaaacttcttccggatgtacacaaagttggccgggatgactgggaccgcaaagaccgagcaagaagaattccgagaaatttataacatggaagtcatctctgttccgaccaacaagccagttatccgggttgactcccctgacgtgctgtacccgacgttagatgctaagttcaacgcggttgttgaagacatcaaagcgcgtcatgaaaaaggccagccgatgctgattgggacggttgcgattgaatcgagtgaacggcttagtaagcaacttgatgaagctaagattccacataccgttttgaacgcgaagaatcactttaaagaagcagaaatcattatgaatgctggccaacgcggcgctgtgacgattgcgacgaacatggctgggcgtggtacggatatcaaacttggacctggtgtcaccgaacttggcggtttggcagttatcgggacggaacgccatgaaagtcgtcgaattgataatcagttgcgaggccgttcagggcgtcaaggcgatccaggttctacacagttttacctgagccttgaagatgatctgatgaaacgctttggttctgatcgaattaaagctatgttggatcgctttaaggtggcggatgatgatcaggtgattcaaagtcggatgatttcacggcaggtggagtcagcccagaaacgggtcgaagggaataactacgacacgcggaagaatacgctgcaatatgatgatgtgatgcgtgaacaacgcgaggtcatttacaagcagcggcagcaagtcatcaatgaacaggaaacgttgaagcctgtcttgatggctatgatcaatcgaacgattacacggattgttcagactcatacccaaggagatcagaaggactggaaccttgatgccttgtacgcttgggtcactgctaacatgattgatcctgagaaattcaaacgcagccagttagatggcaagtcgcaagacgagttgatcgggttactggccgagatggcggagaccaacttccagcaaaagaataagcagctgggcgatgacgcgcagatgcttgaattcgaaaaagttgttgttttgcgcgtggttgattctgcttggaccgatcatattgatgcgatggatcagttgcggcagtcgatcggattgcgcggttatggtcaaatgaatccgctagtcgaatatcaagaagaaggctaccggatgtttgaagaaatgattgcatcaattgatgataatgtgactcggctgttcatgaaagctgaaatccgacaaaatattcgccgttaataacggcttagcgccccggtaccgcggctacagcttgcggtactggggtgttttgaagcagtcgccgacgcacatggtcacgctacaataacgcaactatgtttaaaaaaagggagattacacgatggaactgagtgttatgcgcaacaccttggccgccatgcggaccaaaattaatcaatttagggggtcactttgacctcgatgcgctgaacgaacgcattactgaaaatgaaggccgaatggctgaacccggcttttgggatgactcggaggctgctcaaaaggttattgacaacaacaatgcgctcaaagaaaagcatgatcgattttatgcactagaaaatgagttggaagatcttgaggctggttttgagttattacaagacgagcctgataaggacttgcagcaagaagaagaagcaaagatcaaagatttacaggaaaagctggataagtatgagatgcagcttttgctgaacggcccctacgatcacaacaatgccattttggaaattcaccctggtgcaggcggcacggaatctcaggattggggatcaatgctgatgcggatgtatcagcgttgggccgatcagaacggattcaaagtagaagtggcggattatcagcctggggatgaagctggcatcaagagcgtaacgctgctgatcaatggcgagaatgcttatggcttgctgaaaagtgaaaaaggcgtccatcgacttgtgcggatttcgccatttgattccgctggacggcgacacactagctttgcctcggtggacgtgatgccggaactcgacaactcaatcgaagttgatctgcggccggaagacatcaaaatggaggttttccgctcaagcggcgctggcggtcagcatatcaacaaaacctccagtgcggttcgcttgattcatctaccaaccggaatcgtcacctcaagtcaggcgcaacggtcacagtttcagaacaaagcgactgcgatggcgatgttaaaggctaaattgtatcagcgcgaagaagaagctaagcgtgctaaggccaaggccattcaaggcgaacaaaaagatgtcgcatttggttcacaaattcgctcttacgtctttcacccatacacgatggtgaaagatcatcggacgaattatgaaaccggcaatggcaatgcggttatggacggggatttgaatccattcatcaatgcgtatctacaatgggaacttgcgcaaaagaatcctgattaaactgtaatctgcctgaaaccttgctgacttaatcgcctgttatactgatgctagcttagaaaaaggagcaatttgcatgattcaaatggagaacgtgacgaagcagtatgctaacggcgtgactgccattaaaaatctcaatcttgagattcatgatggcgagttcgtctatgtgatcggtcccagcggtgccgggaaatcgactttcgtcaaaatgctttaccatgaactaatgccaaccagcggtacgattaaaattgatgattttgattttgcaacaatgaaaccgagccgggtaccatttttgcgacgtcatattggtatcgtctttcaagattttaaacttttaccgcggttaacagtgtacgaaaacattgcttacgcgatgcaagtgatcgaagcacctgacgaaaaaatcaaggaccgagtcctcgaagtactgggcctggtaggtctcgaacaaaaactgcgccgttttcctgatgaattatccggtggggaacaacaacgtgtgtcagttgctcgtgccatcgtcaacaagcctaaggtattgatcgccgacgaaccgacaggcaatttggatccacaaacatcagatgaaattgttgatattcttgagcggatcaatgccagcgggacaactgttattatggcgacgcataacaaggacatcgtaaatgagcgtcagcatcgcttacttgaaattgctggcggccgtttggttcgtgacgaagaaggaggcacttacggtaatgaagactaagatctttttccggcatgtaaaggattcgctgcgcagtctgaagcgaaatggctggatgtcagttgccgctgtcagtgccgttacagttaccttactattggtcggtattttcatggcacttattttcaacttgcatcatgtatcagagcaagttgaaaatgacgttcaagtgcgtgtttacatcgagaagaaaactacgatgaaacaacgtgatgcattaaagactcagctagaaaagcttgataatgtcaagaaagtgacttaccggtcacgtcagcaggaattgaacaccattgtcggcgggtatggttcgcaatggaaaatgttctctggcgatcagaacccattgagtgatgtcttcatggttaagacaagcaaccctaaggcgacgatcaaggtctccaaacaagctcaaaaactaaaccatgtggtggacgcaagttatggcggccggactgcgaaaaaactgttcaactcagttgattcagcacaaaagtggggacttggttttactgtccttctgctgttcgtggcggttttcctgataagcaataccattcggattacgattctgtcgcgttctgacgaaatcagaattatgcgcctggttggggcaacaaattcatacattcgttggccatttattcttgaaggcgcttggactggattgttcggggctgtgctcccaattgtgattgttgacatcggttatgccgttgtttaccgcagcttcagcttatcaagcggctctaacggttattcgctatatggcacgatgccatttctgctttggcttgatttgatgctggcgggcattggtatcatcatcggtgcattaggcgcagtcatttcaatgcggcgtttcctcaaaatttaatcgtgcaatttgtgaactcatcctcgctaatgacggggatgagttttttgctatcatactcggctatgcgtgcctactcacattttgatttttatgacgttgtgggagcctccggcgatttctgctatactggtcacagtgaatattggagggttaccgatggcagttgtagttgccttacttatcaatccggttggtttggtgttttggctagcgctaggtttaacgatttggtttgctgtcaatcgcactgatcgcgagcgccgccggtatctgcgcgcaattcatcccaaacatccagaaattggtcggttcttctggatcggacttgtcgtaggtgcgctagtctcgctggtaatggttattggacgactgcagatcagtttagctgctttgcttgcattaagcggcttgacgttagtagcattgctattttctaaatggcgatttagcccttggtggctaggtcttgccagtctggcggcagttggtcagtctggtttgctagctgaacagcatgcagctaatttagctattttggtcggcctattatggctaacacaagctggacttgcgagattcaaccgcggcgatgagatcgagtcgcctgtgattcaacaagaccgccgccagcggcaaagtgcggcgtttgagttgcggcaactgttctgggtgccgttaatcttacctgttgctgttgaaaacgtcagcaacctcccactgctggcggttacagtgcagtctttgacttttgtgggcttgccgttgcttttaggtgcgaccttcatgactccgcgagatcgcgctcagacggcttggcggcgaagttggccgtggtatggcggcgcaggtggcgtgcttatcgtttatggcattgttgcccgcaccatgaccttgcctttgctggttagtcttgtctttccagcagtggtgagtttagtattggttggcggcttcatttggcagggacggcaggtgcatctgacggtgactttagccgatcaaggtgtggtgttgattggtgtcgtgccgcatacaccggctgcagagatgggcttacaacccggtgatcgtgtattggcctgcaatcaccattccgtgaacaattctcgtgagctttacgatgccattcaaaaagaaccaacctattgccgcttgcggcttcgacaggcagatggtgagctgcgattagctgagacggccatttttgccggtgccccacacgaacttggtatgattttatttccggaggagacagcatgaagaagatcttgattgttgatgacgaacctgcgattttgacgttgctgcaatataatttggaagctgaacactatcaggtcgaaacagcgacagatggtcaggaggctttggataaagtacgcaacgagccatttgactttatcatcctcgatttaatgctgccgagtctgagcggcttggatgttacccgcaaaattcgtgaagataaaattcagacgccgattatgatcttgactgccaaagacaatgaaaccgataaaattgttggcctagaactcggagcagatgactatgtgactaagccgttttcgccgcgggagatcattgctcggatcaaggcgattgaacgacggagtcagagtcagccgcaaaccagtcaaaaaccgggcaacagtgatcagatcacagttggccagatcgcgattgatccagaaaattataaggccagcaagggtggcaaacgtctgcagttgacgccaaaagaatttgagctactggtttactttgctcaacgtgttggcaagaccttgtctcgagatgctttattgaacggggtttggggattcgattatcccgcagagacgcgaatggtggatattcaggtcagccatttacgcgataaaattgaaacggatccgaaacatccggactatttaaagacagttcgcggtttcggataccaaatggaggcaccccatgaataaacgaatcattcggcgtgcactcatcattagtctgctatcattggcaggcttttttgtgctcgtgacaacggtgaatcaacaaattgtccatcaacaagcgcgtgatcttcggcgggtcggccggacgtatgcggcctcgagtcatgatggggtcaatcggcaagcattggcagagtcagaggcagccttcatcacggtcattcccaataatccgcggaccacgcgtcaaaaagtgatggctgatgccttgcgtggtaatcgggatgcagcgtttgtaacaaccgtcaacgtgaatggtcgaacagagcaagcgtatttattccaaaataaagggcagtgggtggcagtcagccgctttaagtcaagtgtctggacaactgcaccagagcaattctggctcctaacgcttgcctttgcggcattgctcgctgccattctcatttggctttttcgatctgaacatcgttatcaagaagcgattgaagtcatgagccataatctagatcgcatccgtcgaaagaaagacccagatccggtgattttaccgcctgattcaccttttgtaccagttgctcgccgcatcaatgcattggccgctgaacaagcccatctccgtgaaaaagtggcggtgcgtcaatcaagttttgatcggttgattgataacttgccattgggagtcatgctgattgacaccgataaagatgtcatcttgcataatcacgccatgtcgcagctgctaggtcatcaaatcccgcagccccgacacagctaccttgatgatgttaaaacttatgccttggcgcgcatgatcgaacacacttttcgccatgaaaaaacgcatcatcaggaactgacaattttgaccacgcaaaaatccgttgatgcttcggttattcctttgaatcaaggcatcagtcggttgcaggtgctggtgattctatatgatgtcacttacttgcgacaggttgaaaaaatgcaactggactttgtcgggaatgtcagccatgaattgaagaccccagtcacagctatttctggatttgcagagactttgcttggcggtgcgaagaatgatccggcgaccttggacaggttcttagggattatttatgacgagagcaagcgattaacacaattaattaatgacattttgaccttgagtcgaccggattccaaccaaaatgtggctgcatcggttgctttgaaaaaattggtcgatgatgcattgcataatttggccaaagtgattcaagacaagcaaattcgcgttgaagtggcaattaccccggatctattggtcgtgactgacgagcgcaaattgacccaaatcgtgcgcaacttattgaacaacgcagtcttctacaatcgcttggctggtcatgtcacgatcagcgcccaggttgtcgatcatcagctgtcactggcagttgccgacactgggatcgggatttctgagacggaacaggcccggatcttcgaacgcttttaccgagtagataaggctcgcagtcgtcacaatggcggtaccggtctcggtttagcgattgtggccgaactggttaagagtatggatggtcatgttgcggttcacagccaagtaggggttgggtcaacgtttacggtcactttgcctgtgggtgagggcccgcacagaggatgaaaaactgcagccatcatgcctttacacaatctttacattcaatgacatgaacatttacatgtaactgataaaataattggagcttgaaatggaggatttcgtgtgaaaaaaattgtgaccctgttgagcctgctgtttttgccactgttaatcagtgcttgcaacagcagcagtcaacagtcgggagaatcgatcaccgcagttggatcaagtgccttacagcccttggttgaagcggcgggtgaacaatatcagacggaacatttgggggtctttatcaacgtccaaggcggcgggagtggcacaggtttaagccagatccaacaaggtgctgtggacattggtaattcggatctttttgctgaagaaaaagctggtatcaaggccaaagcattggttgatcataaggtagcagttgtcgggatcgccccgattgtgaatccgaaggttggcgttaaaaacgtctcgatggcacagctgcaaaaaatctttcttggtgaaattaccaactggcagcagttgggcggcaaaaatgtgccgattgttctagtcaatcgagcgcaaggctcaggcacacgcgcgacttttgaaaaatgggtgatgcaaggcaaacagccaatggccgctcaggagcaggattctaccgggatggttcgacaaattgtcggcagtacgccaggtgccatttcttatgtggcgttttcgtacattgataaaacagttcaggggctctcagttgatggcgtcgcacccacggatgcaaatgtcacgaccaatcaatggcgcatttggtcgtacgaacatatgtatacgaaagggcagccaaaaggactcactaagaaatttttggcttatgtgatgtcaccagctattcagaagaagcttgttttgaaaatgggttacgtcccgatgacacaaatgaaagtggttcgggacgcgaatggcaaagtgagcaagcagtaacctgtgatgttatcaagacacggtcagatccgttggctgtgtcaggtgtcggacagaagcgtgatctaatccggatagaaaccgatgttgtggtcttcgccgggaaggttttagttagaaagcgcgtttaggaggtcaagatggatccaattcgggaagcaatgctcaaaaaatcgcgttcagctaagttagagcagcgtggtaaactgatcagtttgctttgtatcagtttaattgtgattgtggtggtggcaattttcttctttgtggcatcgaaaggactagctaccttctttcaaaacaagattaatctttggtcgtttctaagcaaaagtgtttggaatccgtcaatcaaagatgcgcacggcaatcccgaagttggcgccttgccaatgatcgtcggttcgtttggtgtgacattcctgtcagcaattattgcgacgccgtttgcggttggcgcaggcatttttatgactgagatttcccgtaaatggggacagaagattttgcaaccggtgattgaattgctggttgggattccatcggttgtttatgggttcatcggtctctccgtcatcgtgccttttattcgccacatttttggtggtactgggttcgggattttagctggtacttttgttttgttcgtcatgattttacccactgtgacatccatgaccgtggacgcgttaaaagctgttccacgacattatcgtgaagcgtcattagcattaggtgcaacacgctggcaaaccacgtatcgcgtggttctacgtgctgcgattccgggaattctgactgggattgtgtttgggatggcacgtgcctttggtgaagcactggcggttcagatggtgattgggaacgcagcgcttttaccgaaaaatttggtttctccagcttcgacactgacctctgtcttgacgagtggtattggcaacacagttatggggtcgctagataacaatgctttgtggtctctggcattgttgctgctcctcatgtcgctagcctttaatctgctgattcgctggatcgggaagaaaggggagttgaacaaatgaatccaaaagttgctgataaaatcgcaacgacggttttgtatatcgtctcaggtatcatcattatcatcttggctagccttcttggatacattctatttcaaggcttacctcacatctcctggcattttctgacaagtccggctcaaagctttgaggctggcggcgggatcggtatccagttgtttaactccttttatctcctgctgctcgcaatgttgatttccacgccaatttcattgggtgcagggatttacttgagcgaatatgctaagaaaaactggctgaccgatgtcattcggacgtccatcgaaatcttaagctcgctaccttccgtggtggttggtttattcggcttcttgattttcgtgttgcagttcaagtttggcttttcaattttatccggtgccttggcgctgacggttttcaacctgccgttgttaacgcgtaacgtggaagactcgttgcgtggagttgagtatgagcagcgcgaagccggtctggcgcttggcttgtcacgttgggaaactgtcctgcatgttgtcattcctgaagcattgccaggtatcattactgggatgattctcggcgcagggcgtgtcttcggtgaagctgcggccctgatttatacagctggacaaagtgcgccagcgttggattttaccgactggaatcctgctaacatcgcaagtccgcttaatcctttccgtccggccgaaacattagccgtgcatatttggaagatcaactcggaaggcattcagccagatgccgttgccgtctcggccggtgcaagtgcggtcttggttctagctgttctgctgtttaatctcggtgcgcgctactttggcaatcgcctgttcaaaaaaatgaccgcatcctaatgtgaataagcacatgccattgcagtgaagttggtgatggtggtcataaagttggcgacaaaacgcttggaggctcacgatgcaagaacttgaacaatattcattagatgacacttatattcgtccattcgatcgcgacaagcaggaaattgcgatcgaaacagagaatctacgcgttttttatggtgagaatgaagccattcataatgtctctttaccgtttgagcggtataagattacggcattaatcggcgccagcggttcagggaagtcgacttacttgcgctcgttgaatcgcatgaatgataatattgaaggtgcacgtgtcaccggcaagatcatgtatcgcaaccttgatatcaatagtgacgcggtggatgtctacgaaatgcgtaagcatattggtatggtctttcagcggcctaatccatttgccaaatctatttacgacaacattgcctttgccttacgtcgatttggattaaaagacaagcaaaaactcgacgagatagttgaaaccagtttgaagcaggcggcgctttgggaccaagtcaaagatgacttgaatcaaagtggcatgtcactttcaggggggcaggcgcagcgtttgtgtattgcccgcgcgattgcgatgaagcctgatattttgctgttagacgaaccagccagtgcgctggatccgatctcaacttcggcggttgaggataccttgatgtcattgaaggataagtatacgattatcatcgtcacacacaacatgcagcaggccgcccgaatcagtgattacacggcgttcttctacagcggaacggcgatcgaatatgacgaaacccgcaaaatctttacccggcctaagatcaaagcgacgaacgactatgtctccggacatttcggctaggaggaacacatggctgaagcaaaaaaaatcattaccagttcaaatgttcatcttttttatggcaaatttgaggctttaaaaggcatcgacctagacttcaatcagaatgaaattacggcgttaattgggccatctggctgtggtaagtcaacgtatttgcgaaccctgaatcggatgaatgatctcattccgggtgtcaccatcactggcaatgtcagtttgcggggcaataacatttattcgcccaatgaagatgtcgttcaattgcgaaaacaagtcggcatggtttttcaacaacctaatccatttcctttttcgatttatgaaaatgtcatctatggtttgcggctggcaggcattaaggataaagccgttttagatgaagccgttgaaaccagtttgaagcaggcagcaatttgggacgaggttaaggatcacttgcatgaaagtgccttatcattgtcaggtggtcagcagcagcgggtctgcatcgctcgggtgttggccgttaaaccggatgtgattttgttagacgaaccaacaagcgcgcttgatccgatttcgagcacgcagatcgaaaatatgctgctggaattgcgtgatcagtatacgattattctggtaactcacagtatgcaccaggcctcgcggatttcagataaaacggctttcttcttgacgggtaatctgattgaatttgctgacacaaaacaaatgtttttaaatccaaaggaaaaggaaaccgaagattacattactggacgcttcggataggaggggtagtatgcgacgactttttgttgatgaattgaacgatcttcatgtgcgcttttcggaaatggggatgatggtcaacgaggccatctataagtccgtgaaagcattcatcaatcacgacaaggccctggcccgcgaagtgattcatgaagataagcatatcaatgaacgtgaagtagatttggaaaaacgcagcttcgaattgattgcactgcagcagccggttacgactgatttgcgggtgattgtgacggtcatgaaggccagctctgatttggaacggatgggtgatcatgcggtatcaattgctaaatctaccattcgggtcaagggtgagacccgggttcctcaaatcgaggaagatatcgctggcatggctgaagcggttaaagagatggtagaacaggttctggatgcgtatgtgaaggaagattctgctcgcgcccgcaagattgcgcttgaagaccatgggatcaatgacttttcatcacgaatctacaaggaatgtattcggcagatgcaggataatccagaaacggtgatcggatccatggattacatgctggtttcttcctatcttgaacgaattggcgattatgtcaccaatatctgtgaatggattgtttatctcaaaacagggaagattactgaattgaactcaaacgctattgaggataagttctgagaaaatgacgctcttgctggcttgcaagggtgactgaaaaagattgacattgattgttattttgaaagagggatgatttttacttttgtgaaaatcatccctcttttgatctctcatggatgacttactaatatctaaagatcccggtgccaaggcggagcaatcataggctagatggggttcagccgtgcaaacatcatcagctcagcgttgccagccccatctggctggtgactgtggatagattcctttttgatgaacgcgctgatgatgtgtctcatgtcaataaccagatgaatagatgcattactttcaagcgtccgtcttccgacccgttcaaaaatcaacctttggacctatgcgccccggcgcgaatccgtgcatactaatcatgtaatcaaatcctggagggataacccatgaatgaacgcgaaagaattttagacctagttaaaaaaggcgttatttcaagcgaagaggcgctggtacttttggaaaacctggcgaaacgtcaaggttcccagcaggccgctagcccggccgataacacagctcccgaagaaacttcggaaacgccgaatacggatgatgagcatgcaaccagtgacacggatcgcaatgaagcgctgacagaactcaacactgagattgctgaagcagcaggtgccttagatgctgctaccgcacaggttacaactattggtaaacaaatcgatgcgaacaacgaacagatcatcgtgctggacacgatggaagatctcgaagccctttccccggaaaaataccaaaagcgcggggatttgaaacaggagaatcagaaactgactgatcagttggccgaactaaaaggccaaattgagtctctgaaagcgaaccttgccggcttacgtcaccaaaagcatgatttagagcgtaagaagcttggcgacaagattttaaatgacgattggcaaaaagatgctcgcgatgctttttctgagtttggcaaaaacttaggtgatgcaaccacgcaactgggtgggttcgtgaaggatactgtcaacaatgttttggataacgttgactggaagaatgtcaccattacagtacccggtttagcaactgaaaaatttgaccatgttttcgattttccagatagtcaggcaacgattcttgatgtgaaagttgctaatggtgacgtgaagttcaagacttgggatcagccaggcattcaagttgctgctgcgatcaagttgtacggcaaaatggatgccgcatcgccgctggatgcgttcaaagaccggagccgcattgatgtcacggacgatcattttagcttccaagtaccaaacaagcgggttcaagctgatttggtcatctcattgccaaagcgcagttatgatcatgttgctgtccggttattaaatggcagtgcagacttaactggcattaccggtaaagatttctatgttaagagtacaaatggtcagatgaacttcactcatgttgatggtgtcatgatcgagagtgaaggtgtcaacggctcaatcaaggttcaaggtggtcatacccatgacttgttgctcacaacagtgaatggcgatgtcagtgttgatgccgatccggcaacggccgccttaaagacagttaacgggactgtgcgagctacctatcacacggacttcacgacgcttgaaggcacttcgatgaacggcaatgttaaagtcgccgtgccgtcctccattgcgcttaacggcgaggttcggacgcattttggcagcatcaagagccgcttgagtgaggttgccgaaccagctaaggggattaagcgtctggaactgacgcgtcccgggactggcagtagtgaaatgaaactcaatacaaccagtggtaacattcaattaaaagattcaaatgactgaggggattgcttatgccttttctattaattccattaatgttctttatcattggcttgatcatcgtggcggtttttgccatcgggatattcctgttgaaacttctcattgtaccggccttactcatcatcttagctgtgtggctcttctcgcggcacgatcggtctgaccgttatgatcgtcggcgtccgcgtcacccttatcgtgatcgcgactcatctcggccccgaaaaaatgcaacgcatgtgaccgagtcgcatgacgatgactggagcgatttctaatgaacttcgtcaaacgcaccatcataacgacggcagttttcgtgatttacgcgcaactgtttccggctcagctttatgtggcaggatttggtgttgcggtagtcggtgcattggtgctcggcgtcttgaatggtctgttgcgaccaattctagtgattctgtcgataccaatcacgattctgacactaggtttgttcctgatcgtgctgaatggtttgatgctaagcatgatgacttggttcgtaccaggcattgtgttcagcggtttcggcgctacgatgttgctggcggtcattatttccgtgttgaatatgatgtttgtcggcaaaaattaaagtgacgattgaaaatggcttgcgatctgcaggccatttttgcgtgacttgaatgaactaaaggcttatcgttaccttccaacgaagcgcacaatgtgaatgaccttttgcgaatgtttcaacctgctgaccataaggggaatcgacttatggtaaaatagagcaaatatggcgaaagaaaggtggacttcatggcagacagcgtgacagtgcggcagttggttaaggcaaccaagctcgaggtatacagcggcgaggagtatcttgatcagcggcaagtcgttttgagtgatatttcgcgtcccggcttggaactgactggctattttaattactatccacatgaacggattcaattgttcggtcgaacggaaatttcatttgcgcgaaacatgtcatccgaagaacgtttattgattttaaagcgcatggcaactgaagataccccagcatttttggtatcgagggggttggaggcgccggcagaaatgatcaccgcagcgacagcggctcatattcctgttttgggatcgcgtttgccgacgacgcgtttgtcgagtctgattaccgagtatttggatagtcagctggcggagaggcgcagtatgcatggggtgctagtcgatatttatgggctcggcgtgctgattaccggcgattctggtgtcggcaaatccgaaacagcgttggaattggttcagcgtgggcatcgcttgattgccgatgatcgggttgatgtttatcaacaggatgaacaaaccattgtcggggctgcaccgccgattctttcgcatctgctggaaattcgtggcttgggcattatcgatgtcatgaatcttttcggtgctggcgctgttcgtgaagatactactatttcattaatcgtccatctcgagaattggacaccagacaaaacctttgatcggcttggttctggggaacagacacaattaatttttgacgtgccagtgccaaaaatcacagtgccagtcaaggtcgggcgtaacttggccatcatcattgaagtcgcggccatgaacttccgcgccaagtcaatgggctatgacgccaccaagacatttgaaaaaaatcttaatcatctgatcgagcataatgaagaaaccgaccagaacagttcgggggacaaataacttgttattagcacttaatccgatcgcttttcaattaggcggtctggaagttcattggtacggtatcattattgccagtgccgttctaattgcggtttatctagcgatgcgcgaagcacccaaacgcgggattaaggaagaccacattttgaatcttatcttgtgggcgttgccgtttgccttgatcggcgcacggctttactatgtggcgtttgaatggccttactatgccgctcatcccggcgaaatcattgctatttggcatggcgggattgcgatttacggtgcattaattgccagtgtcatcgtttttgccatttattgtcgggtccaatggttgccagtttggcttgtcctcgatattgctgcaccaactgtgatgttggcgcaggcaattggtcgctggggcaacttcatgaatcaagaagcccatggtgctgtgaccacgttagcctatttacgcggcttgcatttgccagaatttatcattcagcagatgaacatcggtggggcatatcgtcaaccgacttttctgtatgaaagcatgtggaatctagtcggctttgctttgctcatgacggtgcgtcaccatgagcactggtttaagcaaggcgaagtggtgttgagttatgtgatgtggtacagctttggccgtttctttgttgaaggtatgcggaccgactcattgtatgtcatgcccgggctgcgtgtttcacaattgttgtcgatcatcttatttgttgcagcggctggcttagtttggtatcggcggcggcaaggaaatgtggcatggtatttagacggcaatccgcttaaagcggtggaataggagtgattttgtgccaacgaaaatagcagtgttaggtgctggttcttggggcaccgtgctagccaatttattaactgaaaatggtcatgaagttgatttgtggagtcacaatccggatcaggtagccttgatgaagcggacgcatcaaaatgaacactatcttggtgctgagtttacattacagccggctttgcatgtgactgctgaccttggccaagccttggatcaagcggcggtcattttgtttgttgttccaaccaatgcgattcgcagcgtggccgagcaagttaaaccaattctgcaagctcataaagggcgcggtgaacaaccgattattgttcatgctgctaaaggacttgaacgtggcagtgagttgcgcatctcgcaagtgctcgcagaagtcttgccgaaggaattgattcaaggtattgttgtgatttccggcccgagtcacgccgaagatgtcgccactcacgatatcacaacgttaaccgccgcttccgatgatttgaagttggcagaaaaagtgcagaagctgttcatgaatgattattttcggttgtataccaacacagacgtcattggcgttgaaattggtgccgctctgaaaaacgtgattgccattggcgctggtgccttgcacggtctcggctatggcgacaacaccaaagcggccttgatgactcgcggtttagctgaaatcagtcgggtcggcgtgaagctaggtgccgaaccgttgactttcatcggcttatctggtgtcggtgatctgattgtgacctgtacctcggtccacagtcgtaactggcgagccggcaacgcacttggacaaggtgaaaagttgccggatgtgttgaaaaacatggggatggtggttgaaggtgtctcaacgaccaaagttgcccatcaaatggcccgtgaacttgacgttgacatgccaatcacagacgcgatttatcaagtgctctacgaaaacgcgccgattcgtactgtcattactgacttgatgaagcgttctggtaagccggaattcgattttgacaatgcgagtttacaaaaaccataaaaccatgtatattaaacagtatagcttactaattgtaagcaatatggcaaaaggagagactgcccatggcaaaaaaatatgatgtaatcgtgatcggtgccggcccaggtggtatgacggctgcactttatgcatcgcgtgccaatttatctgtgctgatgctggatcgcggcgtctatggcgggcagatgaacaacaccgctgaagttgaaaactatccgggtttcaagtcaatcctcgggccagatcttggtcagaaaatgtatgatggtgccacccaatttggtgctgagtatgcctatggcaatgtcgttagcgttcaaaaccgcggtgccgtcaagctagtgaaaactgacgaggatgagtacgaggctaaagcgattgtcattgcgacaggcgcagagcataagaagttgggcgtaccgggcgaagaagcctacagtggccgtggcgtttcatactgtgctgtctgcgatggcgccttctttaaggatcgcgagttggccgttattggtggtggcgattccgcgattgaagaaggcctttacctgacacaaatggccaagaaggtcacagttattcatcgccgtgatcaattgcgtgctcagcagattatccagaagcgagcatttgccaatgataagatgcatttcgtctggaatgctcaggttcaggaaatccaaggtgacgatatgaaagtcaccggcgtgaagtaccgtgataaggaaactggcgaggaacatgttttgccagtcgccggggttttcatttatgttggcattatgccgatgactgaagcctttcaagatttaggtgttctggatgaacatggttggattccaaccgacgagcatatgcggacaaaggttccaggcgttttcgcgatcggcgatgttcgcgccaaggacctgcggcagattaccacagctgttggtgaaggtggtacagctggacaaggcgtcttcaactatatccagagtttgaatgatacgaatattgagattaaagcttgatttgaaaacaggttgagatattactcatacccaacaagtaaaggccgacgatttccctctaccctggaaaattgttggcttttttcgtggataattttttgttggatttaaagatactagtgccaaggcgtagcaatcgtaggccagatggggctcagccgtgcaaacaacacagcgacggtctctggagctgatgttgttaggcgacttcgagaccggtttttgggctcgaagcgccgtctccgctctagctccgcgtcgccagccccgtctggccggagattgcggagtttggcacggcaagaaagtattagcctagcactgtcctacgattattcggaatttaatgattcacaagtccgacgaggaaattatggctcggcctcttttttgtggatgcgagcagaaacacttagaaacaagcagtcttggaaacttgttttagctagcacgcatcatcggtaataaaagaattttcttatttgagcgcgttttcaacccagcactcgtccacttatagtatgattgggacgggaagggtattgcccgaaattattaattatagacagatgggagctgatcacgtgagttatcgtgatacgtatcaacaatgggtcgacgaaccgacccttgatccggagctgaaagctgatcttaagaatatggctgatgatgagacgactaaggaagaggtatttgctgctcctatggcgtttggcacggcaggcatgcgtggtgttcttggtgccgggattggtcggatgaatatttacacggttcggcaagccactgaaggtttggcccggtttatggacacactgtcggatgaaactaaggcccggggggttgcgattagttacgactcccgttacatgagtcaagagtttgcttatgaaagtgccggggtcttgggtgctcatggtattaagagttatgtttttgatcagttgcggccaacaccggaattaagttttgcggtgcgtcatttaaagacctatgcaggcattatgatcactgctagtcataaccctaagcagtacaacgggtataagatttacggtccagatggcgggcagatgccaccggaagaatccgacaaaatcaccaaatatgctcgttcagcagcggatctttttgctatcaagtctctgaacgtccatgtgctacgcgccaaaaagttgatgcaaccgattggtgaagatgttgatgaagcttactatgctgaagtggccacggtcaccatcaaccatgatttgattaacaaagtcggcaagaacatgtcgttggtttatagcccactgcacgggactggacggattccagcgcaaatggttttgcgtaatgctggtttcgaaaacttccggttggtgcctgagcaaagtattgctgatccagaatttgcaactaccccattcccgaacccagagttcgctcaagtctttgatttgccaattgcattaggtaaaaaaattggcgctgatgtcttaatcgcgactgatcccgatgctgatcggctgggcacagcagttaaagtcggcgaccattatcagttgttgactggtaaccaaatcgcttcggtcttattgcattatattctggaagcgcgcaagcaagctggcacactgccgaagaatggcgcggttgtgaagtcaatcgtgtcgacggaattggcaaccgccattgcgaaggattatggcgtggacatgatcaatgtgctgactggtttcaagtttatcggtgatcagatcaagcattttcaagctactggcgagcacgaatttctgtttggctttgaggaaagttacggctatctgatcaagccattcgtgcgcgacaaggatgcgattcagtcaacagtgctgctggctgaagttgccgcctactatcagtcacaaggcaaaacgctttgggacggcgttcaggaactgtacaagaagtatggttactatgctgaaaagactgttggtgttgactttgaaggggttgacggtcagaagcaaatggctaacttgatgaccaagttccgtgaagaacagcctgctgattttgcgggtgtcaagattacgaaggttgaagacttcctgagtcaggaagctaaatccgctgatggcactgtcgaaaaactgaccatgccatcaagcaacgttctgaagtacattttggcagacggtacttggattgctatccggccatccggcaccgaaccgaaagttaagttctatgtcggtaccaaagcagacacagaagctaaagcccaagaaaaattggatgccttcgaaaaggcgctcaatgattttcgtgaagaagcttagtttgttttaaacgaatcaatgtgtgaatcctgacgattaagcaggtgaagcaagatagcggcgaacgtattgtcccaaatttgggacaaggcgttcgccgttttctgtagggactatccggactttttcggtttctaaaagcgattgttcaaggtcctttaaaaaacgttgtcatccccacagccatgtttctccggtatactttaatcaaggtaatgatacgggggtggcatgatgaactatttaatcgttgaagatgaaccggcattaggcgagacactgcgcgcctatttggccaaagacggtcaggccgtgctagcgacctcgttagcgcaagccaatgaacgagtcgcgcagatttcgcccgatgtcatcattttagatctgagcatgcccgatggtgacggcttgacttggttagcgcaatggcggaagcatttgactgctaaggtgattgttttgacggctaatgacgaggagctaacgatgctaaaaggactccgacttgctgatgattacgtggtaaaaccggttagtttacgtgttttaaaggctcgcattgctaaacagctgccgatgacagtgcaacaatttggggcggttagcctgaatttagccactggtcaagtgacgaaaaatgagacagcggttgtgctaacggcggccgagtatcgtttgctggcctatttttttgccaaccccaatcaaattttggcaagagatcagttgctagcagccttgtgggacacgcgtgagcagtttgtggcggataatactttaaccgtgaccatcaaacgtctgcgggaaaagcttgaggatgatccggcacatccgaccttaattcggactgtgcggggaatggggtattttattgatggttaagcatgattattgggctatgccggaaaccaaaagtgtgctgagattgacagtgtggttgatagttattttgtgggccgctttactcacggtgatggtgcttgtgccagtcactcggctttggctagttgttagtggccttggcagcacactggccagtagttgggtcgtgttgcggtgggcagtcaagtttagtcagcgttttgacttggcgctgcggcaactagatctgacaaaggcaggtgcaagcaactatgcgattgatcggaatgatgaaggactgttttccgatctcaacaatcgactttatcaatatgcccgccaaatgcaggctgaacgcacggcggtgaagcgtgatcgcgatcagctgagtattgctattacagatattgcgcatcagttgcgaacacctttagcggcgaataataatttgcttgaaatgatgaccgcggctaattgggaggtcacccgtcaggagcttttagcgcagcacacgcgtcaagcagagttagttgagcagctcattttattagctaaggtggatacacatacgctgagccaaactagacaagatgtgagcgtagcggcgctggggaaagaggcattgaagccactgctgcgaatggttgctgataagcagttgacgattgattggcaggtatcaccagacctaatgcttcatgtgaacccggcattggtcaaagaagcgttggtcaatgtcttgaaaaatgcggttgaacatactgcctttggcggtcaaattcagattattgggattgctgatcctattcgcgtccgcctgaagattatcaatacagactcaccaattgctgaagcagatatgccgcatttatttgagcgttttttccgtggtcaatatgccactgccaataacgtgggcattgggttagcgatcgctgctggcattacgcgtgaaaacgatggccgcttatctgctgaaaataccgcggaaggcgtacaattcacgtttgaattttttcgttgagcgtgttttgtcacttacttgtcacttaccattgataggctgagagtatcataagaaagccaacacagattgatgtgtcaggcgcgaggaggggtactagtggccattttgacagcacgacaactgacgaagcaatatgcaggggaaagtcgaccagcgttagatcacgctgattttagtattgaaaaaggtgaatttgtggcaatcgttgggccgagtggttcgggtaagtcaaccttgctacatctgctgggcggtattgatcaaccaaccagtggtcgggtacagctatacgatacagatatttatgctttggatcagacccaattggcgatttttcggcggcgacaagtcgggttgatttatcaattctataatctgattcccgatttgacagtggtcgagaacatgacgctgcccgctgacttggacggtcgaaccgtcgcgacatctgagttgacagaattactggctactttgggcctgacggaaaagcaagatgctttgccaaatcaactgtcaggcggccaacagcagcgcgtggcgattggccgggcactgatgaatcatccggccattattttagccgatgaaccaactggcaacttggatcgccgaaattcacaagacatcatgaccttattgcgacaggcgaatatcaagcaaggccagactttaattgtgattacgcatgatcccgatatcgctaagcaagcagatcgcgttgtaaccatcaatgacggtgtgctgcgtgaagggcgatgagcgtcatggggacgatgacccatttagtttggcgtcaactgattaaggagaaggcgcgcacgttcacaaccattctggcgatggcagttgctgcgaccttaactgtggccaccttgattggcattaattcggctcggcattcaatgtatcaagataatattcaaaataccggcggcctacagtttgttttatcgaaggttaaccaagaaaccgcactggctattcagaaaaaagccgatatttccgaaagtgtccgctatcagcaacaaggacaaatcagctttgctgatcaggtacctaaccaaccagattcgcctttgttaatgttgccgaaaccggcgctgcagcgattaatccaacccattcttttggaagggcggctaccccaaaatgagcaagaagtcatgttagcccaagatttgatttctgatgtttatgcagtgggcaaaaccgtggcggcacagcgcaatggtcagcgcgtcgttcttaagatcgtcggtagttaccgtggctatgctggcctcatggcaagtgatggcgctgtcaccaccggccattttgacggcacgaagaactatgctgttgcagcgacttttggcaactatgccaatttttacgcgaagttgaagaaactcacagcgcagtatcatgtcgaatccgaccagcagagaatgaatgaattagctttggaacgggccggtgagtcgcgagatgtcaaggtccgtgccatgttcgtattacttgtcatcgtggtgctaagtgtgattggtttggtgtcattggcgttgatttataccggcatcaatctgagtgtacaagcacaaacgcagcgttatggcttattgcgttcaattggtgcaacgccgagacaaatccggcaatcggtgtatctgcaagcactgactttggcattgccagcgattttactgggtttgcttgcaggaataggtgggttgtcactcgcttttcatgaattgaatcgaatttttaaggcgagtggtaacacctttcagctcctactcacgatcagttggtggccgattttagtcagcggatttttcatgttgcttgtcacgttactagcagcacgacgaccagccaaacgcaccgcacaagtgagtccgattgccgcagttcgcgcgcagtcagcaagtcggaaggtgagtcagcgtatgttacggcaagggatgctgggacgatttttgccgacgccgattgctaaattggcttataaacattatcggcgtttgggctggtcaaaagtcacgatgatgacaacgctggccttgtcactcatgatctttatcggctttaccagtttctttcgcggcatgttaacttttagcgatgaaacgattagtcgccaggcagatgtgacgatcaccaagacacaatcgctggcatcagcgaatttctcttttaatccgaggcgactgccaggggtgaaacgcggaacggtgactggcacaactcaagtcggtttgaaaaacgctccacaagcatttcatgatcggctgaatgtgatcgtgttgagtgaccaaacgttcggcactgtttttaaagatcagccgacgattatcacaggcagtcggttagtgacaaactcaaaaacaggcaagcgccagcagcaatgggacacgccaaaagattttgcaggaaccttggagcttgctaacgagcaaagtagccaaaagactttaacgcagccgatgaaggtcgtcaccaagactgctgcggaaatgaccgattggcttgtcagtgaccaaagtggtttggtgctttctgctagccggttccgtcaaatcagccaagcactccaaattaaaaatgatgacatcacgtatgccattcaagtcttactaattaaaccaagttttcatgagacggtggccagtgctttacggcatgaattgccacatgcagcactttttgatcaaattgaaaatgatgcgcgtggcagcagctttcagcttgctattcaagtcatggtctatggttttttaaccctgctgacccttgtgagtctggcgaacattgtaaatcatatttttgctaatctgttgcaacggcggcgaagtctcgccatgctgcaaagtgtcggtacgacacctgttcaaattgttcggatgttggcacttgagaatgggtttctgtttgggacaagtatggtgattggatctttgctggggacactgcttggctggattgtgcatcaagctgtcaacaccggtattacgatggcttttcaggttccttggttagagatggggatggccggtcttgcattactggctatctggggtatttttgcaggcattagttttcagattatgcgacatcaggatattgatcaattgattcgtgtgggttaagacaaaagtgaaatggttgatggcactgatgcttcggtttctaaccgcgcctgatcacgctctgttcttgcaatgggcttcacaaggtggtagtcttttaacaatttaacttactgccatcactatcacgccacgatcatcaggaggtcatttaatcatgggcatgcaccaatttatccagggactaagcaacttagagacactgcgtcgggcaccgggattctttaagtatcaggaacattcagtggcggcacatagtttcaaagttgccgaaatcgcgcaaatgctaggcgatgtcgaggagttagctggtaacaaggttaattggcagatgctctatgagaaatctctgaatcacgattatactgaacgttttatcggcgacatcaaaacgccggttaagtatgctaccccgacactgcgccacatgctggctgatgttgaagcgaccatgacggagaactttatcaaaaatgaaattccccgtgactttcaggatcgctatcgtcgtcgtctttctgaaggcaaggatgaaacgcttgaagggcagatcttgagtgttgctgataaaatcgatctactatacgaaggttttggcgaaatcgagaaaggcaatcctgaacaggtttttctggatatctactccgaaagcttaagcacgatcctgcagtttcggaatcgtcctagcgtgcgctacttcttggaggaagtattgccggacatgcttgatgaaaaatttgccagccgcgatcagcttgctaaactgactaaagaaaccatggcagaacatgaaccaaacaagtagcgaaagtatgttcgctatgttataataagcacgacaaaagttggaatgcgcatcatgtcgattccaacttttttgatgacgaaattttgtttggataatgtaaaaatgcgttcactggggcctttttcctgcacggattgacacgtgttcaccttgtattcggaatgaatgatgcccatgtgattgttttataggaggcatgtcgatgatcgaacgaatagccgatcgtaaatttgatctggtttcaccttaccaaccagctggtgatcagccacaggccattgccaagttgacaaagggctttgaagaaggtaagaaagaacagatcttgttgggtgcaactgggactgggaagacctttacgatgagcaacatcatcgccaacttgaacaagccgaccttgattttgtcgcacaacaaaacattggccggtcagctttatggtgagttcaaggaattcttcccgcataacgcggttgagtattttgtttcctactatgattattatcaacctgaagcctatgtcccgagtaccgacacgtatattgaaaaagatagtgcgattaacgacgaaattgataaactgcggcacagcgccaccagtgcgttgttggaacgaaatgatgtcatcgtggtggcctcagtgtcgtcaatctttggtttaggtgatccgcacgaatacaagaatcatgtgctgtcattgcgaactggcatgacgattgatcgtaatacactgttacgccaacttgtagatattcaatttgatcgaaacgacattgattttcaacgtggtcgctttcgagttcgcggcgatgtcgttgaaattttcccggccagtcgtgatgaccatgcgattcgagtcgagttttttggggatgaaattgatcggattaccgaagtcgacgcattgaccggcgaagtcatcgggacacgtgatcatgtggcaattttcccggcaacgcatttcatgaccagcgatgaacagatgcagcgagcgattaagagcattgctgctgagttagaggcacaattgaaagtcctgcgcagtgaaaacaaactgttggaggcgcaacggttagagcagcggacgaactatgatatcgaaatgatgcgggaaatgggtttcaccagcggcattgaaaactattcacgccatatggatggccgtaagcctggtgaaccaccgtatacactgctggactttttcccgaaagacttcaacattatggtggatgaaagtcatgtcaccatgccgcaaattcgcgggatgtacaatggcgaccgagcgcggaagcaaatgctggtcaactacggcttccgtttaccaagtgctttggacaaccggccattgaaaatcaatgaatttgaacaacatgtccatcgtattttgtatgtgagtgctactcctggtccttatgaactggatcgggttcctaaagacgatattgctgagcaaatcattcggccaaccgggttgttggatccgaagatcgaggttcgaccggtcatgggtcaaattgatgatcttgttggtgaaattaacaaacgggttgatgctcacgaacgtgttttcatcaccaccttgaccaagaaaatggctgaagatctgactgactacctgaaagacatgggcatcaaggttcgctacttgcatagtgacatcaagacacttgaacggacgcagattattcgtgatctgcgacttggcaagtttgatgtgctgattgggattaaccttttgcgtgaagggattgatgtccctgaagtttcgttgattgcaatcttggatgctgacaaggaaggctttttgcgtgccgaacgttccttgattcaaaccattgggcgggcttcacgtaacgagcatggcaaagtcatcatgtatgctgataaggtgacagattccatgaaggctgccattgatgaaacacaacgtcgacggacgattcaggagaagttcaacgaagaacatcacatcacgccaaagaccattatcaaaccgattcgggcagctatttccagctatgaacaatcagatgatgataaagccgaggccaagaagacttttgctgaagttgattatgaggatatgagcaaggctgataagaaggagttagttgcaaacctgcgctcacaaatgcaggcggcggctaagaagcttgatttcgagcaggcagcgtcattacgcgacacaattcttgaattgcaggctgatatgtcctaatcagatcgcacttgcacgatggcaccaagtcagccatgattgctttgaacagatccggcgagcgcgttaaggtgagcggtcagaagtcggcgtataagctgttgtggcaatgtgattttcgccaatactgcttgctaaaaatgaggagatcttttgtgaatggcaaacgataaaattgtgatccatggggctcgtgcccacaatttaaagaatattgatgtgacgattccccgcaataaactggtcgtgatgaccggcctatctggttcaggtaagtccagtctggcttttgacacgctttacgccgaaggtcagcgtcgttacgtggaaagtctctcagcatatgccagacagtttctgggacagatggaaaaaccggatgtcgattcgattgacggcttaagtccggcgatttcgatcgatcagaaaaccacttcaaaaaatccccgatcaactgtgggaacagtcactgaaatcaacgattacttgcgcttgctgtgggcacgtgtcgggcatccgatttgtccaaatgatggcacaccgattaccagtcaaagtgttgaacagatggtggatcgcgttttagccttacctgataagacccggattcaaattctgtcaccagtggtgcgtcgcaagaaaggcagtcataaaaaagtcttcgccaaaatcatgcgtgaaggttatgtccggatgcgtgttgatggtgaagttgttgatgcaacggctgattatgaactggataaaaataagtcgcatgacattgatattgtgattgaccgaattgtggttaagcctgaggcgcgcagtcggcttttcgattcatttgaagcagctctgcggttgtcagaaggttatgccaacgtggacgtgattggcggtgaaccactgcgcttttccgaacattttgcctgcccgatttgtggctttacgattggcgaaatggaaccacgactattttcattcaacgctccttttggcgcttgcccagaatgtgacgggttgggtgttaagctgacagttgacatggatttggtgctgccagaaccgagtatgactttggcagaaggggcaatcgcgccatggaatccaatcagttcccagtactatccggaactgctggctcaggcggcgaaaaccttcaaagtacgaatggacgtaccttttaacaagctgacccaccgtgagcggaatgtggtgcttaatgggagcgacggcaagttattccattttcattatgaaaatgactttggcggtgtacgcgatgttgatgtgccttttgaaggggtgctgaataacatttcccgtcgatatgcagaaacgaatagtgactttactcgccagcagatgcgcagttatatgacagcattgccgtgcccggtttgtcacggcaagcggctgaatcggcaggctttggctgttaaaattgaaggtcgcgatattgcagaagtttctgatcttgccatcaaggatgccctaccatttttcaaaaccgtgcatcttagtgaagccgaaagcgtcattgcccaaccaatcgtgaaagaagtcgttgaccgcttgacattcttggtcaacgttggtcttggttatctcacattgagtcgtagtgctggtacactatccggcggcgaggctcagcgaattcgcctagctacccaaatcggttcgaatttgagcggcgtcatgtatgtgcttgatgaaccatctatcggcttgcatcagcgcgacaacgatcgcctgattgcctccttgaaaaaaatgcgcgatcttggcaacacgttgatcgtggtcgaacatgatgaagatacgatgcgcgccgccgattatctgattgatgtcggaccgggggctggcgaacacggtggccgcatcatggcatccggtacccctaaacaagttgcacgtgtgcgcaaatcaatcactggccaatatttatcagggcgcaagtttattccggtaccactaaaacggcgacaaggtagtggcaaagtgattcgtttggaaggcgccactgaccacaacttaaaaaacatcgacgttgattttccattaggtaaattcatcgtggtttctggtgtttctgggtcaggtaaatctactttggttaactcgattcttcggcgtgcattggctcaaaagttaaatcataattctgagaaaccgggtccatacaaaaagattcttggctataaaaatattgaaaagctgatcaatattgaccaaagtccaattggccgcacaccgcggagcaatccggctacctatacgagtgttttcgatgacattcgcgggctatttgccgaaaccaacgaagctaaattacgtggttacaaaaaaggccgctttagtttcaacattaagggtggtcgctgtgagaactgtaaaggcgacgggatcatcaagattgaaatgaactttttacctgatgtttacgtgccttgcgaagtttgccatggcaaacggtataactctgaaaccctcgaagtaacgtataagggcaagaatattgctgaagtgcttgatatgactgtcgaagaagccactgacttcttcaagaatattccaaagattcggcgcaagttgcaaaccatcatggatgttggccttggttacgttaagctgggacaaagcgctaccaccttgtctggtggcgaggctcaacggatgaagcttgcaagcgaactgcagaagctttcaaccggcaagaatttttatattcttgacgaacccaccactggtctgcatacggatgatatcaagcggctgctggaagtgttggaacggctagtcgatgaaggcaataccgtactggttatcgagcataatctggatgtcgtcaaaacatctgactgggtcattgatcttggccctgaaggcggagacggcggcggtcagatcatcgccaccggcacacctgaacaggtggctaatgtggccgatagttatactggccaatacttgaaaccaatcctcgttcgcgacactcaacggactaaggaagctgcgcaaacatcaaataagaatgaagcgcaggcggtaagcaagaagtagattgactgaacaggttggaacatcattcacggcggttaataagggcaaacaatgacaacaaaattgtttgcctttttgatatggggaattgaattttcgagacactagtaccaaggcggagcaatcgtagaccggatggggatcagtagtacaaaaagcacggcggccgtgccttgtcactgatgtgttaggcgacttcgagaccgcgagttttgcgggcttggagcgttgtctccggtctagcaacgcgtcgccagcccagaaaccgagttgtttcacactctgatttgctcattctcgtgcttaatattatgatgaataggattaagaaagtagggaaatagatgttaaatcgaaaaagttttggttttgactgggggcagtttatcactggtatcctgttcctgatcgctgcatttgttgtcatgcgctatccgctggcaacgttgaaaacggtgacctttatctttgctgttgttgccattattcgtgggattgcgattttagcagggtattcaacgcttcgccagctcactggtaaactagcttgggggtcgctcttgatggggatttttgaccttgttattggtgtcattttcctggtcaacagtaattttggtgttgcaacgattaccatgatgtttgcaatctggttcttagttgattcagttggttcgctattcaacgtgggccatttgcggattgcaggtactggctggtttgtcctttacctcgttttggatattctggcagtgattgtgtctttgatgctgttcatgcagccagtggttgcggccatcacgttggtcacattattgtcgatgtttttcgtcctattcggcatcgaatgtattgtccttgcctttgcacgacgcaatatttaatgaacatcgcttttatttaacctgatgcagctgattcattgcgctgcatcaggttttttaataacaacgcttgatgatgcggtgaaaagaaaccggagatcggtaggaatgacacgcccggcatgttatacttgaataaatatgatcaaaaaggagccttttatgactgaaagtttggatcttgtcattatcaccggtatgtccggtgccggtaaaaccgttgccatgcaggcattcgaagacctgggatatttttgcgtagataatatgcctccagctttgttgccgaagttttgggaattggtaaaagaatccggaaagatcacgaaggtcgcgcttgttgtcgatctgcgcagtcgtgctttttacgatcagattatcgatatgctggctaatttggacaacaatgcctatgttcattctcgcatcttattcttggatgcaactgatgaagagctggtttctcggtacaaggaaacccgtcgctctcatccgttggccatggaaggccgattgatggacggcattaaaaaagaacgtgcattactcacagaattgcgcaatcgcgcgcaggttgtgattgataccacgaccttaagtccacgtcagttacgggaaaagattttccttaactttaaggaaagcggtagtcaaccagcatttcatattgaagtcatgtcattcgggtttaaatacggattaccaatagacgctgatattgtcatggatgtccgtttcctgcctaatcctttttacatcaaggattatcggcccaagactgggcttgatccggaagtttacaattacgtgatggataatgaagatgctgaaagtttctataacaagttttatgatctattgtctgaaatcatgccaaagtacaaggcggaaggcaaaaccagcgtaacgattgcgattggctgcacaggcggccagcatcggagtgtggcttttgccgagcggattggtaaggcgttttcagatgcatatgccgttgatatcacgcatcgagacattaagaagcataaggagacggtgaatcgctcatgagtcgtgaaactaaatttattcgggtcatccgcggtcggcgtccaaaggtggttgtcattggcggtggaacaggcttgccggtcattttgcatagcttgcatgaacaagatgcagatgtgacggcgattgtgaccgtggccgatgacggcggttcgtcagggacgattcgcaactatattaatgtagtgccgcctggtgatattcgcaatgtgctagtggctttatcggagttgccgagtttgtatttggatatttttcaatatcggttcaatacaactgatgcttttttcgctgggcatgcgattggcaatctgattattgccgcgctgtctgaaatgaaaggcggcatttttccagcggttcagcaactaagcgaaatgatgcaagttgatggtcacgtttatccggccagcaacacgccgttaaccttaaatgctgaattcaccgatggtacaaagctgtctggtgaagctgagattacagcggctgggaaaaacatcaagcatatttcggtttcagaaacagatcctgccaatggcaaaccagaggcggtcaaagaagttatcgatgcgattatggacgctgatgttgttgttttaggcccaggcagtcttttcactagcattttgcctaacttgatgattgaaaatctgggggatgcggtgaagaagacgcaagccgaagtgatttacattgtcaatatcatgacccaaaaaggcgaaacccagcattttaccgatgccgatcatgtccgggttctgaatgaacaaatgggcgagaactttgtggacacggttttggttaacattgaaccagtccccgataattatctggatcatcaaaagtacaacgaaattctcacgccggttaagcataactatcaaggtttgcgagacatgggctgccgcgtgatttccgaagattttttaaagttgcgcgatcatggtgtctttcatgatggtgataaagtcgccaaggagattttaaacttggcctttcaggtcagcggcaaaacccggaggtgagggtatggcaagtttcgccagtctggtgaaaaaagaactgacacagctcgaggtacatccagaacatgctaaggctgaattgtctgctttgattcgtatgaacggcagcctgacactgatggctcatcgttttgtgttaaatattcaaaccgaaaatccggctattgcacgtcggatttatagcttgattcgccaagtctatcatcacgaagctaatctggttgttcaccgtaagatgaagctcaagaagaattatcaatacattgtgcggctaacagaaggcgtcaatgacatcttgtcggatctatcaattttagatccggataccatggcgatttcaacaaccgttccagcttcggtgttgaaggaaccgcagcggatgcgttcttatttacgcggtgcctttttggccagtggttcagtgaataacccggaaacctcgcgttatcatctggaaatctattctttatacgataatcacaatgctggtattttgaaaatgatgaatcattttaatctgaacgctcgcaccgtagaacggcgaagcggctacattgtttatctcaaggaagcagaaaagattgccgatttcttgcaggttattggggccacgaatgccatgctgaagtttgaagatgttcggatcatgcgggatatgcggaattcggtgaatcgattagttaactgtgaaaatgcgaatatgaataaaacgattgacgctgcacagaagcagattgagaatattaactatttaaagaaccatgttgggctggataacttaccggccaaattgcgggaaattgcggttttacgtttagcacatcctgacgtctcgcttcaagagcttggagcgatgatgccgagcggccaaatttcaaagtctggggtcaatcaccggttgcggaaattgaatcagattgctgaagggtatcaacaaccagaagacgcttgagcactaatgcgaagtgggttgcgttcgtcataatcgggtgttgacaatcaacaaatcaatccctttgtttcctcaagctaatcgtgtacaatgtaaccgacatcaagttatttttttgctgaagattgactgttttggacgcatgtcgatatcttttagcttggatgtatccctttggcgacgacttgtttgaaggagccgtgatgatcttggcaaccagagagaagcgccatcgcttttttgagatgaccgtcttgaagcaatgacgtgagccccgtcggtgttgatggtggctaataattgatagatgagcgcatttttcacagtgtggacggcttttgcgagctgttcgcgcgtttaaaggtaagttttaggaggaagcagcatggttaaaccgattactttgaacgaacagctttgttttgcgatttacaaagcacaaaaacaatacaatcatttctattcacaagcgctagccccgttcaagttaacctatccgcagtacatcacgttattgtcgctatatgaacatggcacaatgtcggttaagcaagttggacaaacacttgaactggatagcggtactttgacgccgttaatgaaacggcttgaaaaagatggctggatcagtcgcaagcgttccactgaagacgagcggcgagttgacgtcagcctgacccaaaaggcgctggacgcccgtgatcagatttttgaacacgttggctcctgcatggaattaatgaaccttcctaagcctgagtatgatcatatcaagtcagaagtcagtcgggttgatgagcatttaagtgccattcccgacggcgcttttcccgaagcttaacatcaaaaaacaaggtcaaagatttttatctaaatctttgaccttatttgactttagttgtatacttagcactgtacttttaagagtgctaataacgattatcaggaggttaggacatgctagtacctaccgtcgttgaacaaactagtcgtggcgaacgtgcttacgacatttactcacgtctattaaaagaccgaatcattatgttatccggtgaagtcaatgatcaaatggccaattctgtcatcgcgcaactgcttttcttggacgcgcaagactctgaaaaggatatctatctctacatcaacagtcccggtggtgttatcaccagtggcttggcgatgctggatacgatgaacttcatcaagtcagatgtgcagacgatcgctatcgggatggctgcctcaatggcgtccgttttgctggctggtgggacgaaggggaagcggttcgcattgccgaactcaaccatcctgatccatcaaccttcaggcggtgcccaaggtcagcagaccgaaattgaaatcgctgctgaagaaatcttgaagacacgtcgcaagatgaaccaaattttggctgacgcaactggtcaaacgattgagcaaatcaagaaggacaccgaacgtgatcattatatgagcgctcaggaagccaaggattacggcttaatcgatgatatcttggtcaacaaaaatacgcaaaaataagctgtaaaaagaaaagcgcgttgccatatcgtggcaacgcgtttttgtttccccgaaaagacttgcaaagcgagggcatattgagtaatataattaggtacttgcgcggttagtgtaatggatcgcacgtgagattccggttctcgaaatccgggttcgactcccgggctgcgcagaaacccggttaaatgggaaagggtaggaaaaggaaagcccgcttcggcgggctttttgcttgcaaaaaagcatggaaggggaatttgtgtgcaatgagctgaaaagcgcctgaaataattggttattgtaaataaactgtctgattacttgcgacttttgaaacttgttccatgatgtatccctctaattcacctataactgaacacgcaaagcattttgttactccgagcatttgtttggctgcctacttgaccgggtaatgtgcagggaggattagacgattttacttcagagtgaagtattgtgttgaagtgggttgtattagctgactagactgaccgggttcgtcaacattctcaagagcaaggccaattctcgttagattgacctcgctttcactaatgacggcggctaggttgtttgaatatccagcaccagacgctacggttacagctggagtcgggtcatagaattgctcatgactaagacctctatctccaagcgtcaaagtgctaaatccttctaaataagcatcgctgccaagtttgtttaccagtttaaagtcaatctgtattgaaaagaaacgattatctggaatgcttgttttgtaggcactttctatttctgatctaattgagggatcttggatatcattttggagaatctttatagtttcaatattaacaatgacctgcttaccgtcttctgcgaaagtcagggattgagcaggatgatatattttaaccaaagttgctttttttccgtcgcgtacagaaaactcccgactttagttagcggtccacttactttcttgctatcttgtttgactacttttttggatgtctttgttgaacttattgaagaagaaggactagaagagttgttgctacatgctgagaacgacaaggcaattaaaatcgaaagtccaaccacaaaactttttctccctcaattttcaagtcaagtgcaacgatgataacgaattcttgatagtggtctaggctgttacgccatgcatcggtagtaatcgcatgggcgaagatagttcagaatacgtctgggacgatggttcagtgcggaacacagaagttaagcttcttcacgccgagagtagttggtgggaaactgcctgcgagggtaggaagctgccacgctttttttattccggtttagctcagttggtagagcacctgactgttaatcaggttgtcgtcagttcgagcctgacaaccggagttttttatggagagttgtccgagaggctgaaggagcatggttggaaaccatgtatacgggttttacctgtatcaagggttcgaatcccttactctccgttgtcttgcattcggatgtagctacataagaagcctcaaaacgctgttaattcggtgttttgaggtttttttgaacatcaaataaaatttgactgtgcctgatatgattagtagcatgagtggggatttaaaggatggttaagacatctgaccatcacaaaatcgttaaccgactttagtgactattttttacgaaaagcttgtaatttttaatagcttccgctagtataaatagagcaatagacaccacacatggaggattagctcagttgggagagcgtctgccttacaagcagagggtcacaggttcgagccctgtatcctccataatgaaaacacctaccactgcggcaggtgtttttcttttacctttttgaagttggacggggcgtccaacgcatgagatttgacttagtttaaatagctattagagggggctgattctgacaataaaaacgccactactgattgtggtgacggttgattagccgtgcatgcgcgctagatagagtaacagcgtcgcaatgactgggctaaattggtaaaggtagctgggtactttaaatggtcgacggctgttgatgagcgtgacaaggatgatgataccgccgatagctattaagttgagtcgttgtaaccagtaaccgataacgacggtgattgccaacaagaccatatctgtccacttgggaaaatggttggcccataacccgattagtgctggcacatatagtaatgccaagtcgagcaacatatcctgactgagaaaatgcaaacccgcgtaaataagtaagatttggaataaaattgcttggccaaaagcaatggtaccaacccattgcttggtaactttttgtgtgcgcaacaaaaatgtcaacaggagctgaacagcaactaatggtaacaagatccattgattgatggcaccaatgataccggtaatagcggcaatgattagaactaatgggtaacgtttaacgaccattgcagccgctaagcaaacgcccatgagtaaaagcgcgatgatttgaaaatgccatgtaatttgcaaacttagcgcgatcagaaacggataggcgagtatttgtccgataaaggccgctgcaccagcaccttgattgatatttttcaaattgattatcctttctatgatgcttccattttacaaaaccctgagacggtaaacaaagattttcggaaattttacatcttttatgttatgctactagagttgcaaaacattcccgatggggttcgtcaaagctatgacgaacatgccttgtaacctaaaataataagggggaaacaaaacatgcaggaacgccatttatttacgtcggagtctgtttcggaggggcatccggataaaattgctgatcagatcagtgatgctatcttggatgccatgcttgaacaggaccccgattcacgagttgcttgcgaaacgacggtgacaaccggtttggtgctggttgtcggtgagatatcaacaaaggcttacgttgatattcaatcagtggttcgcgggacgattaaaaagatcggctataccaaggaatcaggttttgatcctgatagtgtcggggtgctggtcgctttggatgagcagagtccagatatcgctcaaggggttgacgaaagtcttgaagcccgtgagtctgatactgatccgcttgacaagatcggtgctggcgatcaaggcatgatgttcggttttgccattgacgaaaccgaaaactatatgccgttaccgatttcattggcccacgcgttaatgcgcaaaactgattcattacggcacaagggtgaaattagttatctgcgtccagatgctaaggcgcaggtcacggtggaatatgatgatgatgacaatccaattcgggttgattccgttgttgtctccgtgcaacatgatccggatgtcacgcttgaagaaattcgccgcgatgtcgaggccaagattattcgcactgtgattcctgaagctttaatggatgatgacacgaaaatttatgtcaatccgactggccgctttgtactgggcggtccgcaagccgattctggtttgaccggacgcaaaattatcgttgacacatatggcggttttgcccgacatggtggtggtgccttttctggtaaggacgcgacgaaggttgatcgttcggccagttatgcagcacgttatattgccaaaaatgtggtagcagcgggtttggcgaaacgggttgaagtacaattggcatacgcaatcggtgttgccaaaccggtttccgtgtcggtgaatacatttggcacaagcgcagtatcagaagatgtgattgaacaggcaatccgtgagaactttgacttgcggcctgctggcattattaaaatgttagacctgaagcggccgatttatgaacagacggcagcatatggtcattttggacgtacagatgttgatcttccttgggagcacttggataaggtgcaggctttgctcaagtaccgagattagcgagaaaagaggcggccttagtcgagaattattctcggctgggtcgttttttcgtgcttatgaggggcttctcaagactaacaacatcgcctggcaactcagaagggatatttatgaagcaaaggaaaaccaatgtcgcactcgtaacggcggcaatttttattggcacatttatgacggcgattgaaggcacgattgtgtcaacggctatgccaaccattatcggcagtttacatggggttcatttaatgaactgggtcttttccatttttctgttgactaatgcgatggcgacgccgatttacggcaaactgagtgacaaaattggtcgcaaaccagtttttctcattggactaacgatatttgtcattggttcgttgctatccggtttgtcacaatccatggaaatgctaattattttccgcgcaattcaagggattggtgctggggctattatgccagtgacatttacgattatcgccgatatttatccattcgaaaaacgagcaaaaatgctcggttttaatggctcgatgtggggaatcgcttcggtaattgcgccgttattgggcggttttatcgttgatcagttaagttggcactggattttctttattaacgtaccgttgggtattttcacgtttggccttgtgtggttctttttgcaggaagatcggcgcagtgtccggcagccgcttgacatgcgcgggacggtttggctgctggtggccttgttggcgatgatgtatggctttcagacattagctgagcccaacggcatctggcagttagttgccatggcaattgtggctacgctgggcttctggcgtttttggcaggcagaacggcgtgcagtcgatccgatcattgacttgaaactatttgaaaatcgtacttttgtgattcataatttgatcgccgctttgatttcggggttcgtgattggatttgaagtctacatgcctatgtggattcaaggaattcgcggcatggatgcttcccttggcggctttgcagtgacccctagttctttgatgtgggtcgttggctcttttgttgctggcaagttattgggccggttccaacctaagccgattctgacaggggccatgatttggctgcttggcggcagtcttgtgctggcattagtgccgcaatcgacaccgtattttgtctttctgctagttgccggcgccttaggattcggctttggtttggtgattacgattactacggtaacagcccaggccgttgtggtgcctgatcaggttggcgtggcaacgagtttcaataccttgtctcgaacgttggggcaaacactgatggtctcggtttatgggattgttttgaatctgcgtctgactcaaggtatcgcggcagatagccggctgaatagcaatatgctcaacgaactgattaatccacataccgccaaaaatttacccgcagcagtgttgccaacgcttcggcaaattttgtatgaaggtctgcacaacatttactttttctcgattatcatcgtggcgttggcgattctagccaatcattttgaagcaaaaagggtgctgacaaaagaaacaattcaggagtcgaatgaagaaagctgaatcaactgaaatatcatacaaaaaaccggattctatttaagaatccggttttttgtacgctgatatcgctctcgtttgccgataaatagctgaagttaaaacggactgaccactcgatcggtatgatcttcggtggcggtttttctgacaggttgtttgtacaatttcgctgttttatcggtgacttgcgcaatgacatcgtagtctgggtcattttctaacgggccaaaattgaacactgtctgcgttgcttcgcgcttgatatcttgcaatctagtgctgataaggacatgtagcatatctgctttttgatgtgatcgttcgatttcttcactggctttggctaaagtatacccttcatcaagcattgtcttgatcatgacgattaaggtgatgtttgccaaggagtatcgtttattgccattagcgtcatgcctgcgagaatgaatgagctgcttcttttcccagtatcgaatttgcgttggggtggctccggtgacgcggctggtttcgcctatgccgagtgaaatatcgagtgaacgtaaacgtgcattaaacggtcccatgacatagcatcctctcttgaaaatgcgctcactggcgccaaaaaccgatgcataaggaccatgattgtgatgaccgattttccggccatcacggccaagcccacttatgatctggtttctcaacgcgcctgttcacgctattaccttgacatttattaagtttaaatgtaatattttctattgtcaatattacattatgtgatatagaaaacatgaaatcttataaagaaactaggcgaatttatggacgttaaagatatcaacgggaaacacgtcaatgtaccaatgatggtcacgaccttgatcgttgggacgtttattacgattttgaatcagaccattctatctaccgcgtttccaacgctgatgaaggccttcaacatttcaactgcgacagtgcagtggttgtcgacaggcttcatgctggtaaacgggattatgattccagtatccgcatatctgagtgcgaaggtgccatcaaaatggttatacatgagtgcaatgagtactttttttgttggcacattggttgccttcattgcaaatagttttggcgttttgctaattggtcgattgattcaggcacttggcgttgggatcacgatgccgttgttgcagaacatcatgatgtcgatttttcccccgaaccggcgcggcgctgctatggggatggctggaattgcgattggggtggcgcctgccatcgggccaacgctttccggttatgtcatcgacaatttcggctggcgtttcttattcggtatgattctgccaattgccggtctcgttattttggcaacattgtttttcttcaaaaatgtcttaccgttgtctgatcctaagttagatattccttccttgattgaatcatcaattgggtttggctccttgctgtatggcttttctgaagtcggtaatgatggttggggtgatccgattgttttaggcacaatcgcactcggcattgtgtttatcttcatctttggttaccgtcaattgcacttaaaagaaccatttgttgaattgcgagtgtttaagagcaaaatctttgccttatccacagtcttaggtaccatcgccaacatggcgatggtcggggtagaaatgattttgccaatgtatttgcaaatcattcacggcaagagtgcgttggagtcaggtttgacattgttgcctggggcgattttgattgctttaatgagcccggtcactggtcaagtgtttgatcgcatcggggctaagcggcttgcacagttaggcttgttcttgctgacgattgcaacattgccatactttttcctgacagaaagcacgccttccatttttattacggtgatttatgctgtgcggatgtttgggatttcaatggtcatgatgcctttgacgacgaatgggatgaacgccttgtcacctgatatgattcgacatgggacagcggttaacaacactgtccgtcaggtggcaacttccatgacaactgctgtcatgatttcagttctgtcaaacgtcaccaatctagccaaaccggcggccagtttgttgaaaaccaatccgctgcagtataagcaagacttttttggggcaacacttagtggttaccacgcagcctttctgttggcagcagggttcagtttaattggctggatcttggctttcttcttgaatacccacgcgatgtcgcaagaagtgacgatcaaaaatgaaaagaaggtgaaggcatgattctatggtttttgggcctgacagtgatcggcctttatctcagctttattatgatgaaacgctccagtttgcgtagcacgttaattgcggtcttcgggattggtgtggtgggtagtctattgctgattacgttgaatgataatgcgcattttggcatggtcaaacgaacaacaactgatgagcagaccatctacaccgcctcaccgaatgcacaactgccaatgttgctaaaacaaaacattggcacggatggcaagcatgttgtctacatttataagaccgatccgaagaaaaaagcggttcataccaaggctgatattgttgtaactaatcgggtgacaacgacagcgaatgccacagcttcgttgacgagcaaaacaactcggtggcaatatcaaaacggtttttatggtgcgttgttcaatcatgaaggggctggtcaattggttgctcagcacaatcaattggtcatcccaacaagctggtcagtgctgacaacggctcaggccaagcagcttggtaaaaagttggccgccttgcagcaaccaactgcagaacaaaaagcgtcactggcagccgcagtcaaggctaaagctgctgcgctggccaaggctgatccaaaactagcagcagatccgacagctttagcgaagcaggctaaggctgcggttgaacaagcaatgattcagcaagctgttcgtgaagtgcaagcacaaaaatagtctgatgccgcccataacgtggtactagggcaaacatttttcgtaacattatcttgacgaatggcttttgtcagccttctaaattaaaaaaagcagtccgctattttttaacggtctgcttttttgattgtttggcaactcggtttgtcagataaggactaaaataccaccaactcaccatcagcaaggcaaagccaagtgaaaatccagcaaagacgtctgtgggatagtgaacgcgcacgaagatccgagaataaccggttaaaagaatcatgccactggcaaggcaggtgatgagccatttggcggattgacgtttgagcagtgcccaagccaaaaggatcatggtaccgtaaaagatcatcgtgccactagaatgcccgctaggaaaactaaaaccgccagcatgtaccaatgcccgaatctgaggatcagcaataaaaggtcgtggtcgccgaacccaatatttgattccgacgttaacgaggctcatcaaggcccccatgctggctgcaaaaagtgcagcgtaacgataacgcttgagcagtaacaccacggcgaaagccatggttaaaaggactaaggatgctggattgccgagactggtgattaagatgagtaagggtttaaaagtgacaggatggaactgggtgacagcagcaattacctgttgatcaatggtatgaatccatccagcgttatttagaatacccgtcaataacgtgatgaaaataaataaagcaattgctgcaagatacaatggttcgggtcggcgttttagcacttgttgcctcctctacaaaacgttcgcagtcgcagaaacctccacataaggacctcagacagaaatgaccaaagtccagccatttctgtctgagtccacttatgttccggtttctaaacgtgcccgctcacgctctgaaatcgactaatgttataagaatagcacaaacaccattgaaccttggcaatgtttttgctatgattgacgcaatcatcaaacgaacaaaggagtagtaagttagcgcgggtgacagagagcaggcggtggtgcgagtctgacgaagcaaagaccgaactgacctttgaagttgctggggtgaaattagtagccacagccggccggaccgttatctcctttgagcgctgtgaaagcagaacttaggtggtaccgcggctgagccgtcctaatgtagatagggcggctttttgtttgaaattaagtgggaggtaacaaaatggcatacgatcatcatgagatcgataagaagtggcagcgttattgggccgagcataacgaatttaataccacaaccgatcctaagaagccgaattattatgcgttggacatgtttccttatccgtcaggccaaggcctgcatgttgggcatccggaagggtatacggcaactgatattgttgcacgcatgaaacggatgcaagggttcaatgttcttcatcctatgggctgggatgcattcggcttgccagctgagcaatatgccttgaacacgggtcacaatccgaagacctttaccaaacaaaatattgagacctttaagcgtcaaatcaacagccttggcttttcatatgactggaatcgtgaaatcaacacaacggatccgaattactacaagtggacccagtggatttttgaacaactttataaacatggtctggcatatgaagctgaggtaccggttaactggagtccgaatctagggacggttgttgcaaacgaagaagtgattgatggcaaaacggagcgtggcgggttcccagttgttcggaagccgatgcgtcagtggatgctgaaaatcacagcctatgctgaaaagctgttgacggatctggacgatcttgactggccggaatcaattaagcagatgcaacgcaactggattggcaaatcaactggggcacagatcaccttccgggtaactgacagtcatgagccgtttgatgtctttaccactcgtccagatacgctgtttggtgcaacgtatgtcgtgatggcaccagaacatgaattagttcagaaaattaccaccccagcacaacaggccgtcgttgatgcgtacattgacgaagccgcccataagtcagatcttgatcgtaccgctttagataaggaaaagactggtgtttggaccggggcctacgcgactaatccggttaacggcgaaaaactgccgatttggatttcagactacgttttagcctcttatgggactggcgcaatcatgtccgtgcctgcgcatgatgatcgtgattacgcttttgccaaaaagtttggtattgaaatcaagcctgttattgaaggcggcaatgtcgatgaagcagcttatactggcgatggcgtgcacatcaactccgggttccttgatggtttgaatgaacatgacgcgattgatcgaatgatcaaatggcttgaagataaaggtatcggcagtgccaaaatcaattacaaactgcgtgattgggtcttttcacgccagcgttattggggtgaaccgattcctgtcattcactgggaagatggcgaaaccacgttggtgccagaagacgaactgcccctcacattacctgaagaggctgatatcaagccaagcggtactggcgagagtccactggcaaatctgactgactgggttaatgtggtcgacaagaacgggcggaaaggtaagcgtgagaccaatacaatgccgcaatgggcagggtcttcatggtacttcctgcggtttgttgatcctcacaacaaggaagctcttgcggattacgacaaacttaaggcatggatgccagttgatctgtacattggaggggctgaacatgctgtgctgcacctgctgtatgcccgtttctggaatctgttcctttatgacatcggggcgatcccgaacaaagaaccgttccaacggctatttaaccaagggatgattctgggcgataatcatgaaaagatgagtaagtccaagggcaatgtggttaatccagacgatgtggttgatgagtatggtgccgataccttgcggctgtacgaaatgtttatggggccgctggatgctggtattgcttggtcaacaaaagggttagctggtgcccgcaagttcttggatcgcgtctggagtgctttcattgatgatgaaggcaaactgcgtgatcggattacgacgatcaatgacggtcgacttgataaggtttacaatgagacggtcaagaaggttaccgaggactacgatgctttgcatttcaacacggcaatttcacagatgatggtcttcatcaactcagcgcgtaaagatgatgacctgccactagaatatgttgaaggattcgtgaaaatgcttgcgccgattgccccgcatctaatggaagaaatttggtcacggctaggtcacgatcatagtctgacttatgcgccatggccaagttatgatgaaagcaaaatcaaaaccgacacttacgatatgatgatccaagtcaatggcaagctgcgcggttcgattacggcggatgtcaacgaatcagatgatgagatcaaacaagcggctttggcaaatgataatgttcagaaatttacggcgggcaaagacattaagaaaattattgtcgtaccgcgaaaaatcgtgaatattgtcgcaaaataaccgcactggcttcaccaattaactgaaagaaaaaatggtcaacgaatggttcctgaaggaagcgggcgttgaccatttttttagcgattcagctgtatgaaaagttttgtatttttggcgtttcgattgtgagattacttgctacgtggcggctggtaattgtcaaagttttcttttgattcccgaaagaagcccgggaaagattgcaagtcgcgctgggattgcctaaaatataaaggattatgcaacacgacaggagtttatcatggagaattcgctgggcagcggtaatcaaccgcaacgttcagataaggaaaaaatgatccgcggctcggcgtggatgactgccggcagtgttttttcgcggattttaggggccatttatgtcattccatggcgtatttggcttggagcagcgtttctaactgccaacgctttgtttacaaaaggttatcaaatttacagcctttttctgattatttcgactgctggtgttcctggtgctgtttccaaacaggttgcccggtacaatgctatgggcgaatataaaaccgggatgcgtcttttttaccacggcacttttgccatggtgctgatggggattgtctcgtgtggtgccatgtggctgctctcgccgcttttagcagcgggtgacgcgcgcatgataccggtttttcggtcactggcatggccgttgctgctaattccgtcgcttagtttgattcgcgggtttttccaaggttataacgagatggcgccgagtgccatcagtcagtttattgaacaagtggcgcgaattctttatatgttagtgatgacttacgcgattatggtggcgggtaaccacagctatctgagtgcggtgattcactccaccttcgccgcgttcatcggggccgttttcggacttggactgttagttgtttatttcctccggcaaaaaccacggttggatgcgttggttgcccaaagtgctaattccctgcagatcagtgtcaatgagattcttctagatgtggcacggcaggcgattccatttatcatcatggattcaacgattaatatttactacatcgttgaccagtacacatttaatccaatgatgaaggctttttatctcgttagcgaagatcagcttgaccgtttttatgcgctgtttgccggaaacgctaataaactgattatgatcgttgttagtctggcagttgctatggccattaccgtagtaccattattggcaggtgcgaaaacgcgcggtgatgttgagggattggcccggcaaatcacgaatacactgcagttgttttttatcgtcatgataccttcggcgttggggatggtggcagtcgcgcgcccactgtatgttttgttctatcgggatatggactggttgggcattcgcttgttgcagatttcatcacttttagcgattatgctgggcttgtttacggttttggcagcaattcttcagggattgttcaataaccgtcttgctattcaagagatgctgattggcttggcagttaaagtgattgtacagtggccaatgattttcttcttcaatgtttacggtccggttttgtccacaatgttaggcatgacggtctcgagtctcctaatgctctattcaacgaatcggatgtacaatattcatgtacgccaaaccattcgccgcggcgtcggtattctggccttttccctgatcatgtgcgccgtttgttacctgattgtgaatgcatcaaccttggtgatcaatccgcggagtcagttcggggcagcgttcgtcttgctgattgcagttggggtgggcgttttgatttacgtttatttgattttgaaaacgcgtttggctgatttaatcattggtgagcgaattagtcgacttcgcgatattttacacattcggtgagcttatgcgattagataaatatttgagtcatttacaatttggtagtcgaaaagaagttaaggcacttattcgcgacaagcgggtacgtgtggccggtgatttaatcactgatcctggttacaatgtgttgccggggatcgcggtcgaggtgaacgatgcccaagcggatgggccgcttgaggtcgattatttgatgaacaaaccggccggggtgattaccgcaacagaagatccaacgcaatcaacggtgctggatctgatccgaccacatgattaccgaccgggtttatatcccgtaggtcgtctggataaagacactactggtctgttgttacttacgaccgatggcaatttaggtcatgcactgctttcgcctaatcgtcatattgccaaaacctatgctgcaactttggctaagacattaactgctgacatgaagcagcgactcgaaaccggcattgatttaaaggacttcacaaccgccccggcacaagtcgttgttttgccggataccgatggcaaacgcatccagattacaatcacggaaggtaagtttcatcaagtcaagcgcatgctgttggcagttgataatgaggtgacggccttgacgcgaattgctatgggaccattgtcattgccagccgatttagctgctggggagtatcaggctttaaccgatgacgaacggaccgatttggataatatcactcgttgagcaaccgagcactttgctgtggtgattgtttggctttgtctaagcgagagattttgtttgttacaggagtttaagagagcggccttgattaggcgaaccaagatggctactttgacaaacatgattagaaagggtgcgtgtcatggatcaacaacagtacgtctgccccaaatgccaaaacacggcttatgttgccgaccaatttcaagcaactggtggtaatttttcaaaaatcttcgatgttcaaaataaaaaattcgtgactatttcttgtgccagatgcgggtacacagaactttatcgcagtgaaaccagttctggcatgaacattctcgacttccttttgaatggcggctgagaaggcgtaagttcaggttaagaatgatttcaaaaaagcaggtgacccttcagccgtcgttgtggcggaaagggatcacctgtttttgtttgctgcttgttcacaaattggttcgtcattctgaaagctgctttaagtaggtgggcagttcgcgaatgaccatagtcggtaaggcaacataactattcatagctacaatatcagctacacgggaatggacaaaaacggctgcgagagcggctttgtccaatggctggaactggcccgcaaaggcagcaataatgcctgtcagcgtgtcaccagagccgcctgtggccattgccggcccaccggctgtgttttcatagacatcttcatcaacgaaaacatgtgtctgggaacttttcgcgacgatgatacccggtatttttgcggccgctttttggctggcttcaatggtttgggcagccaggggtaagccagataaccgctgccattcaatctggtgaggggtccaaactagttgggcttgcgggtaatctaggtgatgagaggcaacgagagtgatcgctgatccatcaatgatcatgacctgcttggcattgacggcagcaaaaactgttttcaaaatggtaagggctgtaccatcagtgcccagcccaggaccaacaacaatgaccgttgcttgccgcacagccgtctcaagttccggcgcggtagcatcgaggatcattgcctcaggtaatcgggcgtgcaacgcatgacggttaactgggtcagtcgcaacactgaccaacccggcgccagcgtaaacagcagcactggcactcatgatcgcagcaccgccaaagtgggcattaccgccaacaatcagaattttgccgaaactgcctttatacgtatcacgggcccgtggccggaccacactttgtgcaaattgctctgtcaattgtttcatgacggatttgccgcctcctttaaaacttcccaattagaaaaagttttggtcgtcaattcaggctggccggtcgttaagaatgctttcgcaaacatgacaagcggcgatgcattggcccacgtcaaagtatcaagtggcaaggcgcaggcaccgagcgaatcctggcccataaattgggcaacgcttgtttctagtttaccgccgttaatggatagcgcatagaaaacgcagatgtgctggttgatggtccagtgttggtacttccaaggatagataaaactggttgcccctagttgttgatcaatcgtggctgtcaatccggtttcttcggtgaattcccgcaagacgtcatgttcaagcggttcagggccatcaaggctacccccgggaaggtcgaagcgatgacgataaggacccccatttttcttaatcacgacaagcttgtcgtcaatcgttgcaatcccgtaacaaccaaatgcgcgatgagttttatgtgtcatcaggccacctccattgatcaagggtagcacgctgctgcagggggaacaaattgtaaaaatagttcgtgattttgcttgcgtgccttacctgcttccgttataatcatttatgttgttgccgcgatggcggaactggcagacgcgcagtgttcaggtcgctgtgggatttatcccgtgcaggttcgattcctgttcgcggcattctcgtgatttttaacggcggttaaaaatcgaaatgcccgtgtaacaacgttttagccttcctaattgatgttaggggggctatttttgtgtgcaaaatgtgaacaagcaatgacttatgccttgatgcaagtcatcaggtctggaagctgtgttatattcgtcatgaggcgactgagcaagcggcaaggtgaatgaagagtataaacatgatgtggcctgaaatgaagcacgatcaatagttgaaagggatgatcgctggatgatttattttcttgatgaatacttacttgcaaagaactcaagtgttgaacatgctgcgttgaaacgactggctttgttcaaacaatttaagcaaccagttaagattctgacgcgtgattacgatcgtttgagtgtccaaaccttgcgcaagcttggcgttgctcagacggatgtgcgcaacatgttcgactattttcagcatgtgcccgccgaccgaccggaaaaagctgtgcataatgatgagatcaatttgccgacaatggatgaagtttcagtcgatgctaaccaaagtcaggtcacgaacggcgaccggctgcgacggcaggtcggttatattccaggaaccgtcggccatgtttattatcaaaactttttggacgatcaaggcaatcttgtggaatgcgatctttgggacgcccgagggtttaaatcggccactcagtattttggacaggatggcttgttagcctttgaacgctactatgatcttcgaggtgtaccagtgctggacatttattatgctggtgatcatgctggtcagattcagatcagccggattgttttaaaaggccaaacccttaaagaagatcatgagtttgatacattgggagagttgtttagctattttcttgatcaacttgcgactgaagattcagaaacaacgatttttatcagtgatcgtccggggattggcgttcaaccgctactagcaatgcatgcagccgcaaagaagtttgtttacatacccattaatcatgttttaacacctgacaaaccgcggcaaggcgaacttgatggttttattcaacctgtgctgcagcatccccaaaaagtagatggcttaattgtacaaacgccgcagcagcaacatgatcttcatgatcgttttccgaaagttcgggtggcggcgattccagcggtgacatttgatccggctttgacagcgcgttcggcggccgccgctgcaagcaagaaaatcctgtttgtgggtcgactgtcgcctgataagcaacttgatcagctacttcgggcagtcgctttggcgagtcggcaggtgtctggcgtgacgcttgatttgtttggttacggtgatgaacaatatccaaccgcgatgaggcagcttgcggatcgtttagagattggcagtcaagtgacatttaagggttaccagtcatctctggctgatcagtacccgcaatatgccttgttggtcaatacgaatttgacagatggtggtccgttggcgttggttgaagcacaaacccatggactgccagtggtgagttatcgcttttcctatggacctagtgcctgtgtgattgatcaggaaaccggttatcttatcaagcaaggacgcgtcaatgaccttgctgaagcgattgtgagactgttaaagcggccagagcagtcacaacaattcggcgatcatgccagagcactggcgcaaaagcagctagcgcctgaaaaagtctacgcccgctggcaagcatttcttggactggagagttaacccgacaaaacggtaaggaggttcaggatgtattattttttaaatgatcaaatggcctatgccaagtctggtattgaaggcgcagaaattcagcggttgcagcttttcaaagcgaaccagacgccagcaaagattgttacccggcaatttgctttagatctacacgatgttttgaaagatgcaggcattgacgatactgattttatcaatctgtttgattacttttgcgacctgctgagcacaccgtggcagcaggtaacggttgcagacgtttgccagccgactgcgggcgtgacccgccggcgtgaaggacgccaggtgatcttcagccgcggttcccgagtcattcgaattgtttatttgcgcgaaaaggcggggcgtgagcaagaggttagcaatgttcaatactttgatgtgaccggccgaacgatcaaaatgagttggtgggacacgcgaggcaaccattgtttggatcagtattttgatcaaggcggcaaaattttccaagaacactatttggatcgtcatggtcgcacgcggcttgaaaaactgcattatttaaatcatagccagcaagaaaaattttcgtggaaattggttgattttcatggtgtggattatttatttgatgggcttcatgatttgacaaggttcttctatgatcaactgaatcaggtagatggcggctataatgtcttcgtgtgcgatcggacgacggaaactggctggggcttgttgcacatgacgacaccggcgctcaaagttttgcatctgcacaataaccatgttgccgggaatgaggacgtgctgcatgcgaagctgaataatttttatgctagtgccttgacccatttgaatcgctgggacgctgtgattgtgccgacaccgcagcaggcgcaggatatggccgcccggtttggcacggccacgccgattttcacgattcgagttgcttttgttaaggcggcagatgtagcggctaatcgcctcccgttttcacaacgcgaacaacatctggtggtgcatgttgcgcgattggcaccggaaaaacagcaggcaagttcaattcgggcatttgcccaagttgtgaaggccattccggatgctaaacttgaactctggggttatgccaatggtgatatggcgccaaaactacatgctctggttgaaaagctgcatctcgcggatcacgttttctttaagggttatactcgcgacatagcggccgtctacaatcgtgcacagttaggactgttgccttccagtgccgaaggatttccgctaaccttgattgaagcacaggcacacggattaccgatgatcgcaaatgacattcactatgggccagccgatattttggccaacggtaaaagcgggcttttgacgcaaaatggtgacattgatggtttagcaaatgcgatcattgcgttattgaatgattcaactaagctggcccagtttagcgcggctgcctatgacaatgctttgcgattcactgatacgagcacatttgttcagtggcagaaactcatggcgtttgcggcaaagaaaaagacaaggctggcggcctttgagcatgttgattaggcaccggtcatggcaatgagtggcgtttttactgacaactgttcaaaaaatggtaggatgaggcgtaagcttttaccaagaaatggaggctaaccaatgtcaatttatgattatgaggtcacattagaagatggctcgcaatatgctttgagcaaatacaagggtcgaccaatgttgatcgtgaacactgccacaaaatgcggcttcgcgcctcagtttgatggtttggagaaattgtatgacaagttcaaggatcaaggtttggtagtgctaggttttccttctgatcaatttaaacaggaactggctgatggtcatgcagcggccgaggcttgccggttgaaatacggtgtgagttttccaatgcatgatttgattaaggtgaacggcaaagaagcagctccactatttcaataccttaaaacccaagcccctggtgaactaggcaagtccatcaaatggaactttacgaagtttttggttgatcgtgatggtcaagttgtcgcccgctttgcaccaaaaacaaaaccagaagcgattgaaccagcagtggagaagcttcttggctaacttttgtcagttgcacgtggggctggttcacgctctgttttaaacgcgtttgccagcccagagacctgcgtgtaaggaccttgggtgcaatgaccaaagcccggccatcacacccaaggccgcttacactccggtctctcccgggctggttcacgctctgttctaaacgcgttcgcaggcccagaaacctgcacataaggacctcggacataaatggccaaagtccagccatttatgtccgaggccacttatgctccggtttctaaccgggcctgctcacgctctggacactcatgcatgtgatgcgtacaatgacatcaaaagtaagaaagcagggatgattgatggaagaattgccagctgatgtagcggcttttgttgaaacacatttggttgatcggcgcaatagtaacgccgtgaagtgggatggtttggcaggtgaatttggccgcacggatctcctgccgatgtggattgccgataccgaatttaaagcacctcaggcggtgattgacgccttaaccgctcgcattcaagaaggaacttttggctattccattcggccacaatcctactatgatgccttcattgattgggaaaagactcgccatggcgtgacggtgcagccggaatggatgcgttttggtgtcggtgtggttaaatcgctgtatgccatggtcaattggctgaccgaacccggcgatccagttttaatcatgcagcctgtctattatcccttcatgaatgcgattaaggatcttggtcgcaaagtggtctcggttgatcttcaattaactgctgatggctggcggatagattttgatcaattggataaaacgcttgcgacgcaaaacattaaagccatgattttttgctcgccacataatccggtcggtcgagtttggacccgtgaagaactggaacggctttttgcgatcacgagtcaccatgatgtcacggtggtatctgatgagattcacggcgatttggaagttagtgggccaaaattcacctctgctttgcaagtagctgagggtccggcacgcagtcggcttgtcgtcctgaatgcaccgtcgaagacctttaatcttgcggctttactgaattcgcatattattattccggatgaaaagttgcgcacggcttatgatgatttcatcaaacagttgcatccagtagataccagccttttgggacaggtcgccggtgaggcagcctatcgtcacggtggcgcgtggttagacaaggtgcttcaagttgtccgatataactaccaacagttgctaaccggtctgaagcagagcgctccgaaggctacagttgcggacttgcagggcacctatcttgcctatgtggatattggtgcctatgttgcgccagccaaaattaaatcatttgttgaagatgtttgcggactggcagttgattacggcgcatggttctcccccaaaacagctacgtatattcgcttgaacttagccaccgaccccaaacttgttgccgaggcgattcagcgtttaactgagcacttggctcagccgcaactttaattgaaacaaaacaaaacaccctgttaacgcaaggcatgttgactcattaccaaacatacaaggtttggtgctgagacagcgacgcttgctgatggcagggtgtttttgtgtgagtagtcttagttaacagtcactaagggtgattgatgattaaatgattatcattcatattatgatcctgtacgatttctttaagatatcgccgcagcattggtgagcgttccaaaacggcccaacccggatcggcttttaatcgcttgagttcagctttatcgggatgatcatcgcctgtgaaaaagcgccagttcaagacgcccatcagttttgcggcagcatccaaatcatgctgattcgtcacgccattatccatgagatccccatatgcaagaccttcgccatcttggagaaagagttgcttcagataccgttgataatgtagcagatcaggattttttcgttgcttggcggttaagtaaggtgtgggatcagtcgcatgcttttgataggtgattcggttaggcgtgaacgtcaccaccccataactggcagggctgatcgaaaatgcgccgctgacaatttcaatcgttggacattgcccgtccggatcgcggctgatgtcttgcgcatggatgtgtccggaaaaaagcaacggaacatggtaagctttcagcaacgttttgagttgatcgctgttgtccaaaacaaatccttgattcaccgcttcattgtgggcatatagattgtggtgcatgaaaacaatcgacttgcgatgggccttttgaccagcagctaattgctggcgaacccatttcatggtctgcggtgtgagcttaccaccagtgttcggggggcgattggaaggttcgatcgtataaatattgctgtccagcatcagcaattgataattgcggttaaggttgacgcgatagctcaaactattcggatcctgcgcaactgcctgctcataactggtatgaaaaatattgcgccaatcgctagggctgatttgttctgtcagtagttgtcgtttgcccttgtaggctcgtgcccaaccatcgtaaatatcatgattgccagggatgatcaacaccttcgtaccattggcaacaagtggttgtaggcggcgcatgatactttcggcactggctttttcgccgttgagcgtgacatcaccggtgatgacgagggctgtcgggcgggcttttaaggcgttttgaaccaaagcattgatagcaacgggctgatagtccatatcttttcctgctgcagaacgtttgatttgggtataagcagtcttttcatcatgtagacttggggcaataaagtgggtatcgctgagcacccaaatggttgcctgtgaactattggtgagtgggcgatcacgatcagggtgaatttgccccaagacgattgcaaagatcagcattaaaaataacgctgctacatatttgactgctttcattttcttcctccgtacctagtttaccattgatcaaggtaacaccagcaggtcattttgagtggtgtcaaaaaatttttttgataattaacttgttggtgacttaaaaacgttactgaccgagagcgggattatggtaaaataaagccacatttgaccacgatagcgtttagagagaggacatatacacctatgcaagtaatcgtaacggttatcggtaccgacaaagttgggatcatcgcacaagtaaccactgctttagcagatttagatgttaatattttggatgtttcacagactatcatgcaaggtgcatttacgatgatgctgctagctaaaattccagataatggcaatttcaatacggtaaaaagtcaattggcgaccttgggtgatcaaattggcgttgagatcaaagtagcccgtcaagagatttttgatgccatgcatcggctttaatatgcgttggatcggcaattgtacttatcagagctaaaggagccagtgatggaaactcaacaaattaaagaaaccattgaaatgatcagtgaagagaatctggatatccgaacgattaccatggggatttccttgttggattgtgtaactggtgacctgcaaaccacagccgacaaagtatatgccaaaattatggcaaaagctgccaatctggtgccggtagctgacgccattagcgacgaatacggaattccaattgtcaacaaacgtattagcgtgaccccggtcagcttgctagctggcgcggatcaaaacctcgattttcgcccgattgcccaagcgatggatcgagctgcaaaagatttaggtgtggatttaattgggggctataccgctctcgttcaaaacggtagtacgccagcagaaactgcattgatgaagagtttgccggaggtgttagacaccacggaacgcgtttgtgcgtccgtgaacatcggcagtacacgcagcggtttgaacatggacgctgttaagttgatgggcacggtcgtcaaagaggttgccatgcgcaagccgcagaatgcgatgaaactggtggtattctgcaatgctgttgaagacaatccgtttatggcaggtgctttttgggggatttcagaaggtgatgttgccatcaacacaggtgtttccggtcccggtgttgtagaacgggcgatcgcggccaaaccggcggcaagttttgaagagatctgtgaaacgattaaacaaaccgcctttaaagtgtcacggatgggccaatttgtcggtaaagttgctgcggatcgccttgatgtaccgtttaacattgttgacctcagtttggcaccaacaccggaaaaaggtgactcagtggcgcaaattctggaaacaatgggactcagtcatgttggcacaccaggcacaacggcagcgttggcgttgctaaacgatgcagtcaaaaaaggcggcatcatggcggctgaacgtgtcggcggattatcaggtgccttcattccggtttctgaggatgctaatatgatcaccgcagcggccaagggtcaaatcagtctggaaaaactagaagcgatgacggcggtttgttcagttggcttggatatggttgcggtgcctggcgacactcctgacgccacgattagcggcatgattgccgacgaggctgctatcgggatgattaacaacaagacgacggcagtcagagtgattccagttcctggtaagcaggtgggcgacaccgttgaattcggcggtattttcggtactgcgccgatcatggcaattaacgatggcgatgcgcagcagtttattaatcgtggtggccgtatcccagccccgatccatagctttaagaactaacgcgtctcatttttaaacgatccgacttaggccttgttgttgctggtaattgccagtagcagcagggctttttggttgcggtgcgtaatgttttgatgaggtgaatcgtatgtttgtagccctagataaaaacaatcaacgtgtcacattgacaggtcatgcccaggcggccaatttaacacaccaaacctttcactgtcctatttgcaagcaggtcgttcgcatcaaaaacggaaccgtaatgcctgcccattttgctcaccgaagtcaaccaatgggtgagggtgaaccagagagtatagagcacctaactggcaaatggtggttggcgtcttggctcaaacagcatggcgaacaggcaacgttggaatactatgatgcaaccattcgccagcgcgcagatcttttggttgcaagtaaaccgccgagggtattggaatttcaagcaagcccgctaagcgtgccagatctgcaaaaacggacaatgatgtatcatgcgcgtggttggcaagtgacatgggtattgggtcatcgatactggcatcctgaaggcaagatacaagcacgaaagtttttgagcatcgaagatcatcggctaactttgtggcatttacagacaacggttggtgagttggtacggattcagtttggaaatgaaggccgttggctaacgcgctttcagcatgatgatccgccaactcaaacttggcaggcagaatcgacttatccgcaacgacaaattcggcagattgccatcagtttacaaaagcgggtgcaaccgtggatgacgctgcaagcagctgcttatcaacagggccgcaatttgaatggctctccatggttcgttcacagtcggccccatgtgttacggcattttggtgttccagaactacaactgcgactcaaatggctgttgatctttgaaggacagccttttaccgcgactgccaaccgtcaattttggcaagcggccctgccgaatatctggacgcctttgttgccagctggcacgctcgggaaaatgatgggtgcccactggctgcaagtgttgctggcagaaggcttcgttgttcaggaagatggttgtcgttatcagtggcagcgtttgcctgtttggtttgccgatcttgagcgaaaattggccatgaaaaaagactttgcttaaggcaaagtctgatgaggctgattgcttatcacgattcgcaaggtgggaaaatgggacggtttgtgcgcttatggaaacgtgtttgtagacccagaaaccggcatgtaaggacgctgaacacaatgcctgaagaccggtcatcacttcagaccactgataggccggtttctagccgagtctgttcacgctctaaaaaattctaaagttgctccccatgttttcgggccgttcggtgaagaaaccggcgggatctgttcggatgagatcgcaaagatgtgggatgagtgctgggtcaccgatttgttcgatcaaaacagcatggccgtcatctactttgcgatcggtgtcaacaatgacaagggaaggcgtttgagtgatacccatttggttagcagttcgttgatcggagtcaaagcccattttaacttcggaacgctgacgatcttcataaaacatttcttgatccagcttacaattgtcgagcatctttgccacaaaggccgcatcatattggtattgaaccagaggtgcgtgttgttgtagccgcaacaagagcatccgtgcttttttgttgccttgatattgtgcagccttataatccaacgcaaggttgtaagctgcacggagcagctggttgcgtttagcaagattacctacgctcagttgctcacgtttcataaattgttccatgatatctaaattaagaacgggaacgaagtggacgcgcacttcctgctggaatttatccaattgtctgagtaatttctgttcagtgcccagacagacgctcccgattggattgaaaaaaagaaaaatttctatcacgttaacggcctccaattcgccaacaacaaattcttacatttactttatcagaaaatgagcagggtacaattaatcagcttgtgaatcgtgcacatgcatgaatgcgcgctgaactttgttgataaccggccgtttttcaatgttgaattggtgcaacaaagtatcgtagaaaacttgagcttgtggcaggtcgtggtactccatttccaactcaaaatcagaggtgttgtccatgtaaaaagtctgatcgagtgtcaacaaacctgctttaagatgcgctacacggcgggtcgtttttgcttgggtttgcggatgaaccgctgcggggtcaatttcacgggctgctagtgccgttgtgacttgaccggttttaagttgaccttgatcaatcaaggagcgggcttcaactgaagtcagcggatcggtaatttcttccaaatcacgatgttgattcttattaggaacttttaaggtttgttccgcacgatctttaaactgacgaatgcgcaagcctaggcctgcctttttgacggcgccagtcggtgtatcgtaataggtattcatttgactgaagcccggctcaaaatcaaactgattgagaatcgctagaaaatcagtctttgttaaagttgttttaaattcctgttcgcgagaaattgacatgaactgcctccaaagacaaagggcaacggtgacgagacaaaaatatgatagaatggtggtcgtgagtgacttggctggcaagaaagctacgggttgccgtacttcttaaccagtctggctggaatatagccgtcgtttgtcggccaagcctcacgcaacgtatcatcagtagtttagtatgggagggccagcaatgcaaagggactgggatagtttcttaatgccgtatgaacaagcagtcggggaattgaaaattaaatttcgcggtatgcgtaaacaatttcaacaggccaatgaacacacacccatcgaatttgtgacggggcgggttaaaccggtcagttcgattattgaaaaacaaagtcggcgttttatcagtgacgaacttttggaacaggatatgcaggacattgctggtctgcgaatcatgtgtcagtttgttgaagacatttatcaagtcgtggcactccttcgtcaacgcacagacatgaacatcgtggaagaacgcgattacgtgaccaacgtgaagccttctggttaccgcagttatcatgtggtgattgaatatccagtgcaactcatccatggtgaaaaaaagattttggcggaagtccagattcgaaccatgtccatgaacttctgggcaacgattgagcacagcctgaattacaaatataatggcgaatttccggatactttgaaggcgcggctcaagcgggcagcggaggcttcctttatgttggataaagagatgtcagatattcgtgaagaaattcaagaagcccagcatctgtttgtttatggtaaagggcaacagccacattcgaaaacaaaggatcaccatgacgataaaaaggatgagtaagatgcgtgtgacagttttccataatagcatacctgcctcaatcacggctgcgcaaaagctgacgaagcttttgaagagcggtcactttgagcttgatgagcggcatcccgaggtggtcgttaccatcggcggtgatggtacgctcctttcggcctttcatcgctatgcggatcagttaaactcaattcgcttcatcggtgtgcatacaggccatttgggtttttacacagactggcgggattttgaaattgaagatttagttatcgccttaaaagaagactctggacaaagcgttagctacccacttttggatgttcaggcgacttatgctgacgcgaccagtgctcattatctagcattgaatgagtcaaccttgaagcgtttaaacggtactatgcggacggaagtctatatcaaaggcgatttttttgagagcttccgcggggatggcttgtgtgtgtcgacgccaactggatccacagcttacagtaagtctaacggcggtgctgtgattcatccgcgattggatgcgttgcaaatgaccgaaattgcgtccattaataatcgggtttttcgtaccctcagttcgccgattatcacggcaccagacgagtgggtgacattggagccgacaggtcgcgatgattacgtcatgactgtggatcagttcgtcatcaatccaccaacaatcaaacaaattcggtataaaattgcgaaagaacggattcattttgcacgctaccggcatatgcatttttgggatcgtgttgaagacgcctttatcggagccaaacactgatgcgatttgaatggcagtatgagggaccgccgctgaaattggcggtttttttaaaacaacagggtttttcccgtgcacagcttaagaaacttcgttatcaaggcggatttgtttttgtcaacaaacggcaacggcataccgcttatccggtgcgctcgggggacagaattttggtacagacagcacctgagcacgcggcagacagtgtggtgccttattcgcatgatttggccatcagttacgaggatgacgattatctgatagtgaataaaccggccggggtggcatctattccagcggttgggcgccaaaataatagcatggcgaatatggtcaaggcttatttaattaaaaccaaggctgaaagtcaggccgttcatgtggtgacacggttggatcgcgacaccagcgggttgatggtctttgccaagcatgggttggcgcacagcttgttggatcagcaattgcacagtcaagactttgtcaaacagtatgtggcaattgtgaccgcacaaacacctttagcaactcatggttggatcgtattgcccattggcgtcagtgacggcttttatatgcgtcgtgttgtaaccgatactggcaaagcttctgtcacggagtatcgaacacttgaccaaaatacggctggggccatgatgcttgtcacgttgcataccgggcggactcatcaaattcgggttcattttgccgcgattggtcatgcgttgtatggtgatggcttatacagtcctgatacgcacggctttaatagacaagcacttcattgtgcccatttgcgtttctggcagccgttgaagcataaactgattgatttacatgctccacttccggctgatatggcaacgttagcggcgaagttgaaattatcgcagcaagattgagccgccgcacaaatttaaacaaggtatgacaaaagccagttcccgaaaattaggaactggcttttaacatactatgattcaggaacataattagcggctccaagcgaactagaagttgcccttgtgataacctgaatcggcatcaaacttgaattgctttttgaggccattggttaaatagatcttcttgtcattggtaatgaaaattgcttgaatatgatcgctgtttttggcattcatgtattgcagaccgccttttaatcccttatcaaaggcagcattggataaggcatcgccatcaacactatttttcgagacaatcgtgactgaggccaagttgttgtcatagggatagccagtctgaggatcgaaaagataaatgtatttatggccattggagattaggtattgctcataggtgccagctgtcacaatggattcgttgctttcaggaatcgtacccactgcagtgccacgcggcgcggtcgggtcttgaatcccaacatgccaatcgcgattggtaccaagcggtgagtgacccatgacaacgacattaccgccaagatcaataatcgctgctgtgacgccatctttggcgagcacggccttcactttgtcagcaacccagcccttggcaatcccgccaaaatcaagccgcatcccctttttggtcagataggcggtattatttttggtatcgagtttgacatcgcgccagttgaccagtggcaaggccttgtcgatctcactttgtgccgggacgcgcgcgccaggcaggccaatttgccacagattggtgacggctccaatggccatgtcgaaactgccattggagttttttgaaaagtagtaggctttttcaagtaagggcataaaatctttaggcactttgaccggcttgattccggcattatcgttgatcttatccaaaaccgaaccgccgcgggttaaagttgcctcggcgtcgacgtgatgaatcatggcaaatccgtcttttaaggcggattttttacctttatcataaattgtcaaagtacaagtggtgcccatgacaaattcattttgtgtgtatggggttttcaagtaagttggattggctgttttttgacagccggacaaagttagaaaaccaataaaagcaagtaaaccgatgacgaattttcgcatgttacataaccctcatttcatctttccctttgaatatcataccgcgcgttatggaaaaagaaagccctggttgtcgctcgtcaaacgtatggcagcaaaaaaggctagttatccaagcggttgcccgcataactagcctttccgtggcgtggttcattagaacgcgattagttttgtaccatgtaaagctttcgcacccaatgtctcaccgattgaagcagcgtttcgactggtgatcccgccgcctggcaagatgctgattttatcacctgcatagttgatgatggcttgcaggcgtggcaaagtgtcggtgatgggggtggtcaaaggaccgccgtgggtcaagatacgctcgacatcatgatcggccaaccaatcaattgcggcaaactgcttggtttctgggatggcatcgaaagccatatggaaaacaacggtcatgccagcactggcagcaatgaggctggtcatcgcgtcttcatcaattgcgccatctggtgtcaaagcaccaaaggcaacgccatccacaccaagcgcctgtgcctcaaaaagatcagcttccatgatttttaattcaacatcgttataaacaaagttaccgccacgtggacgaatcatggtgatgaggctacggccatgttcatgaacatattttgtgctctctgccataacgcccttagacacagttgtgccaccaaccgctaaattgtcattgagctcaatccgatcagccccggccgcgattgctttaggaatcgatgtataattttcaactgcaatttcttttaacatgacggacctccatttactagcttagataaacatgaccaataagacaatcgcacctaaagcgattcggtaccagccaaacggtttgaagtcatgcgtttgaacaaatttcaacagccacttgatggcaacgatggcgacgaggaaagaaacaatggaacctgtcatcaaaacagcccattgttcaccagagaagccgttgccttgccacaggtatttgccgattttaagaatcgacacgccaaccatggtcggtattgccagaaagaaggaaaattcggtggcaacgtagcgagaagtcccgattagtaaggcgcctagaattgtggcgccagatcgtgatgtaccagggacgatagacaagacttggaaaagaccaatcagtaaggcggtttgataagtgatgtctgccagagtggtgatatgcgcgtttttattcttgaggtagttttctagaatgatgaacagcaccccataaatgatcagggttgttgcgactacgagtggtgtatgtaaatgttcatccatccagttgttaagcgggaggccaacgacgactgacggcagaactgcaatgataacttttgcccacagttgccaagttgcgttgcgggctttggctgtcggcttggaaaagggattcagcttattgaaataaagcaatatgacggcgagaatagcgccaaactgaatcacgtactcgaacatattaatgaaatcctgactctgcgataatttaatgacatggtttaccagatcaatatggccggttgaactaatcggcagaaactccgttaacccttcaacgataccgatgatcacggccttgataatgtcaaacataataaccctccaattctcaatgttaacagtatacaaggttttgcaaggcttgccacgttcaactcggaatttatagtcatcttacgtaattcagcaacttttttgggaggtaaaaaaagcccaaccaccaagcaaaacaggtcttggggctgagccaataaaaagttgtatcgatggttaaacataagacagacggtttaacttacttagccgataaaaataaaacgttaacggcttctggcgtcggaatatcacgttgaatttcggtcaagagtcccgttttggcatcgcgactatagagtgtgccattactagtgttttggttgaccacgagaataaagtgttcagtgagatcgaaattgaaatcacgaggaaaatcgcctgccgtactgatttgttgcaattctgacagatttcggccatccggactgacggcaaaaacggtgatactattatgaccgcggttggatacataaaggaagcgttgatcactgctcagtcgaatcgcagcagcaccattgtgatcggtgtaatcttctggaatggtcggcaatgttgcaatgagtttgaattgaccagttgccgcatcataatttaggatgctaacctgacttgaaagctcacctagtaaataggcaatcgggttgttgtggttaaaagccaaatggcgagggccaaagccaggttcggtgtgaaaaataaccggatcgctgagtttgccggcatcgctgacagcataggttgttaaggtatcattacccagatcaacgaccgctagtcgctgaaagtcaggggtgacagcagcaaaatgaacatgggcactatcttgttccggtcgcggaccgttaccggtatgcttcacttcatccgttaaagccaaaccatgatcatttttaatgcgatagacattgattcggccttcgtggtaattgctggcataaaccagctgacgattcgcatcaatcgagatatgcgccggggatgaacctgcctgcagtatcttgttgatcaagcgcggtggatcaacatttaggtcataagccgcgacaccgccttgatcaccttctgcgtctaccgcatataaaatattgtcatcagatacggctaagtaggtcggtgaacccaaatcagtaatgaatggggcaggggtcggcaaatgcgcttcgtcattatcaaatgtaccggcataaacgcctgcaccgccgtgacgcgtataaccgcctaacaagagtctttgcttcatgttcaagttgctcctttcgaatttgatttgagtatagcatgtttggctgatgcttatgctatgatataaagcgtgagtcaacgtttaatgaaaatagctggccaataaggctatcattaaaggaattttcagacctttaatcgaacgatttgccacagcccataactcagcgccatcatgggccttaacgagatcgcatttatgttggcagcgaagctcagataacaaacacttatgatattaaaaatgacaggcaaacggaggcacgaccatgcaattgacagcaacagtaacagctattggtaaggatgcattgagttccaaggatccgatgattattctctttggaccgcaagcaacagacgcactacgcgacgtcgcggtgatccagcagttcgctgacaagtcagctttggaaaaactggttatcaaggcgggcgaccaattaacaatcgatgatgagacgtttgagatgacttatgtcggtcaacttgctaacagtaacctgaaggcaatcgggcacgttaccctgttgttccaagctgtaccagcagacaagccgatgcaaaacgcgatttatttaaaaccgacccatcgaccaacatttaaggttgggacgacactaacttacatcacgcaagccaattaagtgtgacaacgagttcttggatcagttatgcgccagtttctaaccgcttctgcttacggtcaacaaaaaaaagaagatttcaggcgatctatcagcctgaaatcttctttttttaccatgatgccttacgaacacctggaatttgacccttatgcgctagatcacggaaattcaaacgagacattttgaatttgcgcatgtacgcatgcggccgaccatcaagttcatcgcgactgtgcgcgcgaacgggtgaggcattccgcggtaaagcttgcaaggcagcgtaattatgctcagccttgtacttggcacgcaacggggcatatttggcaatcgttgcttcgatcttcttttccttggcaatctttgactttttagccatgtatgcaatcactccttatttgtggtttgtatttaacgttttttaacgacgtgtctgttcgaacagttcaacccacatagcatagcacagccttaagccgctcgcaacacttacaaaaaataagcgtttaatattgatcgccattgaaaatcgaatttttaacaatgacataatcgaccttggtcaaggactcgagatcgcggccaccggcgtaggagacagctgactgcaagtcttcttgcatttcctttaacgtgtcaccaatcttgcctttgacaggtaacaagatttttttgccttcaacgttgtggtgggtgcccttttgatactcggacgctgaaccgtaatattcctgatattccttgccgtcaatgttgacgtgtttgccaggtgtttcttcatggccagcaaaaagggaaccaatcatgcacatggtggcgccaaaacggattgacttggcgatgtcaccattattgcgaatgccgccatcagcaatgatgggtttacgggctgctttggcgcaccaacgaacagcagctaattgccagccgcccgtaccaaaaccggtttttaatttggtgatgcagaccttgccaggaccgatgccgactttggtagcatcggcaccagcgttttcaagttcccggacagcttctggggtgccgacattaccagcaatcacaaaggcatttggcaaataatgtttgatatgttgaatcatgtcaatgaccacctgagcataaccgtgcgcaatatcaatggtgatatagtcaggagtcagctcattagcagccagtgcttcgataaaatcgaactcgtcatccttgacgccgacactgattgaagcgattaagccgcgctttttcatatcgcgaacaaaatccatccggcgttccggctggaagcgatgcataatatagaagtaatcgtgctctgccaaccagatcgccaaaggttcatcgatgatggtttgcatattagcgggaacgactggaatcttgaaagtatgcgggccaaatttcacgctggtatcaacctctttacgtgattgcaccacacacttgttaggaatcatttgaatgtcttcgtaatcaaaaatctgcatgccgttgttcatcggattcatcctttcgcaaaagccgaacattgttaagcattattggtgttattcaaaacaccaagtgctaagatacgcgaaagttttgtaaaagtcaatcaaaagtacatacattcttttttaatgttcgtgttttgataaatgaaaagaaaagccggttgcccggcttagaaaaacgacagtggtaattgatgcggcaaacgaggatgtaacacgtcacagaaggctcagaaaaacttgttgcgccaaaattgaaaggcaagtactaccgcaatggcaacggaaatggcaatggtgataatccagctcaccttcatatcagccaaagggagatgaacattcatcccgtaaaacgagaagaccaaagtgggaatggttaacaaaattgaataagaagttaggaacttcatgacgccgttcatgttattgttaataattgacgagtaggtgtccgccgtttcgttaataatagaattgctaatttgtgccatttcgatggcttgttgattttcgatgatggtgtcttccagaaagtcttggtcgtcttcatccaaaccaagaggattgctgcgttttaattgttcgaggacgttgcggtcggtccgcaaactcatcataaaataaaccagtgaccgttgaatgcccatcaagccgtagagttcttcgttgcggaggctgcgttgcagtttattttcattggcttcgcgtgccttgtttagatcacgtaggtaggttaggtaactgattgaaatctggtaaaggaactgcagcacggaccgattttgtcggcgagggtcgaagttactgactttaccttctgcaaaaagactgaggagtggaatcggctcgccgttgatggtgatcaccgcagtattagtgatgatgatcgctagcggagccgtttcgtacaccacctttttacgtgcgtcccgtgtgacgatgggcatgtcgaaaataaacagatggctatcattatcttcgtcgtattcgtaacgggcaccttcatcgggatcaaggccgtacaaaaggaaagcttctgagagcttagctttgtcctgtagttgctgacgttctgcaggagtaggatcaaccacattgatccagacccctggactgatgcgggattgctggttcagttgaccggttttgtcatcaaatcgataaattgcaagcatagcgggctccttggctttttcttttagtttacaacaagcaacagcaggatgcaggagggaaacacatgcgtaagcgtgaaacaaaaattcatttggcagcagcacaagcaccgctttttgcttgtccagtctgtggacaaccattacaggtgacagcgggatcgttggtttgtgtcaacggacatgtacgcgatttcagccacaaagggacgctgaacttcctgaatcagcaagtagccaccgaatacacgacgccgatgttagccgcacgacggcgaatgttgaacgctggtttgttcaccccatttttggcagctatggcagccaaacttccgaaacatcaacgactgttagatgtcggctgcggggaaggcacgccgactgcgtatttggccgaggcgggtcaacaaactgccgtgggttttgatatctcatcaccggcgatcaatctagcaggcggcttagcggcaccagttctgtttgcggttgcggatctggcccacctgcctttcgttaacgatgcatttgataccgtgaccgacatcttttcgccaggtaattatcgtgaattcagacgtgtgctgcgtcctgatggtcagctattgaaaattattccgcgggcgggttatcttcgagaaatccgggaaggcttatactccgggacggctaaggctgtgtataacaatgagcctgtcttgaaaaggttcttagcagctttccctgatgcgagtcaggagacaatcacctacgattttccgttagcgccaactcaatttggcgatttaatggccatgaccccgttaacgtggcaggcgcccgccgatcaactcgaccaaatgcttgctgcaccgccgattagtatccatattgatgttgatttgctcactgtgtcgcatcttgtcaagtaaaagggttgtaaacatcgatggctggtgttaatattcctttaagctatttatttttaacttttatcagggctagcttttgggtaattgataaaagtttgcgataaattacttcactaacgtatcgcttcgctgagtgcgctccgaagcaatgcgtttttttcttgcttatttttacaaattgacctgtccacaaggcctgttcgtgcaagttaaatgtgctaaacttaaaccacttgcgttgaagggaagataacatggcgaatcatattgttttatttgaaccgctgattccggcaaataccgggaacattgccagaacctgtgcagcaacgaatagctatttgcatctcatcaagccactgggatttgagacagatgataagcatctgcgtcgtgcaggtctggattattggcaacgcgtccggatcatctatcatgatagtctggatgacttcatggcaaccgttaaggaaccccaacacctttaccttattactaagtttgctgatcagacatactcagaccgagattatgccgacattgatcaggatcattatttcctttttggcaaagagacgacgggactaccggaaggcttcatgcgcgatcatgccgatcagtgcttacgtattcccatgactgacaacgtccgcgcgttgaacttgtcaaattgcgcagcattggtcatttatgaagctttacgccagcagcattttgcaggacttgaaacatcacatacgtacgagcacgacaaattaaagtaacccaacaatagaagtgtgcgagctggctcgagtagaaactggcatgtgaatggctttgaccgttatggaaaaggacgcttacaagaaggtttctcggttggcaagcgcgtttaggaggctgtatttatggaaacaaaacgttaccctatcgcggttgaatcttttcactatgatttggttaagcaaggaacaccggttaagaacgacttgcaagttgccatgcgccagattgaatggtcagatcccgctaaacaagatgagttgaaaaaaggcaatctttttcagatgatgattccatttgacgttgtccctgacgatgccggttttgagatttctggcaaaattacccagattgtgcaggttttggattattttggtgaggcaaatgaattgccgcaagccgaacttggcaaactaagccggccattggttgaaaccattgaaacgttgacttaccaagtgaccgcagttgccttggatcaaggggttaaccttcagtttggtgccagtgatgaacaaccgggccaaacaaaataagacaaagttgagtcatgatgaaaggcggccgttatcagccgcttttttgatgagcgcgaatgcattctgacgacaggcgttgtcttttagctcaatgatcgctgaatcatcatggctttttatttgcgagttcagctcgtgtataataggcgggtatgaaaggagcatcacgatggcacagaaacgcagcggacgcaaaagcccgcgcagaaaacgacctaccaaacaacaacagcacacccttagttgggtcggtgcgttatttgtggtgttcgccagcttggcatttttccggttaggcattgtcggaaccgtgtttgctaatgttttccgattggttgttggtgatagctttctagttgtcagtgcagggatgatcctgatggggatttggtttctcttcgcagatcgattgccgaaattggcacggcatgtgtgggttggcctcgcaattatcttaatttgtgccttggtactgttaagcgcaggcaccatgaccacattgaatgtgcacagtcattatttgttggcgacctggcgcctacttcaaaatgatttcggcttaatgacgacggcctctagtgttggcgggggattgatcggggcgggtttgtatgcgttacttgcccctttactaagcagcatcggtgcaacgattcttgcatggctaggcatcgttgttggcacattagcttttctaggtgtgggtgcgaatcaggtttttaattggttgcagcggtgtgggcaagcttgtaaacatggcgtgatgcaggtacaagcagccgtggcggctatgaaaaaagaacgcgtgcaaaaagcggctgcccagcagaaaaaaaccgtttctgcgaagccacagacaactacgccggttaccgaaaacgaagcacccagtgaaacacctgatcaccaggatgatttcacgattaacgggccggcaccggttcacgaatcgacgcaaccggttcccttgccacgcacagaacctaagccgcagtcagctacgactgcgccacaacctgagactagtgaagcggcatctggacttgatgcagacgatccttccacgaattatcagttgcctgatcttgacatgctgacaacgattccgccagttgatcaaagtgctgaatacaaggcgatcaaaacaaatcgggttaaactaaaagaaacctttgaaagttttggggttcatgttgcggttaaaagtgccacacttggaccatcgattacccaatacgagattcagccagcggtcggcgttaaggtttcaaagattgtcaatctttcggacgatctggccttagctttggcagcaaaggatatccgaatcgaagcaccgattcctggtaaatcattgattgggattgaagtgccaaatcaacacattgcaacggtcggcttcaaacaagtcatggcagaaacgccgaagtcgcctgatcgcccattagtcttaccattgggtcgcgatgtgaacggcaaagtcgtgacttttgatttgacaaaaatgccgcacttgctgattgccggcgccaccggttctggtaaatcagtcatgatcaacgtcattttaactagcattttaatgcgaacgaagccaagtgatgttcgcttaatgttgatagatcctaaacgggttgaattgtcggtatacaacggcgtgccgcatctattaacgccggttgtgacagaagctaaacgggcgccaagtgcgctgaacaagattttaacggccatggatgagcggtatcaacgttttgctgcggctggcgtgcggaatatgaccgaatttaatcaaaaggtggcggctgatccgacaagcggccaacaaaagatgccgtatattgtcgtgatcatagatgagttgagtgatttgatgatggtggcaggtaacgaaattgaaactgccatcgtccgcttggctcaaatggcacgagcggctggtattcacgtcatcattgcgacacaacggccgtctgtggatgtcatcactgggctaatgaaagcgaatattccctcgcggattgcttttgcaacgtctagtggcatcgattcacgaactattttagacagtaacggtgccgaaaaacttctaggtcgcggcgacatgctcttttcaccaattggggcatctaaaccgatgcgaattcaaggcgccttcataccatctgtggacgttgagcgagttgttaaggcaattactgaccaagtttcacctgcatatgtggagagcatgacgccaacggaaaatacggaggctgagaaacccggtgattcagaggatgagctatatgatgatgcgaaggcgtttgtcatttcacagcagagtgcctcgacgtcaatgctgcaaagacgcttccgaattggttacaatcgagcggcgcgcttgattgatgatcttgaagccaatcaaattgttgggccaagtgaaggcagcaaaccgcgcaaagtctttgtgacgccagaacaagtaacgaatggtacgccatcataaggagttttatgcgaaaagaaatgaaaccgggtgtttggttgattgtcttgccgacaacgcaatttaaaaccacccgcatcaatgtgcaatttttagcaccgttgcaacgggcaacagtgactaaacgaacattattaacaagcctgttagaaacgaatagcgctgtctatccgacgcaagcagctttgtcagcgcatctcgagtcgctctatggcgctaatttcagtattggcatggcccgtgaaggcaagttgcatcgaattggcgtgacgatgagtaccgtggatgatcggtttaccgatacgcctttattgcctcaagcagcggccttcttacgcaccatcttgtttgaacccaacatgcaggcgggtcgttttgacgaagccacttttgcgcgggaaaaggagaatttggatcattatttagccagtctagatgatgatcgccaaacccaagcggcgctgggagtgcagcaactatattttggagccgatcaggatcaggctattccgagttttgggacgcgggaagatcttgcatcgctgacggcgtccagtttggctgcttactatcaagaaatgatgcagcatgatcaggtcgtcatcacggtgttaggggatgttgatcctaagcaagtggcagcattatttgctgattggccacttgatgctcggtcacaaaccgtaccagcagtggcgtttgatttgccgacgcatccagatgtgctgacccaaacaaccaaggtgaaggcgcaacaggccaagtttgatttggcttatcatgttgaaactgatttgatgggacccaaatatgcagcaacattagtggcagaggaattatttggcggctcgagcttgtcacttctattcaccaatgtccgcgagaaggctagtttggcttattatgcgagctccatgttcgatgattttcgcggcttgatgctggttcaaaccgggattgaaggaaaagatcgtcagcaagttgctgatcttattcgtgatcagttggcggcagtggtcaatggcgatttttctgacgccctattgaaggccgtgaaggacggcattttggatcatcagcgtgccgcctatgacagcccacggtttttgacaaatcaggcgttgtatcagttgttagtaccagatgcgccacagaattttgatgagtttgctcagcggattaaggcggttgatcgccaagcggttcaacaggccgccgcagatatgaaattgcaggccacctatttcttgactggggaggatagcgaatgaagacacagtattttagtgatgtcgatgaaacggtgatcacgaccacgctatcgaacgggctgcgattgcaagttgtgcctcgccccgcgtatcacaaaagctatgcgatcatgacaaccgattatggttcgattgatacgcaatttgcaccaaatggcaaacagatggtgacttatccggccggaattgcccactttcttgagcacaagctatttgaaaaggaagatcatgatgcctttgatctttttggtgaaactggggcatcagcaaatgcattcacgagtgcgaccaaaacgagttttttattctctacaacaacgcagctgacgaagaacttacagattttactggattttgtgcaaacgccatttttttctaaggcatcagttgctaaggagcaaggcattatcgggtcagaaattcaaatgtatcaggatgatccagggtggcgcggttatgccggtttgttagaaaacctttttccaaaccatccggcgcatgttgatgtggctggcacagtggcaagtattgcccaaatcacgccggaaatgttgtatacgattcatcgggttttctatcaaccaagcaacatgacattgattgttgtgggaaatattgacgctgatgccattatggcttttgttgcggctaatcaagcagccaaacagtttccggcgccacaggcgattgtgcgtggcgttcacgcggatttgcagacggatgatatcgtgccatatcgccagttggagatgccaattagtcgcccaaagacgctggtcggcatcaaagggcaggttgcgattcctacaacggctgagggctggcggtaccaattaaccattcggctcttgttagaagttctgtttggcgattcttcccagttatatcaagattggtatgaccgaggattgattgatgactcatttgattttgattttacgaaccagcgcagctttagttatggcttggtcggtggtgataccgatgatccgcacgcattaagtgatgcgatcaaacatgtgttgctaaacgcagcgacacagccggatttgacccgcgaccgggttgctctaattaagcgggcgtcactgggtaaatactacgctggccttaacggactgaatggtgtggccaatcagctaagtgcgttgagttttggccaggcgagtttgtttgatttccccgagattttgagcagcatcacgctagcggatttacaagctatgattgatcaggtttttcaggcgaaagcattgaccgttttagatatgattccggaggcagattgatgcgagcagctttgattgttggtgcgtcgggtgacattggccaagcggtggctaaaaagttggcccacgatggctggtcattgtacctgcactattttgaacacgaacaagtggttaccagccaaattgcgacttttcaagcggcgtatccgaatcaggattttattccgttacagtatgatttaactgatgatcgtcatttggatgatttgacggcccagctttttagcttggacgcggtcatttttgcggcagggatgacgtattatcatttatttaaagatacaaccgtttctgaattaacaactttgatgcgcgtgcatctattgacgccgatggctcttttaacgaagatcgagcacaaattagcacagtccggtcatggccgcgttgtctttatcgggtctgtctatggtggcgcaggttcagcgatggaagtggcctatagtactgtcaaaggcgcgcaaagtgcctttgcaaaagcctatgctcaggaagtggccagtctgggcatcacggtcaatgtggtcgcgccaggtgcagtgacaacaaaaatgaacactaaaatgtttgatcaagcgaccttgaccaaggttcgagaggaaattcctgctgcacgatttgcgaccccacaagatattagttactatgtgactatgctagttgcaaaagatgctgcttatctaacaggacaaactttatatgttacaggtggctggcgaatctaggaaacaaaggatttcttaaggcttgcagttggtttttcatgatatactgaaaatggtcaataaaaaatagcgggtgaataaaacttatggatgaaattgggcaaaaattacgggacgcccggattcaaaaaggctatacgattgatgatcttcaacagatcaccaagattcaaaaacgctacctgatcgcgatcgaagaaggtaattttgatgcgctgccaggcgacttttatgtgcgtgcctttattaaacaatatgctgacactgtcggccttgatggggatgcgttgctgacgcaattccagcaggacatcccggaacctcaaccccaagagtatgcagcacaatcagttgaaaataagactcgggcaacccgcgccgaagaagcgagtccggttaaccgtttgcggcgttatttaccgcaaattgcgattgctgcaattgttgtcgtggcagtcattgtgatctatgtcatcatgttggtttaccaatcaggacccaagcaaacgatcccgacagattcagaaagtgttgcggtctcatcgaagcgtagtacatccaagacttcgaaatcgtcgacatcttcgaaaacaagcaagacatcagcggcttctagttcttcgaagactgcggagaagtcgtccaagaagagtactaaaaagagttcgaaattggacatttctgtagcggatgccaatggtgctactcaggcagttactttaaagaatctgccgaagacgggtaacaagttaacgcttggtgcaaccggcgccactgcttggatttcagtaattgtgaacggctcaacgacgtggcaaggttcattgacatcaggtaattcgcaagaagtgacattgccagacaacgtcacgacattccaagtgcggtcaggcaatgcaactgcgaccaccatcaagctcaatggtcagagtgttgatatctcaaagggaaccagcatcgtacggaccatcaccttcacggctgatgcaacagaaagcgagggttcgcaagaatgaatcttccgaataaattaacgctcatccgaatttttctgattcctgttttcacgatcctgctggcacttgattggccggctgggtatctgacacttgcaggaactaaggtcgccttgagctggtttatcgcgctgattatttttattgtggcctctttaaccgactttgctgacggtcaaattgcccgacgcaagcatttggtcactaatttcggtaaatttgccgatccactggctgacaaactgctggttatgactgccttcatctttctgacggccaatggtcagattccagcatggggaaccgcgattatcctgtggcgtgaattagccgtaaccggattacgcttattgctttcaaacgaaggtgaagtcttagcagcggcttggccgggaaaaatcaaaacaaacgcgcaaatgtttgccattattttcttgatgctaaacaacgcatggtttaacaatatcaatgtgccgtttgcactgatcctgttctatgtcgccgttttcttcacgatttactcaggtgtcgaatacttctacaaaaaccgtggtgtgttcaaggactcattcggttcaagtcatcaataataagttattccaatacccaggcaggtgcttgggtatttttgtagagcgcgagcaggagcgattagaaaccggagtgtaagtggccttgaacgtaggtttctgcgactgcgagcgcgtttgcgagcgcagcgtgaagtcgccactaacctaagctgggtggggaacccccaccagcaaatacggagatccctatgtgcaagcttttggaccagcaggcccggttgcgagcaaagcatgaatcagccaacaaaaaatgggagtgtcaagaatcttgtgtaaatgaaatgccttcgtacatataatatgtatctaacttaaataaatgatgcttccaaggtgacaacggcttcggcatttcctcaatcataagggaatccgaagccgttttaaatgtacctcacaatcgtgcgcttacgattaagcctccagtcaaccgcggtcaacgccagcactggaccttcactagcatacgatgagtgaccaagctttttcatcgccaaaacatgacgactgttatatgatagatgttcacgaaaagacagagcgtgagctggtgtgttcagaaatctgagcataagcggcctaggtcatgacactcaaggtgcttatgggcaggtatttgcaccagtgaacacgtttaaggaggagccacctatgaaacgatccaccacatggcgcatgttggcgtttttctggcgtcaacttgcggatatgaagcgtcaattgattcgaattatagtggcgctagtgggcgttgccggtgcacaatatgcgattccacgcctgtcacagtatgtcattgaccgcgtgattccgagccgggctgtctcaacactggtgctcacaatttttctggctttaggcctgactgctttggctggcttgctgaatgcgctcagcacatattggattggacaggttagtttaagcgcgatcgcccgtatgcgtgacgctttatttcggcatacgttgggacttgacatgcattatttcgagacaagtaaaaccggggacttaatggttgttttaaccagtgatgtcaacaccttgcagcgtttaatctcaagcaataccttgggcctgttcggaagtatgctgagcttttttgtcgtgctggtgttgatgctgattcaaaactggcagctcacagcgctgattttgctcacgtttcctgttttgttcgttttgaataatatttttgtgcgccgaattcgcgctgcttatcggcgggtgcggaccagttcgggtgtgatgaataaccaaattcaacaagctttgacgagcattgggcttatcaagagtttcacaactgaaaaagcaaccgcgaatacctttgaaaacgttaatgagcagaaccgcgataatcaactgacagcaacacgtcttggagcaactttttcgccgatcactgatttcgttaactatcttggtacggcgatcattttaggatttggtgcatttcaggtaatgcatgggcaattcacagtcgggctaattgtcgcctatacagcttatctgggtattcttcaagcaccgattcgccaagtgaccggcttgattcaacaattgcagcaagcaacggtttcttttgagcggattgaaacactgcaggcggcggtgccgcgggtggtatctccgccaaatgcgatcaagttagcgcgttttcatgaccgcattcaattcgatcgcgtcggctttagctatgatccgtcagtacctgtgcttaagaatattgatttttcacttgctaaagaacaggtgattgcattggtcggatcttcaggtgcagggaagacgaccattacgaacttgctggatcgattttatgatccgacagaagggaaaattacgcttgatggggtcgatcttcgccaagctgacttagagagcttgcggcaacagattgcgattgtttcgcaagatgtgattctattagatggtacgatcaaggagaatcttgaatacggtacaccaaatgctagtgaagcggctatttggcagtccgccgaagccgccaacattgcaacgtttattcgcgacttgcctgatggtcttgccactcaagttggtgaacgggggattcgtttatcaggcggtcaaaagcagcgaattgccattgctagagtctttttgaaaaatgcgccaattgttattttggatgaagccacggctgccctagacaatgagtcagagcgatttgtgcaggctagttttgatcggttgatggcggatcgtacgtcattagtgatcgcccaccgtctgtcaaccgtccggcatgcggacaatattctcgtactggaacatggcgagattgtcgaatctggtacgcatgaccaactgatggcgcaaaacggtcgttataaagaactttatgatttgcaatttacttgataattgcagttagctggaaagcttaaaaatcggaatatatcgcttcaaagctctcagggcgggggaatgtgaaaaaaagccacgctgatgtcgccttttttggccacaacatttacattcaagtgggtttcgggtatcatacattaagtatgcaatgtgaaattgcgagactaattgtcggaggtacagcatgtctgcaaaatgggaaaaaaagggcaccaatgatggtgagctcacctttgaaatcgatttaccacaaattcaacaaggtttagaccaagcgtttcaacgtgttcgcaagaacttgacggttcctgggttccgtaaaggcaaagttagccgcaccgtgttcaaacggatgtatggcgacgctgcactttatgaagatgctttgaacatcttgctgccagacgcttatgaagcagccgttaaggaatccggtattgatccggttgaccagccgcaaatcaacgttgattctatggacgaaggcaaaccttgggtcatcaaggcaaccgttacggttaagccagaagtcacacttggccagtataagggtcttgaagtgccaaagcagaacgttgaagtttctgcaaaggatattgacgctgaattggaaaagcgtcgcgaacagcaggctgaactcgttgttaaagacgacaaagcagctgaaaatggcgataccgttgtgatcgactatgtcgggacaattgacgggacggaatttgacggcggctcttccaagaactatagcttggaattagggtcaaactcattcattcctggctttgaagaacaacttgttggtcacaaatctggtgatgaagtgaccgttaatgtcaccttcccagaagactacaaggcagctgatttagctggtaaagcagccgaattcaagaccacgatccatgaagtcaaagttaaggaattgcctgcattggatgacgactttgcgaaggatcttgatgatgatgttgatacccttgatgaattgaaagcaaaaatcaagaaggaattgaccgatcagcgtgaggaagctgcaaagaatgccgttcaggaagctgccatcaaggaagctactgacaatgcgacgatcaaagaagtgccaaatgcgatgatcgagcaagaagtgcataatcagatggatcaatatcttggcaacatgcaacgccaagggatctcaccaaaaatgtactatcaattaactggtacatcagaggatgatttgcacaagcagtttgaggctgatgcagctacgcgtgttcggacaaacttagtccttgaagccatcgtgaaggccgaagatattcagccaaccgaagaccaagtgaacgaagaagtcaaaaacttggcttctgaatacaacatggacgaaaaggccgttcgtaaggctttgagtgaagatatgctcaaacatgatattggtgtcaaacaagccattgatatcatcacggacagtgcaaaagaagtcgaatcagctaaagatgatgctgacaaagaagcttctgacgccagggctgacaaatagtttgccgtttccacgtaaaagagacgatccccgatcgtctcttttgttgtatgaacgcgtttttagcgtatacttgacgttattcttttagcagaaagaaaggcaagttatttgacaaaacggtgggtgtgcttccgctagtcggcacttgacgcttctgttagaatgaaggtatcaagaaagggttgaatcagatgtttgacaacgtcgaaacgacgggtccagttacttgttctttttgtggcaagtcacaggatcaagtgaagaaaatcgttgctggccctggggtttatatttgtaatgaatgcattgacctctgcaaagagatcattgatgaagaatttaaagaagaagcctatcagaatctgcttgaagtgcctaagccagtcgagatcatgaagacgctcaatgagtatgtcattggtcaagatgccgcgaagaaagctttgtcggttgcggtttataatcattataagcgagttaaccaaatgcagactgcaacgaaagatgacaccgaactgcagaaaagtaatattgcgttgatcgggccgaccggttccggtaagactttccttgcccagacattggccaaaattttgaacgtgccatttgcaattgccgatgccaccacactgaccgaggctggttatgtgggggaagatgttgaaaacatcttgcttaaattgcttcaaaatgcagactatgatgttgagcgtgctgaaaaagggatcgtctatattgacgaaatcgataagatcgctaagaaggcagaaaatgtttccattacccgtgatgtttcgggtgaaggggttcagcaagccttattgaagatcttagaaggcacgattgccaacgtaccgccgcagggtggccgaaagcatccgcagcaagagttcatccagatcgataccactaacattctctttattgttggcggtgcttttgatggtatcggaaatatcgtcaagaaccggattggtgaaaagacgatcgggtttggaacggattcaaacgagcaagttgatccggataagtcactgatgcagcaaattattccagaagatttgatgcaatttgggattattcctgaattcattggccgtattccgattttagccgcgcttgagaagctgaatgaagacgatctggtacggattttgaccgaaccgaagaacgccttggtcaagcagtatcaaaagctgctgagcttggatgataccgacttggaattcaccccgaatgctttaaaggcgattgcccatcaggcaattgtgcgcgacactggcgcccgtggtttgcggtccattatggaagccatcatgcaggataccatgtttgacttaccaagccgcagcgatgttgacaaagttgtcgtgaccaagtcagctgttgaaggtaaggctaagccacaactggtcttaaccaagggccgtgaagcttcttaaaacgcaactgtcatgaaagcatcaagcgaaaagcttggtgctttttttgactattgaaaaattcttttgaggttagccacggccgtgtttgcggataaggtgtcacccgaatcacgaccggtttctccggcgaggctgcgtaaaatatgctaaactatttgaagcggtgttgtgtttagacatcacgttgaggtaaagccaagaggaggccgtttgagatggacgtgcatgacgtcaaattaactattagtgcggttgcggccgctcagtatcccgaggacggtcatccagagatcgcttttttgggccgcagtaatgtcggcaagtcatcactgatcaataaactgattcagcgcaaagccatggcacgcacttctggtgtgccaggtaaaacgcagacattgaatttctatgatcttgatagtcgactcttttttgttgatgtacccggatatggatatgctaaggtcagcaaaaccgcacgagcgaagttcgccgccatgattgagacttatctgacgacgcggcaaccattgcgcggtgttgttttgctggtcgacagtcggcatgagcctactgctgatgacatcagtatgtatcagtatttaaaatattatcagctcagaacactggtagtggccaccaaaattgataagacgccaaaaagtaaacggctgcatgtggccaagcagatcaaacagcgacttgatttgaatcagaccgacgatgtgattctattttcggcaacaactggtgaaggttatgaggctgtctggtcttggcttgaacaaacggctggcttggagggaagataaagcatgaatttcaatgactatcagcaaaaagcaaatcgcaccttagctggcaatgaacacgttttgactaacctgtcattagggttggcaagtgaaagcggcgaagcgatcgatttaatcaagaaatatacatttcagggacaggatcttgataaagtcaagctgcaacatgagctaggcgatgtgttgtggtatttatcacagattgctttgtgggcagacattgattttgatgatgttgcaacgagtaaccttcaggaattggcgaaacgctacccacaagccaaaaaataatcggtttctaggtatgaaaaaagcgaagtgcgtgggcacttcgctatttctttgcttctttttctgttttttctttggctttcttggccaatttgtcgtggtgttttggatctggcccggttgcgttctccttatcaccaggcagactggcaaacttatcgaacatgtcattcaggttggtttgtgtgttgattttcagtgccatgcacgccacccctttccttgctgaaagtatagcatcaacactggggcgcgtctaggtaagtcgcccgaacaaaaaaatttggaaaaatatgaatgcatattgcataaaaatcaatttgagtgtatagtacactcttgtaatcaaggagggtattatgaagcatttgagacgctggttgatcgctttagtcgctgtttttgcggctgttgtgacattgaatatgcaaacggtccatgctgatgacagcttggccaaggttcaacaaaaaggtacgttggtgatgggcacgagccctgattatgcgccgtatgaatttttagtcaacaagaatggcaagaatcaagttgttggcatggatgttgaagttgcgcgtaagattgccaaggatctgggtgtaaagctggtcattaaacagatgaactttaactcacttctggtcgccttgcagacgggtaaggtcgacatggtgttggcggcgatgtcaccgacgaatgcccgacggaagtcagttgacttttcaaatacgtactacaagtctggacaagacattttggtcaacaaaacggatgctaagatctacaaagaccataaaagttttgcgaacaagaaagtcggcgtccagaatggcagcttgcaagagacgttagcgaaaacacagatgaagacgagttccacattgggcttgactaaggtcaccgacctgattttggcgttgaagacacataaggtagctggtgttgtcgctgaaggtgcggtagcgaaggcttacacgtcaaatgatgattcgttagttgagattcccggtcacttcaacttatcaagcgacacagtcggtaccgcgataggatttgctaagaactctgattcattagtggcagccgccaacaagagcttggcagagattaagcaaaaaggtttaattaaccagtatctcaaaactgctggcagttacatgaaaaccaatactgaagataccagtatgatccattactggacctacttcctaaaaggggtcgagtatacgctgttgattagtgctatcggtgctttcttcggggttctactcggcacgatcttcgccttgctgcggttgagcaagaataaactgtcacatttaataggtgtgtcatacattgagttcgttcgtggcactccgctgatgattcaagtcatgtttgtctatttcggcatagggatcttcattgatattcctgcgctaatagcagggttgattgctgtttccttgaactcggcggcgtatgtggctgaaattatccgtagcgggatcgatagcattccagtggggcaaacagaagctgcccgttcgctcggtctgtcagagcggcagacgatgataagcgttgttttaccacaagcaatcaagaatatttggccagcgcttggtaacgaatttatctccttgattaaggaaagctcgattgtttccattatcggggttaccgatctgatttatcagttaacggttgtccaaaccgcgacatacaagggagttcaaccaatccttgtcgcgatggtcctctactttgttctgacattcgggctgtccaagctcttgagtcattttgaaaggaagatgaatcatgcagcataaacctttaatccaaatcaatcacctcaccaaaaagtttggcgacaatgttgttttgaacgatatcaccgaaaccattgacaaaggcgatgtgatcgttgttatcggtgcttccggtggtgggaaaagtaccttcctgcgtagcctgaatttactgaatcgaccaacaaaaggggaaatcctttttgaaggtactgatttagttggtttgagcgagaaagagctggataatgtccgagaaaaaatgggaatggtgttccaaagttttaatttgttccccaatatgacagttttggaaaacattaaactcgcaccacttaaagtcaaagctgtgaccgatgaagaagcaaccaaaacagccaaagaaatcttggatcaagttggcttagccgaaaaggcagatgcttatccatccagtctttccggtggtcagcaacagcgtgtcgccattgctcgtgcattagcgatgcatcctgatgtcatgctgtttgatgaaccaaccagtgccttggatcctgaaatggttggcgaagttctgaaagttatgcaggatttggctaaaaccggaatgaccatggttgttgtgacccacgaaatgggcttcgcccgtagtgtggccgatgaagtatggtttatggatggcggcaaaatccttgaaaaggggacgccagaacaactgttcgaacacccgcaagaagaacggacacaagacttcctatccaagattcttgcccaataagcaaaaacacctcacccagcagctggtaagcggcactggttgaggtgtttttggtgtgaagtgaccattgctaaatgggggcagtcatgccatcactgatcaaagccgcttgcttgcaatctatttttagaatctttataatgttagcgaacatttgttttataaggagattacgatggcctcagcacacattgaacacaagttatcgttgctgccagatctgcctggcagttatcaaatgaaggatatcaacggcaaaattatttatgtcggcaaggccaaaaacctgaaaaatcgggtgcggtcttatttcaagagttcacacgacggtaaagttgcggcgatggtgtcacaggtagcggattttgatttcattgtgacttcaactgacaaagaagcctttttgctcgaaattacgctgattcaaaaatatcagccgtattacaacattaagttgaaaaaagggactggctatccgtacattaaaattactcatgaacgcgatccgaagattgaaatcactggtactatccgtaaagatggcggttattactttgggccatacccaaatgtctatgcagcgcaagaaaccatgcattttatccagaaggtttatccattgcggcgctgtaacggctatcaaggcagaccgtgcttgtattatcacatgggtcagtgtctgggtgcctgcttccggactgttccggaaaaggaatacacggaccaaattgaacgtattaagcgcttcttgaatgggaacgttggcaaggctaaagccagtttgacggctaaaatggagcgggctgcgaaaaatcttcaatttgagcgagccgcagaaattcgagatcaactgcattatattgaacagacggtggagaagcaaaaaattatttcacacgacaatacaacgcgtgatttgttcaatttttatatggataagggctggatcagtatccaggtcttctttattcgtcaagcacgtttaatgaaacgtgagtcacgactttttccagtggtgaatactgccaaagaagaattcgaatcatttattttacagttttacagccgcaggaataatgtgaaaccacgcgaagttctcgtacctgctgggcttgataataaagtactggcagatatcttagagattccagttagaacgccacagcgcggtgaaaaacgggacttgatggccttggctgctaagaacagtcaaattaagcttgaagacaaattccgtctgatggaattggataatcgtaccacgattggcgcgatgaaagagctgatggccgctttgaacttgccaatggggcatgtggctgaggcattcgaccacagtcacattcaaggagctgatccggtgtcggcaatggtgcagtttgtggatggccagccagctaagaacaattatcgaaagtacaagttggatgctgacaaaacgcataatggcgcagatgaggcggctaatacgcgcgaagtcattcgccggcgctatacccggttgttaaaggagcgtgcaccgttaccagatttgatcttgatggatggcggcgagattgaaatgaacgcagccaaggatgttttggaaaacgaactcaaccttgatattcctgtggcagggatggtcaaaaataataagcataaaacggcagcattgttatttggcaatgctgatcagctgattaatcttgatcctaagtcgcaaggcttttacctgcttgaacggattcaggatgaggtgcatcgttttgcgattaccttccatcggcagctgcacgccaagaactcgttggcctctcgattagaaggtatcaagggggtcggacccaagacgcggctgaagctgttacggaaattcaagacgatcaataagattaaagaagctccccttgaagatattcaggagctaggtatttctaaaaaagttgcgcaggcattgaagctgtcgctgacggcagagccgacaccagcgcggcgggtttaatcaaatcgtaggagcgtttaggacatcgttcataaccatcagtaagaacaaacaatcttgagatttaaagatctagtgccaaggcgaagcaatcgtaggccagatggggctcagccgtgcaaacaacacagagacaggctctggagctgatgttgttaggcgacttcgagaccgcgggctttgcgggctcgaagcgccgtctccgctctagctacgcgtcgccacctcatctggtcggagattgcggagtttggcacggcaagcgaattttttggctaggaatttaacgcaccacaagctcttatgtggaattccggttcggtctcacggcacaaaaaagcttggcgacattgatcgccaagctttttgcttacttatttattttcttttgcgactggtcgccagaagccgaggattaaggcggcaatgatggttccaatcagaagtgacatgatgaagccaagtttctggttggttagcagcaaggcaacaacgccaccatgaggagcagggacgttgacgtgccataactgggttaaaccgccagcaatagctgagccgatgactgagctgccaatgatatgcagcgggtcagtagcagcaaatgggatcgcgccttcagtgatgaaggtcaggccaagtgcatagttagaaagaccagcgttgcgttcttgcaaggtgaatttcttcgggaagaaggttgaagcaaccgcaatggccaaaggtggaatcatgccaccaatcataaccgcggccatccaccgaccatctttaaagccggatgcttgatagacaccgatggcaaatgtataagcggctttgttgaaaggaccgcccatatcgatactcatcatggcggctagaatgacgccaatcagaatcgcattaccagtacccatgccttcaaggaagctgatcaatgcgccattgatagcggcgaaaatcgggttgatgatgaagaacatcagcagacccatgatggcaaggccgatgactggatagagcaggatcgtgcgcataccatcaagtgaatgtggcattttgctgagcagcttcttcaagccaacgatcatccaaccagctgcgaacccagcaaccagaccgcctaagaagccagctgggttttgagccttcacaacggaggccgttgcaacggtggccatataaccaccgacgaacccaggcatcaacgcaggccgatcgccaattgattcagcaatgtaggccgctaaaacgggtactaagaagctaaaggcaaaggttcccaagttgttggtgaaggtgaaccacatcgatgtcttgcccagccattgttcgaggatgaacgagatcgccatgataatcccaccgccgacaacaaatggcagcatgtttgaaacaccattcatcaggtctttgtagatgcgattccataaagtgccgccagaagcctcttcactggctgcatcactgttatcggtgcctgcagcatgaaagacttggcctttgccttgaagcgtttcttcaatcaattcttcaggctttttaatgccgtcaatgaccggccgattgagcaactttttgccgttaaaccgatccattgctacctttttgtcggcagcgacaatgacaccagctgctcgattgatatcggaatcggtcagtttgtgcttaataccttctgagccatttgtttcgactttgatatcgacaccgagcttttccgctgtttctttcaaggctgcctcagccatgtaggtgtgggcaatccctgttgggcaagcagtgaccgctacgataaatggccgttcctggcgcttttctgccttgaattctgcttgcttgtcagctttttcttgttcttcctgagccttttccttggcttcttcagctttatctttagcctctttttcagcttgcgccttaccaaacaaggctaaaacatcatccggtgtcttcgcttgtttaagatctgccacgagcttcgggttgatgagcagggaagataatgctgcaagtgctgccagatgttcattgttggcaccttcaggggcagcaatcatgaagaataagtgaaccggctggccgtctaaggcgttaaagtcaacgccctgatcgcttttggcgaaaagaacggttgctcgagtaaccgcactgtctttggcatgcggcattgcaatgccttcgccaatcccagtcgttgattcggcttcacgcttcagaatatcttggcgatactcgttttcgtcggtcacaataccttctgcatggtatttagcgaccatttcatcaatcacagcctctttggacgttcctttgaggtccatgatcatgacattttttagtagtaaatcacgaatgtccattttgtcctcctaaacttcagttatactaattgtttgtttcacttcagcgattttgtcagcggtggcaagatcttcagaaaaagcggtcgcggaaccgcaggcaatgccgactttaaagctttccaacgtgtcatgtgtctgcgcaaatgtgccggtaaaaccagctaacatactatcgcctgcgccgacggaattaaccgctggctgcttaggaacggtgccatgccaagcgtgatcttggtcgatcattaaggccccggcccccgccatggagatcaagacatgctgagcgccaagaccaagtaggcggcgaccagctttgatgatggcatctgtgcttgtatattctggatcgccgaacaatgctgctaattcatggtgattaggtttgacgacaaggggatggtcaggcaatgtgtcgagtaacgcttgaccagtggtgtcgatgacaaaatcagccttgtgggcatgaatcaccggaatcagatcccgatagaaagtgttaggcaagccttttggtaaactgccagacatgacgacgacatcgccggcttcaagtttgtctaatttgtttttgaaggcggcaatttcagcagcgtcaatggtaggaccgcttgcattgagttcagtttcggatgctgctttaagtttgacgttgattcgtgtatcaccagcagtttttgtgaagtcacaaggcatgtcaatcgcatcgagccgatcttggataaaggtaccggtaaaaccgcccaaaaagccccaagcagttgttggcaggcctaatgtttgcaaaattcgactcacattgatgcctttgccgcctggtaatttaacggcgtgcgtaagtcgattgacagcaccaagttcaagttccggtaactcgatcacataatcaatcgaagggttgagcgttactgaatagatcaagaatgaacctccttaatattttcaaatcgctgataactggttgggagtccttgtaatgaacttgtcaggatcgtggcatcggagatatcagcaaagcggacgaaactgacttgctcaaatttacttggatccgccagaatgacaggtttactggcttggtgaatggccaatcgcttgatcacagcttcttctggatcaggcgtagtgagaccaaactcaggatgaacgccgttagttccaataaaggcaacatcaaaccgataatggttcaaggcttcagccgtcgtggcgccaatcaacgctttggttgtgggcttgaccatgccgcccagcatgagtgtagagatttgataatcagctaacaaagaagcgttatcaacccccgttgtaatgactgtgacaccaatgtcggccaaaaaaggaattaattgtgctgttgtggttccagcatctaaaaagatcagatcatcgggctcaatctgacgaacggctgcctgcgcgatcgtttgcttggcgcgcaaattctgcgcagatttgctcgcgacatccggttcatcgccgaggccattgatgcgcttggcgccgccgtgaatgcgtttgagctcacctgctgcctctagctcgtccaagtcgcggcgaatcgtggattcagaagcatcaagagcagccataagtgccttagatttgatgacggtatgctgttgcaattgggcaagaatatattgccgacgttcttctgtaagcactttcgtttcacctcgttcttcattatactgatgaaaccgtcaaaagcaacctaaaacgtgcaaaaacattcaacaactgtcagtaccccgactgacgcggcatattggcaatgttttctaattcttgtgcatgaagggtgagtaccggcttgggacgtgttaaaatagttgaggtatgcgttacgctgtactgaaatataaacatcgcgtataatcaaatgacatgtttttctgaaaggagatcgccaatgtttgtcgatcaggttcaagtagaggttcaggcgggcaaaggcggcgacggtatggtcgcgttccggcgcgagaaatttgtaccgtttggcggcccggccggcggtgacggcggtcatggcggcagcatcatcttatacgttgatgaaggtttgcgcacgttaatggatttccgttatcaacggcattttaaagcgtcagctggtggcaatggccaaggcaagcaaatgtatggccgcgctgctgaagatcggcggattgcagtgccggctggtacgacagttaccgatgctgacacaggcgaggttttaggcgatttaactgagccgggtcaaactttggttgttgctaaaggtggccgcggtggtcgcggtaatatgcactttgtttcgcccaaaaatacggcgccggaaatttccgaaaatggcgaaccgggcgagcatcgtttcatcaaattggaactgaaggtgcttgcggatgttgggttggttggttttccttctgtcggtaaatcgacactgttatcagttgtaacccaagccaagccaaaaattgcggcttatcaatttacgacgttagtacccaatcttggtatggttcaattagatgatggtaccgattttgtgatggctgatttgcccggtttgattgaaggggcttcacaaggtgtcggtcttggcatccagttcttgcggcatgttgaacgcactcgtgtgctactgcacctagttgagatggatcctgataatggacgcgagccgcttgatgattacgatcaaattcgtaaagaattaggggcttatgacgataacattttgaagcggcctgaactcgtggtcgcgaccaagatggacttgcccggcgcggctgaacgatttgctgattttaaggcagcgttacttgctcgtggcgtcgcggcggatcatatctttgaaatttctagtctgacgcatcgtggcgtgacgccactcatgcacaagacagccgaagtactcaaaacagcaccgcattttgagccgaaacaagcggcggttaaaacggctgattataagtatcaaccagagccggctttgaaagtaacccgcgatagtgacgggacgtttgtgctcactggtgacaagattgagcgggcgtttaaaatggccaatcttgatcatgaagatggcgcgatgcgctttgctcggcaattacgcagcatgggggttgatgatgctttgcgtgatgctggtgctgaaagcggcgatttagtcgccattgatgattttacatttgagttcgttgaatgatcttcggctgaacggctggggaagttatttttagacagaatggtggggccgcaattgaaacagacgcgtggacgaaagcgccggtacattcatggatttgatggtttaagaacaatcggggttattggtgttattttgtatcatttacgccccgagttgtttcggggcggatatttaggcgtaccgatcttcatggtcgtgtccggctatttgataacggatgggttgttgatcgaatttgaccgcaatcatcggattgattttaaaagtttttttattcgacgatttaaacgcctatatcctgggttaattaccgtcctctttgggacagcagcctatatcacgttattctcgcaaaacttgctgcataacttgcacatgatggtattgaccaatttactttatgtgtacaattggtggcagattttgaacgggcaatcctattttgctagatatgcaaatggggaatccccatttacgcatttgtggacgttgtcaattgaaggtcagtattatctcatttggccctttcttgtgttggcgctgttgctattggttaagagccggcatcagattgcgaacattgtgctgattcttgcggctgccagtggcgcttggatggcaatcttgtatatgatgaccattgcccatgtacagccagcagcgtttgatccaagtcggctttattacggtactgatacccgtgcattctcaatcctattcggagcagcgctggcctttatttggccaagtggccggctttcgcaacacttaggtaaaaaatgggtgattgggcttgatcttctcggtactgccagctttctcggcttactagtcatggtcttcacaattgatgcccagagcagctttctttatgaaggcggaatggtattgttctcaattgtgacaacgattttggtggcagtggtagcgcatccggcagctcattttgaccgattgttaagtaatccgttgttcagctatatcggcagtcgtagttatggcttgtatttgtatcagtttcccgtcatgatcttttgggagaatcgttttcgtaacattgcggatcacccagtattatatccggtgattgaagtggtgctaattgttgttatcaccgaactttcttaccgcttcattgaacaaccggcggcacattttaattatcacaagacttgggcattcctaaagggcttggctaatcctaaagttcgtatggggaaaacgcgctgggttagttatgtggcgctgattatcttagctattggcagtgttggattagccaaagcgccttctgttaaagcagaaggtgacaactcgcctttagcacagcagttaaagaagcgtggtgtttccactaaagagaaagaaaagcggttggcagcaatgcgttccagtattgctgcacaaaagaaagctgacaagaataaagcggccgaagaatcaagttccaaggcgctagaagccaagtatgcttctcaagctaaaacgcatccagtcaatcgtgagtatgaacaatacggcttgacccagattcaattgcaacaggcacaagacattggactcactgctattggcgactctgtcatgcttgacggtgaaaatgggcttcaacagctgttccctaaagctgtgattgacgctgctgtttctcggcaaatgatcaatagtattgatttggtccgcagttacgctgaccgcggtgtgctgggcaatatcgttctgattgggttaggaactaacggcccattttcagatgatcagctagcgcaaatgatgcaagccatcggtcctgatcggcaagtcttctggattaatgtacgcgtaccaacgcgcgcttggcagaatgatgttaatagcaaattggctgcagcccagaagcagtataagaatctgacggtgattgattggtatgacaagtctaatggtcatcctgattggttctacaacgacatggttcatatgaatccgaatggcaatccacaatatgcggcattagttgcaaaaacgattctggacaaggtgaaaaattaagcttccgacagatgattgattgcgttgatgagacaaatatgtcggttgatttcatgaggctgagcggcatcaagtcgctcagtttttttattagcggttgcagttagcggtccaccttcgtcttttttaaaccttgcaaatctcggcttaccaacattgaaaccgcgaaaatggcgaggaacttgtggtagactacaaagtgaagttcgacagaataggaagtatggtatggaaattcaatttttgggcacaggcgcagggtcgccttccaagtctcggaatgttagcagtttagccttaaaattacttgatgagcgtaatgaggtttggttgtttgatgccggggaaggcacacaacatcagattttacaaaccgctattcgaccacgaaaaattgccaaagtatttattactcacttgcatggggaccatatttttggcttgccagggtttttggccagtcgctccaaccaaggcggcacagatccgttgacgatttacgggccttctggcattgaggattttgtaaaaaccagtttgaaggtttctcaaagtcatctcagttacccgttaaaatttgttttattacagcatccaggcgtggcttttgaagatcaaactttcaaagtcacttttgatcgcttggatcatcgaattacgagctttggttttcggatcgaagaaaaaccgcatcctggcgagttgttgattgataaggtacgtgccgctaaaattccttctggaccggtttatgcggctttgaaggccggcgaaactgtaaccttgccagatggccggatttttgacggccacgatttcattggccctgcgcaacctggcagaacggttgccattttcggggatacccgcatgtgcaatcgcgcgctgcctttagcagcaggcgctgatgtgttggttcacgaaagtacctttggaccggatgaaagccaattagctaagcagtattatcatgcgaccaatgtacaagcagcggcgttggctaaacgtgcaggtgtcgggcggctcttgctgaaccatatttcggcacgatatctgagtcccggggtagcgatgttggaaaaaacggcgcggcagatttttccaaatacgcatgttgtcaaagacttcgaggaaattaacattccatttcggagtgaacaatcggaacctgctgtcacagttaaatcataaagctcagcggtagcaagtgaatatcaaaacagaggaggaaatcatgatgaaccaacatccgacggtggttatttctggaggatcgtcaggcttaggcaaggcgattggacttgaggcagcaaagcaaggcgcaaccgttgtctttttggcgcggcggcgggagaaattacgtcaagcacaggcagaggccagcacgctttccggccgaccagcttatgctttccctgttgatgttgctgacccagttgcaattgaagcgaccgttgatcaaattcacgaaacggttggtccagttgatattctggtgaatgccgctgggtttggtcattttgaaacagccttcgataccgatatgcaggtagtagagcgcatgtttcgggtgaatgtgctggggatgatgtatctgacgaagttgctgggtcgcgatatggtcacgcgtcagcaaggacaaatcattaacattgcttcaatggctggaaaaatggcgacgcctaagtcagctatctactcagcaaccaaatttgcggtgcttgggtatagtaatggcttacgtcttgaactgaagccattcggtgttaaggtgaccacggttaatccgggaccaattgccacgaatttctttagcgaagccaatgcgttagactatttggctagcgtttcttggctggttttggatccagataaattagcgcggcgaattgtagcgacatttggtcgaccagttcgggaaatcaatgcaccgtggtttatgaatcttggcgcagatttttataccttgttcccgcatttgggcgattggttagctgctggtatgtttaataagaagtaaaggggtaggtcgtatgaagggtcaacaacgttttattattgggttagttctggcattgattttaattgtttttgccttgttgaatgggcaagacgtttcggttaatttcttcggtattcagctaaagtggccgttgatagtgattattgcggtttccgtgttgataggtgccgttgtgacctggttgatctcaaccagtgctgtttcgagtgctaaaaaacagattcgtgagttgcaacagcggatcacggagctgacaaaatccaataaaactgacaagccagcccctaagccagttcaagcaccaaaagaggaactgtcaacagatgcgacggataccaaaaaatagacctttgaggattgaactgtcgtacctagctgtcaatagaggagctcgtgacaaaattctcagtcagacaaataaacaaataaaaggaacaatttttcgattgtacgattggaaaattgttcctttttgccttcacatagattatttaatgcgattttaaagaccgtagtgccaaaacggagcaatctaggccacctgaggctcagttgtgcaagcaacacagcgacgggcttcctacgatttttttaaatcatcatgaaatttaaaaaatggtttgaccttaactgaccaatgtcgtattgtgaaaatgaaaactataatgtaagacgatatttttcagggaggcatccgtattcatgaacccagataattttacgcaagccgttgccgaagcacttggcgcggcacaacaaattgcccaagttcgccgtcatcaagaaattgacatcccacatgtcatgaaaagcctggtgcagcctaatcaattggctgaacagatttatcgtgaagccggtgtgaatgtgcagggcttgaatgctgcgattgatgcggcactggaagcagagcctgtcgttgaaggcgctagcgcatacggacaaagcatgtcccaaaacctgtcgcagctactgacagatgccaacagcgtgaaggatgaatttggcgatacctatatttctacagaggcagttttgctcgccctttatcaacaacgctacaacccgatcacccaattcttgttgaacgatgccaaggttgatgcaaagcgattacgacaggtgattgagaacctgcgcggtggtgaaaaagtaaccagcaaaaatgccgaagcctcttataagagtttggaaaagtacggtaccgatcttgtaaaagaagcgcgcagtggcaagatggatcccatcatcggacgtgatgaagaaattcgcgatgtcattcgtattttgagtcgcaaaactaaaaacaatccagttttgattggggaaccgggggtcggcaaaaccgccattgtagaaggtttagcccagcggatcgtcaaaaatgatgtgcctgacaatctgaagaataaaactatcatctcacttgatatgggaagtcttgttgccggcgcgaagtatcgcggtgagttcgaggaacgcttgaaggcggtcttaaaagaagtcaaaaagagtgaaggccaaatcattctttttattgatgaaattcacaatattgtcggtgctggtaaggcagaaggctccatggatgctggtaacttgctgaagccgatgctggcccgtggtgaattgcatctgatcggtgccacgacactggacgagtaccgggaaaacatcgagaaagataaagcccttgagcgtcggttccaacgggtgctggttcaggaacctagtgttgaagatacgatcagtattttgcggggtctgaaggaacgattcgaaatttttcataaagttcggatccatgataccgcgttggtcgctgcagctactttgtccaatcggtatatcacagatcgatttttgcctgacaaggcgattgatttggtggacgaggcttgtgccacaattaacgtggaaatgaactcccgcccgactgagctggatgtggcagagcgcaaacagatgcagttggaaattgaacagcaagcactgaagaatgaaactgatcctgccagcaagaagcgattagcagatgctgacgctgaattggccaacttaaaagaggaaacaaataagctcaaggctcagtgggaagcagaaaagaaagatattcgtcaacttaacgagaagaagtcggcgattgataaagccaagcatgaattggaagatgcccaaagtcgctacgatcttgaaactgctgcacgcttgcaacatggcacgattccacagttggaaaaagagctgcagacgatggaacacagtgatcgtccccaatcttggctagttcaagaaagcgtgacagccaatgaaattgctgcggtgatttcgcgggaaaccggtattccagtagcgaagttggttgaaggtgaccgccagaagctattgcatttggcagataatctacaccaacgcgtcattggccaaaatgaagccgtcagcgctgtctcggatgctgttttgcgatccagggccggtttacaagatccaagtcggccacttggcagcttcttgttccttggtcccactggtgtcggcaaaacagaacttgctaaagcattggcagaagatttatttgattcagaaaaacacatggtgcgaattgatatgtccgaatacatggaaaaggccagtgtgtcgcgattagtcggggcggcccctggttatgtcggctacgaacaaggcggccagttgactgaagcagttcgccgcaacccatacaccattgttttgttagacgaaattgaaaaagctaacccggacgttttcaatatcctcctacaagttttagatgacggtcgtttgacagatggtcagggacgtaccgtcgatttcaaaaatacgattatcatcatgacgtccaatttaggctccgagtacctgctggacggtgtgcaagaagacggcaccgttagccaacaagccaaggataatgtgcggcaattggtcggcaaagcctttaagcctgaatttttgaatcggattgatgatattatcatgttcaacccactatcattagcagatgttgaaaagatcgctgtgaaggatctcaagcaattaggcacgcggttggccgatcaacagatatcgcttgatatcacaccggcagcgcaggagtggttggcccataaagggtatgagccagcgtttggtgcccgtccactgcagcggttaattacgagtgcggttgaaacgccgctggctaaagaattgattcgcgggactgtgatgccgggtcaagaagtcgtcatcacggttgcggacgatcagttgcaatttaaggcaaaaacagtaccggtcaaagcttaaaccggctgacaactgattttttctgtaaagacccttgccttgacgcgccttttcatgtatgattatcattgctgtgacagatagcattctgtccacgcgtgatgatgattggacttgcattttgatcatcaaccgtataaagttgtttagaaatcttactaaaaaaggggttttccgctcatggcagttccagcacgcagaacgtcaaagaccaagaagcgtatgcgccgcggtcatatcaagttgaatgtgcctaacttgcaattcgacgcagcgaccggcgaataccgcatttcccaccacgtttcacctaagggttactacaagggtgcacaagtggttaagaagtccgacgataacgcaaatgcataatcaaaagccaacatcttaggtgttggctttttttgtgtgtgagcgctcgccagcccgtttagaaaccggagtgtaagtggccctgaacgtgatgaccgggttttggtcattgcgttcaggggccttacacgcaggtttctgggcttgcgagcgcgttatggtgaacggagtaggtttctgggcaggtgcacgcgttatggtgagcgtgagtacgagcagcaagaagtcgaaacataatcgaccttaccaatgaaaactgtactttgatcattaggtaaaatattagcatcaatcggtccacgaatggttatcaagtctagctcacatggtatactcttcttgaaagaggtggcagcatatggctgataacgaacaatttgccgattatctagggcaacttcaagaggcgcagtttccgcgctggactgatctgccccaatttgacttgtatatggatcaagtgatccagtatgtcaatgatattgtcacaccgctggggtttggcgagatcacatccacgatggtcaataattatgttaaaaaaggggttattaaagccccgcttaagaaaaagtatcgtccagaacaattagccaatattttagtcattgcgatgctaaagccagtttttgcgttggatgctattgcggcaggtattcaattttcacttgccaatcggccggttgcgcaagcttacgatgcgtttattctcacttttagcagcgcaattgagcaggcaaattcggattttagcgatggtttaaccattagccgcgtcaataaaccagatatgacgacaacccagcatgccattgtgacaatggccattaatgctgttttacaaaaactgttagttgaaaaaatgattgatctggctgctgatgattcggaaaagaaagggaaaaaatgaaactaaccattctatcgacaagtgacacgcatggttttgtcttgccaactaattatgtgaaacgggatcaggatttgcctttttcattagccaaggccaaaacggtgcttgatgctcagaaggcagcagctgaaggtccagttgtgacgattgaaaatggcgattggcttcaaggatcaccactggcctattacgttgcgaagatcagcaagcagccagatcagttgacgcgactgtataacgaggttgggtatgatgccggcattatcggcaatcatgagtttaattacggcagcgactatttgcggcaagcgttgaaaacattgacctatctaaccatcaacgctaatatcaccgaaaatggtcaaccagcatttggggcgccttatcaattgattgagcgctcaggggtcaaaattgccattctgggtttgacaacgaactacatcccacattgggaagcaccggcccatattgccggcttggcttttcaagatgtggtagcgactgccaagcactatgtcccattgttgcgtcaacaagctgacgttgtgattgttgcttatcatggcggttttgagcgtaacttgcagaccggtcagccgactgagccattaaccggcgaaaatgtcggatatgcgctgacccaagtaccggggattgatgctttagtcacgggtcatcaacatcgacaattggccggattagttaacggtgtaccgatcacccagccaggttaccgcggggaagcgatcggtaagatcacacttgacttaaatcagacagcgagcggctaccaagttactgctagcaaagccgtgttagtcaaaacaggcggatcaattgcgagcccaaccattttgcagtcagcggctgatttgaatcaaactgttgaaacttggttagaccagccattagctcatgttgaaggagatatgcgcattcaggctccatttgttgcgcgggttcatgaggtgccgtacattgagtttattcaaaaagtacaaatggccagcaccgatactgacatttcgggcaccgctttgtttaacaatgaagggcgagggtttggtgaaaccatcgacatgcgggatgtcgtcacgaattacatttatcccaacacgctatctgtgttgcggttaaccggcgctgatttaaaagcagctctggaacagtgcgccgaatatttttcgctagatgctgatggcaagttgacggtgacgccccgatttgagcggccaaaacctcagcattacaattatgacatgtatcagggcattgattatactttggatattcatcagcccgtgggcagtcgagtaactcggctgctttatcacggtgcgccagtacagcccactcagacttatgatgtggcggttaatcaataccgtgcggctggtggcggtaattttaaaatgtttggtcctgataaagtcatccgagaaaatcaaaaagatatgaccgaattgattgccgattatttgcaggaacacccattaatcaaggcaactgctgaccaaaactttaatgttttaccgtcaatgtgacagtgagtcatatttcgcttgtcaagcagcgaaggaacgcttatgctgttggtcgttattgaattgtgcatagcgaaaggattgttcggtttaatgaaaatttggaaatataccatggtcggcttattggcattcgtgctagcaggttgcggccaacaattaagcactaccaaaacctcatatgggcgtgacggactggtcgccattgttaaagggacggcccgcggtgtggatcgcgtcagttatacaagtgatgccggaaaaggcagtgtgccagtcaattcaggcacgtttgtggtcaatgtgcccgttagcgatgtggctcaaaaggtgaacctaaaagccggtagcatgcaaactaacgtcacggtgaaagccggtcaatcgctcggaacttatagcacgattgcggcaaagtttaatcaaatgctggcggtatccagtctacctaaagcggatcaagccaagctaaaacaggcacaggctgcaagtgccaatgctcaaaagaacgttgcgaccatgagtccaactgagaaaatggcaatggctcagcaagcacagcaattgaagacactgatggctcaggccaatgccaataccaaagcatcccaactgccggcaacggcgaagacgggcattcattcaatcttaaaatcagcaagcggcgattaccgcgcaagtattgttgatggcaaggcaatggggtttgccgttgtggtaccattatcagttttgaaaaacagcaagaagatgcagacgtttgccactgacttcgggttactcacaacttcggtcggtgctgatgccaagtcagttttctcgcaatttaagaaattgacgaaggatgctaagtctaaaaacaatgcgacgaccattagcacaatcaagagtcacggcgtcaaaattgatgttggttattccaccacagcactttacctgtatgtgacaaaataagcttgcgtcactcattccaaaaacgtcagcacatgcaaagtgcccggttattgttagacatgccagtctagcaataatcgggcactttgacgtcattgacgatttaattaatgttctggtttttccgcaggttttgcaaaatgctgcatgattggcgggaagaagaataaaatgacaacgaagatcacactgataatcgcgcttgtcttcgggtcgtagctgccgccgctcaaggcgctgatcaggaagccgacaacttggccgaggatcacgccccagataatagtaggtagataacgcatggaatccctcttttctgtcgtcatcttaccacgaccacaagcgaattcaactgaaattgtgagtatttccggtataatagaagcgaggtggcaagatgacgtttacccaattacaggttcatagcaattataccttattacacagcccgttggcactgtcggatcttatcagcgcagcaaaatcacgcggttattcggccattgccttaacggacactaatgttgtttatggtttagtcgagttttatcgacaggcgaaagcggctggcttgaagccgttattaggcatgcagatcgcgattgatgatgccaaacttttagtgattgccaaaaataatcagggttaccatcagttacttaagatctccacgcaaattatgctagcaacttcgtcggtggcctttgcggacttattgcctttgacaggcttagtcgccatcaccttaccggattcaccattttcggcggcagttgttgctaacgaacacgacagagctgtcgcttttttacaggagcttgataataaacagccggaagcggtgtatgttggtctggatgaggctcatttagatacgccattgccggcatttgcgactagtcagcaacttcacctaatggcgttaggtaacgtactgtatcgtgatccgactgatgcttttacgcaaaaagtgatggcagcgattggtgatggtagtcagttgaactttcgtgacccagttttaaccgatgctgggccatggtggttaaaaccgccagcagatgcaagtgcaccttttgttgctgctggactacaggcggcagttgacaacgcggctcagatagcggatcaaacggatgtgacgattacgttcaagcagccgcagctacctcattatcaaacgccagatcagcttgcgtctaaagattacctgaccaaactggctcaagaaggcctcgctaaccgttttcacgatcagccgattccgacaacctatcagcagcgtttgcaatatgagctggatgtcattatcaaaatgggatttgctgattactttctggtggtttgggatgtgatgaattacgctcacaaggtcaatattatgactggggctgggcgaggatcagctacgggctccttggtcagttacgcgctggctattacagaagtcgatccgattgcttatgatctgctgtttgaacggtttctgaatcctgctcgagcgcaaatgcctgatattgatttggacattcctgataaccgtcgtggcgagctgattcaatatgtccatgacaaatatggccgaaatcacatggcccagattattacttttgggacgttcggcgcgaaacaggcgatcagagatgtggcacgcgttttcggtatgagtcagtttgaaagtaatacttggagcagagcaattccaaacttgttgcacatggatttaaaaacagcatacgatcagagtcagccgttgaaaaatttggtggccgattcaccaaaaaatcgcatgctgtttcaaaccgctttagcattggaggggttgccgcgacattattccacgcatgcagccgggattgtgctttctgaagaaccactaactgacaccgttgccttgcaacccagtggcgatggtcttgaacagacgcaggtacccaaagatgatgttgaagcacttgggctgcttaaaatggattttctgggtttgaaaaacctcaatattttagccgccgccagtcattttgtcacccgtgatactggccggacgtttgatccaaaacagattccgctgaatgatcaaccgacactcgctttgtttgcccgcggtgatactaacggcgtttttcaattcgagtctgctggtatcaaaaatgttttgcgcaaactgcggccaactgattttgaagatgttgtggctgtcaacgccttgtatcgtccaggtccaatggaaaacatcgacacgttcattgcccgcaaaaatgggcaagaaccgattgcttatcctgatccggccttggagaagattttgaaaccgacttatggtgtcttggtttatcaggagcaggtcatgcaggtggccagtgtcatgggcgggttcagtcttggcgaggcggatttgttgcggcgcgccatgagtaagaagaaatcatcagtgctggcagccgaacaggataaattcattgaaggtgcggtcaagcaaggattccctgaggcgactgccaaaacggtttatgcttatattgatcgatttgcgaattacggcttcaatcgttctcacgcagttgcttatagtatggtcgcattttggttagcgtatttaaaagtgcatgatccagccgccttttttgcggcattgatgaatgctagtatgaataatttgccgaagctccggacttacgtacaagaagccaaagcgcgtcaggtagctttattaggtcctgacatcaacaccagcaatggtggctttaagttgagcgacgggaagattcgctttggacttttgtctgtcaaagggatgcgccgtgacttttccgaagccatttttaccgctcgtaaaaatggcccgtttaaagattttcgcgatttactacagcgcctcgagccgaagtggttaaaggcagataatttcaaaccattgattcttgccggtgcctttgatagctttgatgataaccgggcacagacaattgcgaacttagatgaattaatcaactcggttaaacttgctggcaatgatgttgggttattttcagtgctagcgcctaaaccgattgtggtgccggaaatgccggcaggcgaacggcttgaagaagaggctaatgttttaggcgtttacctttctggtcatccggttgacaaatatgcccctttgaaaacgcaatacacattagtcaatgtggtggatttagcagaaggtcgcacggttgatattttgcttctggttcgacacattaagcggatccggaccaaaactgggaagcctatggcgtttgtggatggacaggatgcgactggcaccgtttcgctgacggtttttcccaatctatatccaacattagaaaaaattgagaccgacatggtggtactagtgaacgggcgagttgaaaaacgcaatgacgacttgcaactcattgtgaaccggattcaagatgccgcaccgttacttgaggccttaccaaaagcacagttatttattcgcttggatgcggataatgttgacgcccggaccgatttactgaaaaaattgcaaactgcccatggaccaattccggttatcactgtcgacacgaccagcaaggagagcgttttgctagataagcgatactgggtcactgctgacaccagcttgatggctgatcttgaatcgcggtttggtgcggctaatgtggtgttgcgaaaacgacaagaagaatagagaaaattgtaaaatgttctcattttcagggactttgtttctgaaaagtggtaaactcaatgagtatttgtgatgggacaaatcgcaaaagaatatgcatgaggtgaaataatgaaacgcattggtattttgaccagtggcggggatgcgcctggcatgaacgccgcggtccgcgctgttgctcgcaaggcgatgcacgaaggccttgaagtatatggcatcaattatggatttgctgggttagttgccggcgacattttcaaaatgaatgaatcaactgtcggtgataagattcaacgcggcgggaccatgttatattccgcacgttatccacaatttgcgcaagaagaaggccagttgcgcggggtcgaacaattaaacaagtttggcatcgaggcgttggtcgtcatcggcggagacggctcttatcacggtgcactagctttgacgcgtcacggtttcaacaccattggcctgccaggaacgatcgacaacgatattccttacacggacttcacgattggctttgacactgccgttaatacagttgtggaagctgttgaccgtcttcgcgataccgcggcttcacatgaacgaacctttgtcattgaagtcatgggtcgtgaagctggggatattgccctttggtcgggcgtcgccggtggtgccgaggatgtcatcattccagaacacgactttgacgttaagaaaattgcgtcgaagttgcaaagttctcgtgaacgtggtcaaaagcatgcggtcattcttttggcagaaggcgtgatgcacgctgatcaatttgccaaggaattagccgcacatggcgatttccaattacgttcgacagttctgggacacattgttcgtggcggtgcaccgtccgcacgtgatcgcgttttggcttcacaaatgggttcatacgcggttgaacttttgttgcaaggcaaaggcgctttggctgtcggcattgaaaataacaagatcacggcacatgatgttcggaccttgtttgatgccaagcatcacgcagaactttcgctctacaccttagcggaagagttaacattttaatctcgtaaacaaacgacattaacgtctgtttaaataatttcaaggagcgatttcacttatgaaaaaaaccaagatcgtcagcacgcttggacctgcaagtaacaccactgatatcatcgttaagttgattgaagcgggtgccaacgttttccgtttcaatttctcacatggtgatcatgaagagcatttggcacggatgaacatggttcacgaagctgaaaagatcacgggtaagaccgttggtatcatgctggatacgaagggtgccgaaattcggacaactcttgaagataccccgaatggtaagatcgattttcacaccggtgacaaagttcgcatctccatggatgcaagtctgaaaggcaccaaggaaaaagttgctgttacctatcctggcctttatgatgacactcacgttggcggccatgttttgtttgatgatggcttgattgacatgaagatcaccgaaaaggacgaaaagaaccgtgaactcgttaccgttgttcaaaacgacggtgtccttggtggtaagaaaggtgtcaacgctcctggtgttgccatcaacttgcctgggattacggaaaaagactccgatgacattcgtttcggcttggacaacgggatcaacttcattgctgcttccttcgttcgtaagcctcaagacgttttagacattcgtgaactccttgaagaaaagaacgcacttaatgttcagatcttccctaagatcgaatcacaagaaggcatcgacaacattgatgacatcttgaaggtttccgatggcttaatggttgctcgtggcgacatgggtgttgaaattccatttgaacatgttccgatcgttcagaagcgcttgatcaagaagtgcaactctttgggtaagccggttatcacggctacacaaatgttggattccatgcaagaaaacccacgtcctacccgtgccgaagtaaacgacgttgccaatgccgtgtttgatggcaccgatgcaacgatgctttctggcgaatctgctaatggtgactatccggttgaatccgttgctgcaatggctcggattgacgaatacaccgaagcagcgatgatggatcaggatgccttcgcattgaaggaatacagtaacaagaacgtcaccgaagctgttggccaaagtgttgcacacacggctcgcaacttaggggttaagaccattgttgctgcgaccgaatccggctacactgcccgcatgatttccaagtatcgtccgaaggctgacattcttgccattaccttcagcgaaaagacccaacgcggcctgatggtcaactggggcgtttacccaatcattgctgaaaagcctgctaacaccgatgctatgttcgacttggcaaccaagaaggcccaagaccttggctttgctaaggaaggcgatctgatcttgatcactgccggtgttcctgttggtgaatctggcacaaccaacgtaatgaaggttcaactcattggctccaagctggttcaaggctcaggtgtcggcgacgaatccacgattggtaaggcagtcatcgcaagcaacgctcaagaagctgctgctaagatgcaaaagggtgacattctggttgttaagacgactgacaaagattatttgccagcaatcgaaaaagcagctgccttggttgttgaaaccggtggcttgaccagtcacgcagctgttgttggtattgctatgggtatcccagttgttgttggtgctgaaaatgctaccagcgtcatctccgatggccagatcattactgttgactcccgtcgtgggatcatctacaaaggtgctaccaacgccctttaatcttcaaaatgacctgttaaaggttaggaaaaactctcaaggaaacttgggagtttttttcttccaaaaaaacagtagcgttgcctgttttgagcaacttactgataaatgtatgagcagaggtcgtcaggtgcgtgcgagtggcttataataagaaacagtatgcaatctcgtaagcgataacgctggcagtatggtcagcatcatgatggagggaacacttgtggagagttggctttttttactaggtattttagcaattgcaattgtcggcaaaaataaaagcctgataattggggtcagtgctgtgatggttctcaagctgatcccgcaaactcaaaactttttgaaattgcttcagacgcaagggatcaattggggcgtgactgtgatttcggccgctattatggtgccaattgcaaccggtgagatcggttttaaagagcttcttaatgtcattaaaagtccggctggctggattgcgatcgggtgcggcgttttagtcgctgttttgtcggcaaagggtgtcggtctgctggcaatgagcccggaaatgactgtggcattggtttttggcacaattattggcgtcgtgttcttaaagggcattgcggctggaccggtgatcgccagtggcctcacctatgttatcttgaccgtttttaatcttgttcctggacattaatgaccggcaactatggcgctcgtttaaggagaaaaataaatgaattttaatggcagtattgtcaccgcacaagtgacggatcacaatgacacggaagtctttgctcagcatgatggcgtcactttggccattgatcgcagtgagttggctgaacttccagaagttggcagtgatgttgagggttttgcctatgaaaataagcaggggcaggctcgtttaaccacaaaagttccgacagttggccgcgaccattacgcttttgcaaaagtagtcgaagtgcgtaaggatcttggggtatttgtgaacatcggcttaccagacaaagatattgtggttagtgaagaccagttacctgaaatcagccgtttatggccgcaaaaaggcgatcaattaatggttgccttaacagtcgacaaaaaagaccggatgtggggaaatctggctgatgaaagtatcatccacgcggttgcaaatcgcgcgaagcctgagcagatgaatgctgatgttactgccacggcttatcggttgaagatggctggaacgcgtgtcttgaccgatgatttttatttgggttttatccatccaagtgagcgcgatgctgaaccgcgacttgggcaaattttgcatgctcgcgtgatcggggttagtgctaatggcgagctgaatttgtcgctaaaaccacgtgcctatcaggccatcggtgatgatgctggcatgatcttggcagttttgcagcatgatccttcaggaaaaattgcttatacggataagagcgatcctgaagcgattaagcaaacctttggcatcagtaaaggcgcctttaagcgcgcactgggccatttgttgaaggctggcttagtgaaagaggaagctgggtatacgattttgacggccgcagctaaggcgtctcgggagtaacatcatgcatgggttgatcgcggattttattcattatctaaatgttgaacgcggattggcaaaagccacccaaactagctatcagcaggatttgatcactttttcggcttggctagcggcccgaaaaagaaggacatttcctgaggagttcggtaccatccagtcctttttaaaggagcagaatgccaccaaggcgcctgcttcagttagccgcatgatttctgctttacgcaagttttatcggtttttactgcgtgaaggggcaatttcagctgatccaatgaccaagattgacaccccaaaacgtgcccaacatttaccagcaacgttgtcgagtcaagaagtcgatgctttgatggccaaaccagataccgacaagccattgggattacgtgatcgcgctatttttgagttgatgtatgccactgggttacgggtttcagaagttgttgatttacgtcttgatcaattgcatttggcaatgaatctacttcaagtgactggtaaaggggacaaagaacgactggttcccattagtccgcaagccacacaatgggtggatcgctatctgcaagaggccagacccaaattactcaaacgagtacaacctaaaaacgtttttgtcaattttcacggtgggccaatgactcgccaagggatctggaagaacctcaaagcatatattgcaagtatcggcattgaaaaagatgtcacaccgcatactcttcgtcacagctttgcgacaaggttgctcgaaaacggtgctgacctgcgcgtggttcaagaactactcggccacagcgacatcagcacgacccagatttacacccatttaagcaatcaacatctagttgcggtctatcataaaacgcatccgcgcgggtagctattttgacagggtgttcctttctaagaatatgtttgatgactaagagattgtggccatcagcattgccatgggcagtctagctcgaatactaagatagaaagcagagcgttggcggagccaaatcggacaatagaattaaacttgattagcgtagaaccgagaaaagcttgacacatacgttcacgctctgccctttgctactgccgcgtttctatgatagagtgttacgagagtatctcttggaggcaaacatgctggttaaatacaaaaacgactatgagaagatcgcgatgggattgttgtcttttattccggatctgaaagatgtcgggcatttaaagacagaactcaagatgtacaccgaagatgattcccatgcgttgtatctatacaaacataagaatgattttgttggtgtcgttggcattgaactaagtgctgactttgttttggtgcggcatttaagcttttcacctaattttcgtgaccaagcaacggcatttgccgcgttgactgaactgactgaacttttcccaaacaagaaattgatgggtgcccttgaacatgcaccgctaatcgccgcctttaacaagtttcgaaaagaggatgaccatggcactgacactcgtgctgaatgacttctccggaccgttagacttgctttggcacttgattcggacgaatgaagttgacatttacgacattccgatcgctgagatcaccgctcaatacctagattacctgcatcaaatgcaggatctggcgctggacgtggccggcgattattttgtcatggccgctaatttgatggtcttgaaaagtcgccttttgttgccccaacctgaacccgaaacgatggctcctgatgaggcgccagatccacgagcagatttagtggcacaactattgacctatcaagtctaccaagaagcagcaaaggatttgaaagcacgcgaggctaaacgcgcacaagcctatgccaagccaaccacattgccagacgccaaaatggctgtgccacttgcgccaggttcggtgaaattagttgatttacaagcggccatggcgcgtgtgatgaaggcacaacaagccactcgccaaaccattgcccacattgaaaccgaacctgtatccgttgaaaaacgaatcggcgaagtgctacagacattgcaaaaaggcgggcaatgtctctttgctgatttactgtcggttcagtcggttgagcaggttgtgacgacttttctggctttgcttgaattgatgaaaaatgatcaggttatttgtgaacaagaggcgccatttgatccaatcacagtgaccttgaaggaggctgcttaatggagccagcactagaagcaatcctttacacagctggcgaaagcggcgtgacgctgggtgagctggccggcattttagaaatcagcgaaagcgcgatgcgacagcaattagacgcgtatcgacaacggctggctgctgatgatcagcgtggcctgcaattgcagcagtttgcggaccggtattatttactgaccaaaccagcgtacgcacctgcaatcaagaaatattttgccgggccgccagctgcgggattatcgcaggctgcgttggaagtgctcgcgattatcgcgtaccagcaaccgattacccggattgaaattgacgaaattcgcggtgttcaaagctcaggcgcattaactaccttggctgcgcgacaactcatcaaagaggcaggccgaaaagaagcccctggtcgaccaattttatatgcgacaactcagtttttccttgactattttgggttgaaccgccttgctgatttaccaccgctagctgatgcgcctgccgacacaggtgaggttgatttgtttacggcatttcggcacgatgatgatcaagaggaagctactatagacgaaaagaaaatggagcaaaatcaacaacatgacaaccaaaactgaacggcttcaaaaaattatcgcaaatgccggtattgcttcgcgtcgacatgcggaaacgttgattgcaactggccatgtcaaagttaatggccaaattgaaactgaaatgggcatcaagattggtccgcatgatgaagtcgaagtggatggcgtgccgattggcaaagaggctaagcgctactttctcttttataaaccgcgcggcgtgattagtgctgttcaagataataagggacgtgatgtcgtcaccgattactttaaggatattactgagcgtctttatccagttggccgattagattacgatacaagcggcttacttgtgatgacaaacgatggcgatttagccaaccatttgatgcatccacgttacgcgcttgagaaaaaatatgtagccaaggttcaaggtgtaccgaatcgacctgccttggctccgctcaaaacaggtgtcgaggttgatggcaagatgactgcgcctgctaaagtagacattatctcgactgataaggctaaaaaaacggcgatcgtatctttgaccattcatcaaggcatgaatcatcaggttaaaaagatgtttaaagcagtcggcttcccagttctaaaactatctcgggaagcgtatggcaacttaactttggtggggttacagccaggtgaacatcggccaatcaagccgcaagaactgcaagccttgcgaaaactagcgggtgaatcggaaaataagtagttggtgaaattgttaacgctttcagtgcaaacgcttgaacttttccggtgcctttgctaaagtaaagctgttaattaaataatcttggttcgtcttcagggcagggtgcaattcccgaccggcggtatagtccgcgacccgcttatgcggtggaaccggtgtgactccggtaccgatagtgatagtctagatggaagaagatggggcttttttgaatctacattcaatcaagacctattccccctgaaggaggaataggtctttttaagttccggaagacggcctcacggaggtaatgttttatggcaagtagttccaaggttcaccgtttggttggtatcgcgttgttagcggcgatcgggtatgttttgatgatgttttcatttccgatcattcctgctttcccgttcctgaagcttgatctatcagatctggttgttttgcttggtgggttattatatggcccggctggcgggatcggcgttgcatttatccggagtcttgtgcattttgctttaacaggcggcggggtcgtcaatttaattggtgatctggcagctttcattgcgagcgttgggttcctgcttccagttgtttacacgattcgtggcaagcacagcttgttgcggcaaattgaaggtctggtactaggtaccgcaagcctgacagttgtcatgagtgtgctcaattggctggtgatcacgccgatgtacatggcggtcttcaattttaaccttggtatgtcgctgacgcgttacgttttaatcggcgttgtaccattcaacttaattaaaggaattgtggtctcggttgcattcttcgcgatcgccaaggccttggcaccgtggttagctcggcgtgagattcaacctagtcattaatgatttgatcaatcaactaaaaaacggctctacgtcaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttgcctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcccgcactgaaccatcgtcccagacgtattctgaactatcttcgcccatgcgattactaccgatgcatggcgtaacagcctagaccactatcaagaattcgttatcatcgttgcacttgacttgaaaattgaggaaaacactccagtaacaaaatctattgatggaatttttctggcaaagacacgatataacacaaaaatgctcatcttctaagccaaactagaagatgagcatttttcgtgaattcgaactcactcgtattgctattgaagcttgtacaccactgcgccaaatggtggtaatgtcagtgttttctctagtgaatcggaaatttcactattccgaatcaacacatccacatccttagcttgcaagtcatccggcactgaccatgtgcgttcctcacttgagaagttatctgccaccagcaaggtctcatgttcccctttgcgcaggtaaataaacaagttcggatcatcaggagcaagtagctcaaatacaccagtggtaatcaatggctcttcatgtcgtaatttaatcaggtgttgataatagtggtaaacaccgtcactatctgccaagtcttcagctgcattaatgtctttgtgatctggatttagtcccagccatggttgtccggtggtgaaaccacctttttcactgccatcccaaggcatcggcgtacgagcattatcgcgcgaatgcagataaatggccttcatggccgcctcaggactttcatgatgctgttgggtgagttctttgaaaatgttcttggtctcaagatcgttataatcgcttaattgatcaaaatgaacattcttcagaccgagttcttctccctcaaaaatataaggcgttccctgcaacatgtgcagcacagtccccagcattttggctgatcgaattcgatactggccttcatctccaaatcgtgtcacaggccgtggctgatcgtggttgctccagtaaaggctgttccagccatcgacttgcgctaatgtgttctcccaacgtgccaagacttctttgagatcaactaatttaaatcgatttgtcgagaacttgccatattggccatagtcaagatgcatatggtcaaaatgaaaaaccatatccaactcgtgacgatctgccgccgtgtataattgcgcctgctgtgccgttgtatggggcgtctcgccaaccgtcatgatattgtagtgcgacaacacttgctcgtgcatttcctgcaagtaatcatgaaccttagggccatttgccgctccggcataataactaccgtatgccttgccttgaatgagcgggccatctggataagccggatctttagaaatcagtgatatgacatccatccggaagccatcaactcccttatctagccaaaagcgcatgagatcataaacttcttggcgtaccttaggattttcccagttgagatccggttgttgcttggcaaaaagatgcaggtaatactcgcccagatcttttttgtattcccaagctgaaccaccaaagcttgagccccaattattaggctcatgatcgtcaactggcttcttccagatgtagtaatcgtgatgcggatcgctcactgatgatttggcggctttgaaccacggatgttgatcagacgtatgattcacaaccaagtccaagataatctttagatgtcgatcatgtgctgcctgcaacaagtgttcaaaatcggccattgtccctaattgtggttcaacatcgcgataattcgaaatatcgtagccgttatcaacctgtggcgatcggtaaatcggattcagccagagcacatctacgcccaaatcggctaaataatccaatttttcactgataccatttaagtccccgacgccatcaccgttactatcattgaagcttttcggataaacctgatagacaacgctctttttccaccatggtatttcattcatcatcgtcatcttcctcaacttgaatctcgttgacattgacgattgcatctttggcctcttgaatcagcgcatcaattcgagcatcgctaatatactgatcagccggttccatcgcaacgccaagtgcaagtggcagattcatgccgctgatgatatgtgtatgcggacgtgtgcgatatttgaagaacttttgattaacgctccctgccgtcatatccgtcagtaccacaacatcacgatcagctgggaaagcagtcataacctcatcgacttgcttttcaaccggctgattgtccaaatacgctgccagcgtcacgatgtcttgaccgccgccactaatgaaatccaatgtgtctttcaacccttcagcgagccgatgatgtgacgccaatacgattgtgcgtttcatgaatcttcctcctctaaccacgtttaccagaccagaaacctgcacctaaggaccttatccgcaatgaccaaaggacggtcatttcaggcctaatcattcaaaagtatctccaaaagtgcatcgctcagtgttgccggtgcgagactggcaacagttaatgctgctctacttgctggcatatcgttaacgctttgccacaactgctttttcagatcaaacgcaactttagcatgttgcagaattgcaaagatatgctgcagtttaattgcctgttgatcttcggcttctaaatcaagtgtcagtcgctgatcaaatcgtcctgagaatggtttcattgtggttttaacgcccacaatttgtaattgataggtccgcttctcgggaatgatgtgattaggatcagtaacggtcatcccaaatgtaccggccacgggatcccaagaaaatttggtttgcgcttctccagccgctgtctgttcatgtaatacataggcatgttgcttgccagggaaaagcgtaacggtcatagcttcgggcagatcatcaatggccgccatagcgtcatcagctaatggcacgatgccgcctgagcgcacaagaaccggatactgaaacttgttgcgatagaacttaacaactgccggaccagtatattgctgatgggtaaataaatcggtccaggtaccggctggcacataaccttctgcactggctaagcccgttgtgtcatcactaggcgctgtgatcggtacgaccagcatttctgacccgaagaagtactcatttttgaactgataagcttcttttacttctggatatcgataataaacaggttcaatcaatggcatgccttgctgatgtgtcaacacatccgccgtcgccagataagggacaagctgagcgcgcaatcgcatgaaacgtgtcatgctcttatccgtttccagatcatattgccatggttccttgcccataaacggattgtccgaactgtgcaaccgcataatcggactgaaaacaccgaactgcagccagcgtagtgacaattcaggatcatagctgccgtgcatatgcccgccgatatcatgactccaccaggtgtagccaatattcgtggccgttgctgtgaagtacggttggaaagttaatgatcgccaactggcaatggaatcgccagaaaacccaattggataccggtgactgccaggtccagcatagcgtgacaagatcagcgcttgatccttcttttctttcacctgatccagaaaatgcagcacgttaagcgaccataatggatcaatctgcgcacgtgatcgtgcagcgccctgctgccaatcaagccaccagaaatcaatcccctgtttttcaagcggatgatgaaccaagttaaaataggcttgaataaattttcgattgtttaaatcaaacaacactggctgcttagaggctggatcaatgccgacagccttagcaacttctggatattgcacttcagaaggacggataccagcagctgggtgcacattgagcgtgacatgtttgccttgtgcgtgtaaggttgccaataatttttctggttccgggaacagttttttattccaagtatatccagtccaaccgctgccatacttcgtcggaatatctgtgacatgccagttcatatccaagacagcgaccgctattggaataccggctttttggaaacgatccatgagcgcaaggtaactttcttgcgtataaggatagaagcgactccaccaattacctaacgcaaaacgtggtaccatcggcggaaatccagtgagctgataataatcatacaaagccttgcgatagtcgtgaccgtatgcaaagccataaagatcaatttcctcaacaggccgattcctgatcgatgtgccagcttgcagcatactggttgagtcatccaagatagtaaaaccgtctttggacataatccctgaatccagcgatacagcaccatctgcgccatctaacgttcgggccgttccaagcaagttcttgacatcgggatcaccgtaatgccaacgcggatagtgcgtctgaaaattgtattttgtatcaatgaacaagttggctccgttgaattcaccaccgcgataatagaggtgaaatgaatctgtctcgatttggacagcaaaaccttcttgatcacggatcacctgaaaatccggcttgccaaaatcgcgattaaccactgtttgcgtcgttgcatcttcaaactgaccggcagattgatattccatgcggatcatcttatttgtaatgacggtaaaccgataatgatccccgctgacttgattcttctgattcaaaatatcaacccctcaatctttcatcatgattactttgttggttcaatcccgagaataccaaagaaggaacctacgagtgcaatggctaaaatcaggacaatgacacgattaggcgtccattttttcgaaccgagcaacttgtaaaccatccaggcaaccaaggcaggcagcaaggcaggcatgattttgtcaagaatacctgtctgcatcgttaacttaactttgccaaactggaattgtagtggtgtgtaaactttaacaaccgttgcaatcaatgtaccgacaacggtaatccccatcacggaagcagcttctgtgaaagcactcaattggttagccatggtcgtaaccagcttaaccccagaatcataaccgatatcaaacagcttaattcgaacccagaacagcaaaatatcaacgagaatccagataattgcacctagtggattgccttggagggccatataaccggcaatagaacccatgatcgtcggtaacagaatccagatgatcgtgtcaccaacgccggcaaatgggcccatcagcgatgtcttcaacgcctgaaccgcatctttggacttaatgccatcacgttcttccatggccagcgttgcccctaagatcatgccagccattgcagtggtcgtattgaagtatttaaaatgattgtccaaagcagcgacatactcatcatcatcgggataaattttccgcagaacctttgaaaatgcccaaacaacggatggcccctgctgcgtttcgtagttaaaattgttgacgcccatggccatgtaacgaaggatggcactgtgtcgttcttttttagtcagcttaggttgtgtcgcactcggctggttggttgtttgctgtacatcactcatcgtaatcgtctccttcgtcatcatcatctgaagcatcagcaccattagctgtcgccgcttccttcttcttagaagcactgatcaggttctgataggtgtaaattgctagtgccaaaccaatgatcgcaacgccaagaatcggcactttcagataagctgacataacgaaaccgatcataagaacccagatatacttcttcaaaggcatgtaatgcatcagcatcccaataccaacaactggcaacatgctacctgcaattgtcaaaccatttgtaagccacttaggaatgatcttgagcaaggcactgatggcagaaggtccaactgtgacaatcaagatcatgggaataaagttcttgagggcgaagaacaacggtccaagccagttaatcatccgcattttattaaattctttggcatgcgcatatgcttgtgccttgtgagcaatgaagttgttgacgattttaattaaaacatccagttgaatcgtcaacagcccgactggcagtccaacggcaaccgcggctcccaatcctgcgcctgtccgtgctgacaaatagatcccaacgatggtagctaagccgtagtcaggcacagatgcgccacctaggccggcaacccctaaactcattaattggaaagtcccggcaatggtcatggctgtcggtaaatcacccataatcaatccggcaaaaagtccgaccgtcaccggccagtagttcataatcgtgataccttgattatcaagcgttgcgtatgatgccaagaaaatgatcaggatatcttgcaaaatatgtggcatgatgtttcctcctcgcgcgttcttcagccaagaactcgctgattatttaatgtctttgcctgcaatggccttatcaaatggttcgggtgaatcagcgggtacatagcgaatgttcacagggacgccgcgcttttcgagttctttaaaatcagcaacttcttgttgattaacggaaacaaatttgctgatctgtgtccgtccgtcttctgcaaaaatgataccgatatcgacacgcggaatttcgatgccagcgtccaacaatttcaacatggtgctgggctcctttgcgataacgaatacccgttgggcgtcatacttaccagctttaaaattcgtcaaagctttttcagtgtcgatgatagacatccctgtgccggctggtttgctcaaccgcatgctagctttcacgtcttcatcctgactaacagcatcatcaatgaccatatagcgcttcggctgcacctcagctgcccattgattgacaacgatgccatgaactaaacgttgatctactcgtgctaatacgactgtcatattaatttcctccatatttttggtattgataccaatttttctcaaaaaagattaaaccgactgacgaacaacaacagaaagcggtaaaacgacttgtctggcttcaaccgttttttcttccaagtcatcagcgaccatattagcaatacgatcaccgatctcatgtactggttgatgaatggttgttaacggccgcgcaaccacctgactcagcagttgatcatcaaagccaagaacagcaagttcttcaggcaccttcaattgcatggtctgcgcttcagcaatcatgccagcggctgcttgatccgagccggcgatcacagcatcaggacgatgcttcatgaccatgatgcgctgaagaacatcttgaccatcagcaatggttccaacatctgtaaactgccattccaccgctggctccaagtcgaattcacgcaatgcccgaagatagccacgataacgatcactattcaaatcttcaagtttgtcattgtatcgaatagcttgctgcccggtgcaaaatgctagcttgcgataaccacgattcaagagatatttagtacccgcatacataccgccttcctgatcggcacgcaccatcaaaacctcaggatcggcaacgtattcattacaaataccaatcaaaccgtattgccgatactgcttaatcaaatcccagtcattctcaattgcgcacataatcacagcatcaacctggttcgtcttgagaaattccaaggcattcagttcgtgacttttctgaccgaatgtttgcacaatgactgtcttataggatcgctcatcggcagtgcgttcaatcgctgcaacgagttctgaaaaaaacgggttcgtaatgtaaggaaccgtcacggcaatcgtctgtgagccagaaccacgcatttgtcgagcagcttgaagcggtgtgtaacccaacttcgccatggcatcggcaaccagggccgctttgcgcggtgaaacatgtggtttgtggttaatgatccgtgataccgttgaaaccgaaaccccggctaactttgccacttctgaaatcgttgccatttttcaccgctcctccgcatctccttgattacatgaataatatagcgctttcagatttcttgtcaacgcttttttggtatcgatttcaaaaacaagccaaatcaattttgtgaatttctttttaaaagtgtgacatgacgttaaccaatccttcacaagtcaccactgtctttgataaaaatatttttccattgttgttcgttgcggtacgcttaagaaaacaagaaaggcaggtccatcatgccccactaccaactcacacaacaatcacgcttcaaaaagcacctcaagcaactcctccaagctggccgctttactcagaacgactttgaacaagtcaccaactacctgaaaaccggcgacccgctgccggaaaaatacgacgatcatgtcatcaaaagtcgcaaacctgatcgcgctttgttcattaaaggcagctggttgctgatctatcgggtagaagatttgacggtacggttgttggatgttgggcgtcatggtgacatttgacgttattttgttctactagctgaaggagaccgcttcggacaacactagtaatagaacaactgttaagacgacagtccttcatactaatatgtgattggcatacagtacaaaatgccattcgatgatcactggggattggtcattcgcattattagcggttgtttgaacggactggcgactttctttgttaaggaagtcgtttttatgtctaaccattgtaagtaacgcttatccaccgcttctcaacgtttatcttccacattgtcccctcccaccccgctgtgctaagctggcatgaggaaggggtgtgactgccatgtaccgtttgattgcggttgatttggatgacacattattaaattcacataagcagctgtcacccgctacaattagcggtttaaagacggcgattgctgccggcatcaaggttgtgccatgtaccggacgacctttgcccggcgttcatgccacattagaggctttggggctagaaggcgacgatcaatatgtcattgttcaaggtggcggcgtagtgcaaagcgctagcggcaaaatcattgctgaaaagtttctgaatcatcaggattatcaagacttttcgacttttgcggcttcggtcgctagcaacggcattgacagcaacgtcttgacgccagccggagaggtttatacggcagatcgcaatatcagtcgttacaccgttttacaagcatgggaaaatacggccggtattaaggtccgtgaaccgcaagaaatgccagaagacttcgtgattgcaaagggcatgttactgggcgaaccagataagcttgccgcgattcaaccccaagccgaaactgaatttggcaatcgttttaccgtcattcgcagtatgccatttatgctggaaatcatgccccatggcgtcgataagggctggggcctagcgcaactcacgcaacacctcggattttcagcagacgatgtcattgcgtttggcgatgaacataacgatctcgatatgttcgatttcgccgggacaagtgttgctatggctaacggccaggacattgtcaaaaaacgtgctgattttattacagcaagcaatgatgaagatggcgtggtgaaggcacttaagcacttcgcgattatctaaccgtcaggatgccatgagctttcaataagcaaatgaatggtcgctgcaactgagatattgaatcttactgcagcggcttttttcatgtctttgtgaaccatcaacgagattacttttgactgggtaaaaatgttctacaaaaaaacgtgcacgatgccacctttttgaacatgatagttgccacgatccctgttaggcagcgtcgtggccaaagctcatctgcataaagttagccgtctctaaaaataaattgttcaataattaattgtcgtctatcattgactatagattggaactattctaatatagagatagagccgatgacgaaaagtcgcggttactacataattaggaggaatttttgtggacaagccaaagatcattgttgtaggggcatcacacggcggtcaccaaagcgtcttagaactgttgcatcgttatcccgatgcagacattacgatgtttgaagcaggtgattttgtttcgttcatgtcctgcgggatggaactattcttagaaaatcaagtaaccgatgtgaatgatgttcggaattttcgtccagacgatttgatcaagcgcggcgcacatgtgttaaacaaccatgaagtgacggcaatcaatgctgatgtgaaatccgtcaccgttcgcgacacgaagaacggcacgacgcaggattatccttatgacaaattaattctgagttcaggcgttcgcccgaattccttaccagtgccaggcaacgatttgaagaatgtcttcttgatgcgtggctacgattgggccaccaacatcaaggccaagttagaagatccggcggttaagcacgtcaccatcatcggtgccggttatatcgggattgaagcggctgaagccagtcgtaaagctggtaaacaagtaacgttgttggatatgattgatcgcccactgggtacctatctggatccagaaatgaccgacattctggccaaggaactcactgataaaggtgttgagctcaagcttggtgtcaagatcgaagccttcacaggcgatgaagctgttagcgccgtcaaaacggacgccggtgacgttaaaaccgatctcgtgattcaagcagcgggtatcaagccagcaacggaatggctcaagggcaccgttaaccttgataaacgcggcttcatcaacaccgatccttatctgcggaccaatttgccagacgtttatgctatcggtgatgccactttggtttactcaatcccagcacaacaaaaggtaccgattgccttggcaaccgttgcgcggcgtgaagcccgttaccttgccgaaaacatttttgcagaaaatccagcacggccattcaagggcgtcgttggttccagtgcgttgagcgttttcgactaccattttgcagctagcggcctgaacaccttcacagctaaacgggctgacgttaacgtgcataccgctttctacaccgattcactgcggccagactatgtaccagaagctaacggcaatccacaggtgtgcgtcaacttagtctttgacccgcaaactcatcgactgttaggcggtgcagtattgtccacttacgacgtgactgcacaaggcaacgtcttggcactcgccgttcaacaacaattaagccttgaagacttggctgaagccgacttcttcttccagccaggttttgatcgtcaatggagcttgctgaacttggctgcgcaacacgctttaggcgaaccgcgattctaattacttttaaaaagacattaggcaaatgatgtcttcatttcaatcagccagataaacgattaagcttcaaaaagagccctcttgtgtcagaattctgacacaagagggctctttaagcatctaccgcgttaatcatactgtagcaaccagttgtttttcactatgctgcgttggaagtgtcaccttcgcttaactgaccatccaacaaagtaaacgtgcgatccgcaaacttttctaagcgaacatcatgggtgacaacaacaattgccttatcacgcttatgtgccagatcagctagcagctgtccgacaactgccacacgcggactatccaatgcggcggttggttcgtcggccaacacgatggctggatcgggatacaaggctcgtgcaatggccacccgttgtgtttggccgccggataaggaagccggatattgattaactaggtcaccaataccgagatcatccagcaattgatcaagttcgtcatggctgagattgttttttggcttaattttgtcaactaaagtaaactgctcgccaaccgtcaaatatgggacgaggttatatgactgaaggacaaacccgatcttatccaaccgcaaagcatcacgtgccttgccggataacttatcaagctcctgtccagcggttgtcacgactcccgatgttggggtttgaatcccgcctgcgatagtgagaaatgtgcttttaccggaaccagacggcccaagcacgagcgaaagactgccgggttcggcactgaagctaacgtctttgaggacttcgacatcgctggttggcgttttaaaatttttaatgatgtgttgtaattcgatagctgccatacaatcaacctccaatggctgtgacaggatcaactttaagaatcgtccggactgggacaattgcaccgagtaagccggtgagcaaaataccaataacaaccgcgatgcttaaaccggcggagaaaatcatcggcacacccagaggcatgaaccgcgctgtaactgccgtcagcaccccaccgaggatcagaccgaatgacacaagcatgagtgcttgcgcaatggtcgttttaacgagggtccgcgccggtacaccttgtgcccgtaaaacggcgtagttaggaatcttctgcatggtcaaaatgtacaggaagaccgcgatgacaatcagcgaaatcacaaatagaaaaccaatcatgaacgcaaacgtgctattttgggctgaataacccggcagcttctggataaatgtattcgctgtataggttttcaaatcgctgttgttaactttaaaatcagccgacttggaaataatgccgctagccgtaaaagtatccggcaagttgtgcagttttcgccatgtcgccatggtgccgtagacaaacggggcgacactcattttggcattttccgtgaaaccgacgatggtatattgctggccgtttgtggttagccgcaccttgtcgccaagcttgtagccttcatttttaaattgtgtatccacgacaatttgattgtcactttgcacgcgatgaccgctcaccagctgcatgtccttgccgatgtactgattccaatcaagcccgaccatcgtcgaacgaatttccgagtgcttgctgctggtcgcaaccgcgccgattgtaccgacataggcttgcgacttgcctagcttaatcgcttttgtctgctccgacgtcagcagcgactggctcaaattgatatccgagtcctttgccaacaccaccttcgatgtgtcccaggactcgattgcttgcgtattctgctgggcaagcccattagccaacgcactgagaataaagacaaggtaagtcaccagcaaaatcataccgatgatcaagccatagcgtaatttttcatgccagatttcttttaatgaaagatacattgtttcactccttaacttgcagctgagaaagtgctgccttcaaatgtgccaaaatcaaggtcgcgtcagccggatcagccagtacctcagaaatcgcactgtggcataacgacgcgacagcccagtcggttgcatctgcgggaacttgtagccgggccacattcaccagcccgctatttttagtgaaatgcaagcggatgaaatcccggtcacgactctcactagcctcatgcagaaaatcagctgttgccgtatatggatcttgccgcatggtcggacccgtgatacccgcatgcaaccgcccaatcacctgtccaaaggcatagcgataggcgtcatctagatccgtgaagtacttataaaaagcaccgcgagcaatgtcagcctgcttcacgatacgtgccacttgcgcctgcgctaacggatattgagaaaattctgtgatgagtgcagctaagacccgttgttgtttagctgcatcgagatgttgaaaagtagtagatgccatgattgccccctgtggtgacacggtgtcactaattgataattcgtagtttatacggaaagtgacaccgtgtcaacatattttgcacaatctttttgtgaatttttattgaatttgctattttcatcttttaaaacgacttgatatcctagaaaaaaagctgtctgttcggtcttcttgaccaatcaacagctttctttgaacacggggatatcaattcacccgcagctgatccccagggtgaatcacactcaaaatcgtcttgccattcaatgcagccagcttgtccatgtcatgtccgtactggtgcgcaatcgcccaccagctctcccctggttgcacggtatgaaaccgaatcgttggcacgcgcgcgacaccatcgttgagtgtgccagtgagacgcgttgtatagtggccaaaaaagtcgtaactcatatcaacacctagcccttgaaagttattcgtgaactgccatgtgccaacattatcgacgcccggttgattcacaccataactggcaagccacaggtttttcgggatcaaggcgacccgatcaaagcgccgcgtggtcagccaactggccatggtatacagatccgtgtgcggatatccgatcgctttgaccgtttggagaaaaacattcgtcaaccccgtcaactcaccagataaacccggatcctccacatctgctgccattaccgactcggttgacaaacctaaagccttggctgtggttccgaagaaccgtccttccgccacggcatcagcgctgttgtgataatgcgcgtaatgataaccatgcacctgcatccccattcgcgacctgccgccaattgcgctgcggccttaggattgcggtaggtggtgccttccgtcagctttaccaccaccgccttcaccccaacatccgctagcttgcgaaaccagctgtccgattccggctgccaactactcacatctgccattaatatcgccatctcgcccctcctacaacctgtccttggcatccaactttgtcatgaatttctcaatactcgtaatcaggacatccaaccgccgctcaatccgcgtcagtaaaaacacggcaatcacaacgccaaccgcctgatctaagacatacgtcaataattctttatccattttttattcctcttttcgttacgtcaaaaagttcaagtgagcatgaaccgattcaatagaaaccatcctgccatcagccgacaatctgtcgatacttggcctgcaactgcttacgtatcttcaaaactcgttgccgactaatctgtaatcgacctgcgatgccagcatctgacaagtcagccaatcgcaagcccaaaactgttcgctccataggcgtcaaaatagccgcgagtcgttgcagctgaccatcccattccagcgatgtctgcacattcaaaacagtgctggcaaaagtcgttttctgcaataaagtgatattgcttggcaaccgctcaatcacgcttcgctgccggtttttctgcattcgctgcatcaacgtcagataaacaaaatgccatgccagcttattaaacttgcgaatggcagcctcatccgtcaatggatcgcgatatcggttgaagtagttgaggtacaccaacatcccatcatcacgccaatcctgaaaatcacttcgatcacgccgaatccccaactgcgccaaagctgcatacacccccccttgatgtgcgagatacaatgcaaatcctgcctcctcctgtgccatctcctaatcccatccggcgcctagtgtctttcgatatcgatgggtttagtttatgcgggcagcgagttagttgtcgtgatcgcaatcaagtaaccaaaacgctgaccaatcaaagcgatatgtctgcactagcgcagaatttccaaaagatcgcttaaccattagcgcgcgacacgataattgcggaggaaaaaaacatcaaaaaacgcgatcggccaaaatcgtcctatcgcgcatccaccaatatcgtattgatcgtcaagtcagcctgaaaaccacgaaatttcacagttgttaattaatgttacataagagatagataaacatttgaaaaaagcgtacattttttccattagtaaaaatagcttgtccggcaacttcacatcatagggggattgaccatgcagccttcgcgcaagatcgcatccaatatttttaaaggatcgctcggcaatatgattgagtggtacgactggtatgtttacgccgcgtttgctgtctacttcagcccctcgttttttccaagtcatgatccaacgagtgaactgttggatgctgcggcagtattcgcacttggatttctgatgcggccgattggtagccttgtgatgggccggtatgctgatcgccacgggcgccggaccgggttgaccttatccatcctgatcatggccagcgggtcgctgttaattgccttattgccaaattatcagacagttggtatttgggcacctgttttgttagtggtcattcggctgtttcaaggcctgtcgcttggcggtgaatacgggacaagcgctacttacctgtcagaaatggccgagccttcacgccgcggcttttattcaagttttcaatacgtcaccttagtcagcggccaattgatcgcacttggggttcagattatcctgcagatgtacctgactgaaacagaactcagctcctggggttggcgcatcccatttgccatcggtgcagccggtgctctactcgttctctggctgcgactttcgatggacgagtcaaaccagtttcagcacatgtccaccagtcaacgccaatcagctggcacgatacgcgccttacttaagtatcccaagcaaattctgaccgtggttggcctgacgctcggcggcactatctgcttctatacttacacaacttacatgcaaaaattcatgatcaattcggttggcttgcccaaaggaaccgtggcgttaatcaacttcgccgccctcttcatcttcatgtgccttcaacctttggcgggttacatatccgatcacatcggccgacgccccttgctcttctttttcgggatcggcagcacggtcttgacggtcccactattttggctgatgcaaaccaccaaaaccccactgatggcattcctgctaatgttggtcggtctcatccttgtcactggctatacatccatcaatgcgattgtgaaagcagagttatttccaaccgaaattcgtgcactcggtgttggttttccgtacggcctgaccgtcgccttgtttggcggaacaactgagtacatcgcactatggttcaagcaagcacatcatgaaagttacttcttcatttatgtttcgctatgtgcgcttattagtctgattgtttattggcgaatgactgagacgatgcatgctgagtgggattaaccgccagaaaaagacgactttttcaatgataataagatcttccgcaatcaaaaataaatattgctcatactaatccattgactttctaatcgacacaccatatactcattgtcaactaatcaaaacatcatattgacttatgcgttgaagagaagagtaagcgtgaatccgtttaaagagactgcccggtggtgtgagggtggaacggtgaagcactgaagatgagctctgagcatcggcaaccgtgaaagcgggcgctgcgtcaggactcgataccgtcccagacatcgttttgacggtgttgttgagttggcgggagcaatcccagccaagaattagggtggtaccacgaaggtcttcgtccctgtattaaacatacaggggcgaagatctttttttgattaaacaggcaaaggagttggtagcggtggggtttgcaacattgttcgaagttttgcagcatttagcaccatacttaggcatcacattttggatcattggcgcatcagcacttttcgtacttgtatttggcgcattaatctcgttggtgcatttcagccattcgcgcgttctggaattgctttataacgggttcgtcagtctcatgcgggcaacaccagttttattgctattaatgctggtattctacggcatgccatttctattccagttagtcggcattgacatttcgtggtgggccaaaaccagtttcgccattcttgctatcggattggaaaacagtgcgtacttctctgaaaacctgcgtagtgcttatgcctcgattccacagtcacaatatgatgcctgtacatcgttgcatttcagccgcatcgcagccattcgcagaattttaggtccgcaggtttttgcggccgcactaccaaatatcgggaatacgcttatcacaattgtcaaaaactcagcctacgtctatgtcatcggcatcaccgacctatatgagcaagcccaaattatcgcccaagcatcatttggcaaacagcaagtggtcgttttcattgccttgtcactcatctactgggcaatatgtgcagctatccaagcatttttcacccagcttgaacgccgccggtcttggtcaggaggtgcaaaatgacgattttctggcaagattggcaacaaatcatcccaagtgtttggacaagcatttacatcgcactgttggcaattctttttgggatcccgattggttgcctcatcgcttggatccgtgtcaaacgtccgccaatcctcaatcaattggtcggcatctatctctcgtttgctcgcagtgtgccgatgatcgttgtcctttatattctgtactttgcattaccgaaccttacgactgtgctaaatggcggtaagggactgcatattcccgccactgtggttgctgtcgctgctctcgcactattctccagcgcctactttggtgaaactttccgcgcggcctatcaagcactcgacccggcgcaactggaagcagcactcgcctcaggactgagtaagcgcacggcgatgaaacgcattgtcctaccacaagcggccgcgcttgccctgccaaatgttttcaatagtgtcatggacattgtcaaaggcacggccattatttacaacatcggcctgctggagatcactggcactagcatccttgttggctccaaaacgtaccaattcattccagcctacctagcagcttggacaatttacctagttctttattggctcgtcagcgctatctttcatctcatcaagcgtcaagtcacatacttacactaaaaggagttcttatcatgaaaaaatctcgtcttgcactcattgctggcaccgccgttctcgcattattcctcgcctcctgtggcaaatccgacaccgccagttcgaccagcagttcaaaagttaaaacagttcaaatcgttggcccgtcagcatctcaaccctaccaaatttataagagtaaagataaaatgtccggctataatggcgatattcttgccgctattcaaaaagacctcaaaaacaaatataagttccagtatcaagtcactgaagcaaactccgtctttgtgggcttacaatctggtaaatacgatctggcagtgggcaattactactactcgactgaacgtgctaaaacctacgactactcacgcaaccctaccctactgagtgacttgcgcttggttgtacgaaaagatgataacaaaatcactgaccttgcatcgctggcgaaaacaaatggtaagttggaaccgattgatgtggctgatccgcggtatggtatcgttgaaaactggaataagcagcatcccgaacagaaagtaacactcaaatcatccggtttcgttgatacagctaaccagttcaaagatattgtgaacaaacaatatgatgccattctttacccacggacaaattttgatactgcacagaagaagctcaacgaaccactcaagctttctaagtcaatcgcagtcttcccagtggtctattactatcacaagagttcaaccagcacacaactacgtaaggatattgacaaagaactcctcaaactgcggaaaaatggcaccttggccaaattgtcccaaaagtggcttggtagtgatccctttactgcaaaaaatgatcgtgtgactgacgtgaccaagtcttacgctcaagaaaagtaggtgattttgatgggcttgttagaagttaaaaatctcaccaaaacattcaaagagaagacaattctcgccaaccttaatctgaccgttaatgccggcgaaaccttagtcattataggcaaaagtggtgcaggcaaaacaacccttctacgatgcctgaacctgctagaacggccgaccagcggcaatctcacactggaaaacaacatttacgattacagtcggctcacagcagacaatatccggacaatccgtgatcaactcgctatggtttttcaaaactacgccttattcaacaacaaaaccgctttggaaaatatcaccgagcctttaatctacggccagcatcaaacaaaagccgaagcgcaaaagaccgctcaaaccttgcttgagcaattagaactaactgacaaagcaaacttatatcctgcagaattatctggtggtcaacagcaacgcattggcattgcccgagcagaggccttacgaccatcaatcattcttttcgatgaacccactagttcactagatccggccttggtcggtacgatcagtcgtgacattctttcgttgcgcgaaaaaggccagacgatgattgttgtaacgcatcaactggattttgcccaacggatcgcaacgcaatgcgcttttctaaatgaaggccatctggtcgaagtcgcgcctgccgaccaattctttacacacccagcccaaccggaaacagttgcgttcctgaatgctgcaaaggaggcggaggcatgaaagcaacgattattggtgccggcaataccggttttgcttgtgcagcagatcttgctcgccatcatatcacgacaacggtttactcacgcgatcctgccaaagccgccaagctaactgaaaaccccttcgccatcacaggccgcttcacaactacccagcctttaaacgtcagctctgacctagccgccagcattcaatcagccgacgtcatcatcgttgccacttgggccaacgtacacaccaccgttattgatgccttgcgaccgctcattcatcgaggtcaagccattatttttctcaatggtaattggggtctgcttcaagctgttgcggccttcacaccagcatggctcgccgaaaaaaggggcagtattttggaaacatcaggcatgccttacgttgctcaatggcaggaccattcattgcacatcagcgaaatcaaggctaaagtaacggtttcgacttatggcgccaaagaagccagcatcaaaggcattaatttgctcaagcagttatatgcgcaagtgatcgagtcgcctaatattctgcaggcaagtctaagtgcgcttaacccaatcattcacgtacccgtctccctcttcaatctttctcgcatcgaacacgccgcgtcttttcacatcctcacagacggtttaagttccgccgcaagagcttacatcatgcacattgacgacgaacgcaaacacctagcaagtgccttgcacataccatacagcagcattgtgcatcaacttgccacacaatggggaacagactttgacacgctacgagaggtgtttcatggactgcctacctaccgcgacctgcccgctccagacagcttgcaatcacggttcatcgtcgaggatttaccatttggcatcgatccactggttaagctaggcgaagttctcggtgtttcactgccatacagcgagaaactagcagcatttgcacatgctgtttttgatcaggtgccggaaccggatctcggatttattaatgctgagacaattgctgctgttcagggaactgggttagcataaataaagtttcaagtttcacaaaaaagttttcggctaattcgttgttgtttgatgtattgttgctgtgcatatccttagtctttacaaacagtattaagtatatgttcgaaattcaatcctaatatcttgggatcaaatccagacaccatataaaaatgcctccaacagagaatcctctattgcaggcatttttaagttgtcggtcttcattaacaagttgtgaatcaaagaaatcctatttggcattgccaacattggcaggcaacttcgccttcgcttcccaatacgccttcagcaacttctcaaacattgcactattcggttgaatcttcgtatattgagcaatggccttttcaattccatgcgtttggataaactgctgcattttgaccgcttgcttatcatcaggattatggaaaagcaaggcacacgcagcaccgcgtaataaatattgattatctaagccaaaagactcgcattcattcgcaggaccaatgatccggtcattgggagaaagcttgcggatcggttctcggccaacacgcgtcaccggatcagataagccaggtgtcgtcatccgcttaacgaacatcgtctcaatataatcttgcagtgactgtttcgaaaaatgatacttcgcctcaagggctgctgccgattctgccatagccgccttcacttggtgcaatagtctctcgttgtgtaagacttcttgaaccgtgtgatagccgtgagcttgacccagataagcactgatcgcatgaccacagttaatgatataaatcttaagttgcaggtacatttccaaattatcaacgtattctgcgcctttaattggttcgctattaggatctaacagctttcctctttcgatcgccagttcatacgcgtcacccacttcaataccatcttgcccctgatgatgaccatcaaatacaacgcgatcaacagccgtatttggataaaccgctgcttgttcaagctgctcactggtcatctcgcctgaatcaagcatcgccttttttagaatatctgtgcccataatggcattctcacaagccataaccgtcattttaggcagatgtttttctaaccgcgccttcaaacccttcgcgataagtggcgcaacttttggtaagttacttgccatgacggatgtggtcactatgtcagcatgtgttatcgcctcaacgacaccagtaggatcttgaatggaagaaacagcatccacattgtcgattatccgttcttgataatcgtgatcaattagaaaaagtcgatactgtttctctttcctcaactgtgccactgtcttctcaacgacatctgcaaagacaatgtgatagccgctttgatgaagcaaatctccaatgaaccctaaccctatttttcctgcgccaaaatggactgcggttgccataatctccatcctctcaaaagataacttgttagtgctcactaagtttcaaaatgctgaggaccgtttgcttgtccttggcctctcgaagtttttggatattgttatcctccgtcaatgcctgcgcgatttgaccaaggagctgaacatgttcctctcccttgccggcgacgccaactagaaggtatgccgtgttgccatcgaagtcaacaccatctggaacctgcacaaaacagattcctgaatgcaaaatagaatccgactgggttaacccatgtggcatagcaactccatcgccaagataaactgataaatcttcctcacgagcaaacatctcctgcttgtaaaacggcttcacatagccaccttcgatcaggatatcagcacacgctgaaatggccgcattcttatcttggaaacttgcccctaaaacaatgttttcaactggaaacaatggtttttcaagcacttgctcggcaacttgtggcgttattgccgtttcttcggctgcttgtttttgcgttacatgatcgtcagtgtcacccaccatcgttcttatctgatcaatgatgcgttgatattctgttcgatccataaaatttttaaccgttaaaattggcagactgcctttactcatcatttctgcccgcggctctaaactttcattagtaacaatcagatctgctctactggtttcatcgccaatatctgcaaccgccatatggtccacttctggtgacaggccgactttcttgagttcggcacttaatattgaggcccccattgctgatgaacccataccagcatcacaagcaaaaataatccgatttaggtggcgcaactgattcttgggtgctaccgcaatgccatcatctttttcagctgtttgaagttcctcagaaacagctggcgcggcagggcctgcagtagctacagcagccgtgtcaaagcttgaaagcatcttactagcatttggctgccgaacaaacttgaggattagtcccgtcactgcaaacgaaaccgccaatgcgccaaagtaagcaatggaattaaccagaaggctgctcttaggcgtcatcatgtaaaaggcgaacaccgatcccggagatggcggtccaactgtgccaccaccaaaaagtgaaaggacggttagtgaaaagatattaccagccatcgggccaagaatagtcagcggcatcattaggcaataaggaaaaacaacttcagcaataccaccaaagaacatgataaccgctgccccaggagccgttttcttcgcaatacctgtcccaaactttgcaaatgctaaggctgtcccaacccaaattgcgccattagcttcaactaggaacaagattgacttacccgcttcggctgcttgttgcagtccaagtggcaccatgatgccatgattaatcgcattatttaagaataaaatctgcgctggctgcacaaacaaactggttaaaggaatcaaatcacgtttggtcatgaaattaacgccagcagacaagaagttctgaatacccgtaataataggggcaattgccaagaaacctaaaatgaccagaataaagccaagaatacctagcgagaagttatccaccaacatttccatgccaggtttaactttgcctttaacaagcttatcaaactttttcaataagattgcaccgattgggcccataatcatgccgccaaccagcatcgtgacactcgagccaacaatgacgccaagggttgcaaaagctccaatgaccccgcctcgacgtccataaatgttggcccccgccgtgtaaccaatcagtgcaggaagcaagtaagtcagaatggggccgaccaattcattcaactgcttattcggcgcccaacctgttggaataaatagtgcagttaataatccccagccaatgaaaacaccaatatttggcataaccattgcgctaagtgttgccccaaatttctggactttcgcttgcgctacctttaggtccataatgatccctctttcttaacgctccgtttgcgcttttatcatcatgatgatggtggcctattccaaattagcatgacgaggaaacatcgtgtcagtcgtctcgccggtcaatttcattaattccaaaataatggcgtcataagttaaccaactgagctgttcaaataaggtccccattggttgcaccgaatgagcagtgtcggctgcccctgtttcgtttttaggcgtttcgccaggaatcgcaatgatcgcatcggccagactgccgatttcggctgttggataaatcgtcaccgttgccaatttagcgcccaccgcttttgccttcttagcatcaaccaccaggctacccgtcgatccggaaccagagccgatcacaagtaggtcgccttccccaattgatggggtcgtggtttccccgacaaaataggcgtgcaatcccaaatgcatgagccgcatggcaaaaccgcggcctgcaaaaccagagcggcctgcaccgccgataaaaatccgatttgcttgaaagaccatcttggcaacggtttcgacttgggtgtcatcaatcattggtgcatattgatccagttctctgataattgtcttcaaactttttgcttccatgatcgtttctccttattaagcgcttacattttcatgcgaatgaattttagcggccaaagccttcgctgttgcgacaggatcatcggcatgattcaccccgccgccaacaataatgatgtctgcgccaagggcctgatattgatcaactgtgctgaccttaatgccgccagcgaccgacagctgtgagtgcttactcagttgtttaacttgcttcaatgcatgcaatggcgtttgccccactgcttgctcatcaacgccaacgtgaacgctgatgctatcaaccccgacatcctcaagttccttgatgcgggtgttcaagtcaggcacacagatcgtatcaacaaagacttgcttgccatatttcttcgccgcagcaagacaagctttgatcgtcaagatgtccgtcacaccgagaactgtgcagtagtccgcaccagctttaaaggtaagctcagcttcatactcgcctgcatccataatcttggtatcggccaggatctttttttccggaaaataacgccgaaattcgcgaacggcgcgcatcccttcttggatgataaacggggagccaatttcaaaaatgtcgacatagtctcgaactttttcggccagaaccaacgcatctacaagcgagatatcgtctaatgcaagttgcaacttcataagaattctcctcctcaaggctgatattccttttgacaagttcagtatagccggctaatgtgtatcttgcaacataaaatgtttaaattgacacattttatgtttaataatcaacaaatcgtggcgttgttgcgttgtatttgctacaatcgaaagcgagaaggtgattagccatggcaaaattaagtgccattgacagacaaaaacagctcgttgatctgatctcacatcaaggaaccatgaagatcaccgagttagccacttatttcaacgtatctcgcgaaacaattcggcgcgatctgcaggaactcgacaattctggtgccgtcaagaaatggtacggtgcagtgatgcccgttcaggatttcaatattccgccagttgaacaaagaatggccagttttcacgaacaaaaactggccatctgcaaaaaagcgctgtcctatgtttcccagcgctcaactatttttattgatgccggcagcacggcgctgacctttgcaagtctgttaaaagaaacggctggccatacgatcatcacaaactccatgcctgttgtgaatgaactcgtgaccagtcaaaatcatctcatcagtgttggcggctcggtcgatcctttgacgtttgcgacaatgggcacacaaacactcggcttcatcgaaaaaatcaggatggacatggcattcttaggcacatccggcttcgctgagcacaatggtccaagttcaaacagtcttgacgatgtcgaaattaaacacaagatcattcaaaacagtcgactgaacttcgtcttagcggacagttcaaaagctagttcctcatcactttcccagtatgcaaattggcatgatattgattacttaatcactgacaacagcttacctgccaaaattaaagatcagctgacggcgcaaacagaagttgtcacggtctgatcaggttaagttcagctaaaaaggaggtcgttggtctgtgcgatgtattctctttgacatggatgggacactgattaactctgaagccaaatactatgccatctgggaccagttactagccgataatggctatcatcttacggttgatttttatcgtcacattcttggcatgcccatgagcggtattcaacaaactttcacggaccactatgggacaggctttccgtttgatacactcttttcggcctttttgaaacagcgaacagcgctggttcagcacggcaattttgaactcatcctaggtacgcgtgccttccttaaagcttgcggccaccaccaaatcagttgtggcttggtcacttcctcttatcgaaacgaaacccaggcgattttagaaaagctcgatttagctagctattttcaattcgccttgttcggcgacgagacgcaacatggcaagcctgatcccgaaatctatctgcaggccatcgccaaatccggtttcccaccggatgaagttgtcgcttttgaagattctaagaacggcattttatccgctaaaaacgcaggcttagcggtttatcgcattgaaaatccagtcccgatagatgctgatattttcgacttggtcacggcatcttttagcaactatgatgaagcccttgaattttttcacttaaatcaagaacagttgcaataatcgggtaacggtagccccttcaatcagactaccgacctcccacgccgcctagttgattcccctgtcagacgcaatcaaaaaacgacgatccgcaaagatcgtcgtttttgggttgcaaaaatttgttttggctgcttgttattaacgttcatcaaatttcatagagaaaaataatccatcaaaaagttatcaatattaagacgtatatgctcagtgactgagcgtttctcaataaatttaaaaagcacgatataacattcgttgttctacgcaaggtcgtcacgctggaagtgactctgataaactgaagccagcagagaaggataatgagcggtggtgcctgattcggaaagtaggtggtgcctatgggactagttcctataacccacacttttaaaagaaaggtgtcatgttttgccggtgatcgctatcatcacaacgatcacagcctgtgtatgttcattggtagtgctgatcatcgtgttcacacgattgatcaaagcaacgaccatgccgcttctagcagttcacgaacttatgcaggcgctcgaagcatttcgagaaaaataggcaaactaaaagccgcgcttccttcacacgggtttcgcggctgttagttgcctaatcctgtttgccactgcttgttagctggctctgcaagggcatttgcccggccgttgtgttagcgcacaacggctttttgctgtctttagtatagcattcgcttttgcaaaatggccagctatgtctcttagtttatcccgtcagtgccagataaatccttgagtttttagatctacaagcgatctgaccgtatcagataatcacttgattattttagactcgcttcacccgcctctttaaccataaaatacctcctacgcaaattgctaagatcatttgtccaagaacaatcgctaactcattgacgtgattcccagcttgtggcaatgtctcggttttctttttggtcattgttgtctttgcgttttgatgtatgtcgtctccgcctttgccagtaatcgaagcagggggattctcgcgatcgttagaaatgctggatccggtattgtcttcaatgtttgtctctttttctgttaaaaccgtcactgtggcttctttgctgatcttgttaccagcaacatccgtataagtgtacgtaacggtataagttccctgcgtctttagatctactgtaccggtaacggttaaattagacatggccaaagcattgccatctgcgtctgttgcgctaactaaattattggccgcgttccaagcggctgatggacctgcaaccattgttgtatctttagtcacaatatcagccttggacgcgatgactgtcacggtggcttccttactaattttgttgcctgctgcatcggtgtaactatacgttaccgtataagttcccggtgtctttggatctactgcaccgttgacggttaaatcagaaagggtcaaagcattgccatctgcgcctgtagcctcaacaaagttatcgaccgcgttccatgttgctgatggacccgcgaccattgtcgtatctttagtcacaatatcagccttggacgctatgactgtcactgtggcttttttactaattttgttgcctgtcgcatcggtgtaactatacgttaccgtataagttcccggtgtctttggatctactgcaccgttgacagttaaatcagacacagccaaagcattgccgtctgcgtctgtagcgcctactaaattatcggccgcgttccaggcggctgatgggcctgctactaacgttgtatccttggttacaacagacgcttgagacgcacgataggtataagtaatcgtttgattctgggtcgtatacaactggttgctattaatatggtcagtattttcttttacaaaaacatagcccggaatcgttgctgactcagaagtgtagctttgtcctacacgaccggtctgaattttatcactggctatagtgtttccattttcatctacaaatttttcagttagttgaccagtactgttccaaattgaagtaattggattgatagttaagtcgctgatctttgtcgtgccatcgttcgagtacacatagacgcctgttgtggcttggtccccaatattttctggccgcataaagaaattttgggtaattgacttttccccatcattcgcaaaggcttcgatacttgtttcgtcaacataaaccgtaattgtaattgatccatccgcattcactgttgcgttcattttgtctcgtggtgctcccatgttgggttcaccggtattgagtctctgaacgtacaataatcccgtagttaaatcatacccaacgatcatgtcatatttttgatcatcagatactcgcaacttaaagccaactgatttcggtttgtcagcttcgtcccaagaaaaagttgcacttatcttatattgtttgccttcgtactggacttgctcatcggaacgcgaaaccgtaaagttactttcagccttgttaataacattggcctcttcgttattagcaatttctttgaccacagtattcgtcagcaagtacccgtctgttgtatcagcattctttttgaggctcagctcacgaggaagtgtcatattgccagaccaaggtgaagttttggcctcgtccacataactccaattcgactgccaagccaacataaccgttcgaccatcaggcatgttggagaaaggaatacccgcataaaaatcctctcctgaatccatcgtcattggattttgcaacgtttttgaactctcaggtacccaagttccgtcggctgtcatattaccaacataatattgcatcccagatcctgtggcatgtgcgccttgttggacactgatgcaaaagacccactttgtttcatttgttccagctaccttcatcggtaccagtgatgggcattcccatacgccattaccaacatcattttcacgttcaatcttagaagcatatgtccagtccaacagattgctagatttataaatgagggcttgctgaccagacacaactgtcaaatagtattgtttgttaaccgcatcgtagaccacgcttggatcgcggaagttggcggcatctcctccttggttcatactggttggaatgattgcctggggattagctgcattaccatccttcgaatattgaataaacgttttgccaccatcgaggctgtaagccaaatgttgctcctgaatttctgttaaaccaatccaggtcccccatccgtcttcagcaccatcattttttctagtcgcgatctgataatcagcagtgtagaaagccagaatggcgtcttttcctaagccactgacattgttagtgtcaacaacaatcgagccactgaaaatagcctttttgccgtcagcgtcaccccaatttgttgttggtacaccaacatatctaacttcgcctttatcttttagcgaaccagttgtgttggtatacgtaaagtcttcccacccctgattctgtagcattggaatggcaacgtcctcttgtgtccaattaattaagtccttgctgacggcgtggccccaagacatattgccccactgattaccttccggattgtactgataatacagattgtaaagccccgtcttgctatcataaaaaagaccattaggatcattgatccaattctggctacttgagtagtgatactggtttcggtatggttcattatactgatcgttttgactgacgtcagaggtgactgcattggttgcaattgttgcggacgatgctggttggtcagtttgagattgtcccacactactttgtacttgttcattacttgtcggcaacgtggttttcgaagtggggagcgctttgtctgaatcactcgttgttacagattttgtcaaatcattgtcagcagtatcgcttttggaagtctcttttttatcaacagttggttgactgattgtactaccaattgatgacttgctgtcgctcgaactcggcaaatcagccacacttgatgatgatgcagttgccgtactattgactgaagactgagccgtctcgcctgtcgtttcattattaggctgactaccagtgtttgtttgactaatttgggtagacgaagcacttgtagcagcgcttacattttgcccgtcattaaaaaatgaaacgataagacatgttgataagcaggcaaatacccatacactcttgcttttatacatcttgtaatgtttcttttcatccatttccaactttattcatcctcctatttgttcgacgcatttcatatacatgaaatcttctggttgccgctgtccatttaccacattttgctaagtagccttacgacaaaaaaagtcgatgagaactgaatctcaccgacttctcagtcctgccatagttgcacttatcactgataaatgaagtatctacaattaaagtcacctacaacaggggctatttggctttgggcgtaatgcccgtctgctgacgaaccttcttttgaaaatatttgattttcttgtcatagtcgtcaacaaccgcgcgaacattctgctgccctttccaacctgaatatccgaacatcaacatccccagtgcacccaagactaagagcacaatgccaacgatgtttaaccacaaggtcttgccatggaagaagtagatcagaacaatgccaacgccactgagaatggtgcaaagttgaaaccagtagcctaggtttttcaacatatgcttctgatacgcaacttctttttcgtatcccttagtcatttcgtcaattgtcattttgattttccttcttccatacacgttcgtagtttagtaagacaggccagggttgaagaaaccaactagaacaccgacgagcgaaacaacaacgagtagcagcatggtccagatagctgaaacatgcttcttcgccatcaaccaccagcagaataatgttacaagtactgtcagcaaaccaggatagatgctgttcagcttgtcttgcagattcaggaagactttgccatcagcaccgcgtaatttgagtgatgttgtgacgttaacccatgatgccagaaccccaccaacaaccatactgccgacaatcccgatagcgtgacgaacagccgcgccttgtttaccaactaagaaactaaccgcttgatcaccgaagcgataaccacggaaataaaggaaacgttggccaaagtatgccatcaatacccaggcaacaatgtagaaaatcgccccgactggtgaaccgccagtcgacataccaagggaaatccctaagagaatgggaatcaaggtcccatcaatcaatgaatcaccaataccagcgattgggcccatcaggccagcacgcatatcgttaatggtctcgccgtcaatttctttaccgttcgcacgcgcctgttccatgctggccgtgatcccgacaatcacggtcccgagcattgggttggtgttgaagaacgcggtgtaagcgtgaatggctttgacctggtcatcatgttttggatacagttttctgagaattggcagcattgatgccatatacccaaaagtctgcatatgttcttgtgagaagcaggtcaacgcaccccagaaccaacgatgaaaagattttgtcagtgttttgtgatcaagctttttcatgtcatttgtcgtttccatgatcaaatatcctcctcatcatcatcgtcacttggtccatctgctggtgctgcactaccctttgaaggtgtattgttagaaccagacatctcaatttcataaataataaccgcaaacagtaacgatacaactgtgactgagactaagttcaagtgtagtgaagcagcaagtgtgaacccaactaagaacggaatgaaatcaactgctttaccaacaatttgccgaagcagaatcgcaatcccgacacatggcagcatgccgccgaccgtgaacagtgtcttcatggcaatgccgtccattggtaaggcactacgcaaagctgtaaccgccgtagcaccgtagtatgtgagtaacattgttggtaaaaatgagaacaatgcatgtgagatccaaggccagccaaagttaacagctgttaatttatcaagcttgccattatgaacgtctttccaaccaaaggactgccaaaccaggttcattgttgcaacagcgtagtacaaaaccgtcccgacagttccgactaatgtcccaactgacttagccaagttagcagcaccgccacccagcggattcaatccttgcgaagaaatcgcaaccattgctagaggaatcccaatataagaaatagcacgaacatcggcagaaacagtaccacctggggtaaccaatgcgatataaaccaactgcatcgcaaccccgcaggcaatccctaactgaagattacctagaataatgccacagacaagacccccaaccaatggacggccaatggtataattaccaaccgcttgaccagccatacatgagttggaacataagcaagcgaaaacacctaaaatagctgcttgaaaccaactaattgtcatttttcttaccttccttttttgtgagcgtgagcaggagcgcttagaaaccggagcataagtggccttggacgtgatggtcgcactttgaccattgcggccaaggtccttatgtgcaggtttctgcgactgcgagcgcgttatcgtgagcgcgagccagcgcgggtgaaaccggagtgtaagcggccttgggcgtgatgaccgttctttggtcattgcgaccaaggtccttacacgtaggcttcagcgctggcgagcgcgttattgtgagcgcgagcagtagcgtttagaaaccggaacataagcagccttggacgtgatgactgctctttgaccattgcggccaaggtccttatgtgcaggtttctgcgactgcgagcgcgttattgttcaaccattaatacccaaagcgtgacttgaatttgtcccaactaccaatccgctgatctggcaacagcgcaaactcaactttataaccagccttctcaatcgcttcaaaggcatcgccttcctcttgggtaaaggactgattgtctccgagtttgaccgcgttgtcgcgatcattacctggaccgacaacaactgttttaatgtcgcccggcttgaagttcatatcgaccaagatctttttcatatcttgaggactcttggtgatgagaaaatacttggttgctgagttcaacaccttatccttaaccttgtcaaaatgatctaacgtccaaacgaaggtcttcttgtcagacgctgccatataggcttccttcaaaatcggattgtttgccgctttgtcgtttaccgcaataatcccatccatcgggtattccttgccccaacgaaccgtgatcaagccatgaatcatgcgatcatcaatacgtacaaacgaaattgccattttgctcactccttaaatatcgtcatcgtcagaagcttctgatgaggtcgtctgaaattctttgatggccgcggttgcttctgaaaatgctttttcttttaacgctgggttatctaaactgtctttcgacatcaatgtggttaacgccattgggaagttcatcccgccaagaacaagcgtatcttgcagcttgccatggtcgttcaaaatgttgcaaaccgttgtgagtggactaccgccgacaatatctgccagaacaacaaagcttgcatcctctggcagggtctttagcaatgcctcaaaccgtgttccaaatgttgaagctgcttcatcgggttttaaaccaaccgcaatgacagaaccaatcgcatcatcgcccgcaaacatacccaaggtttgctttaagccactggagaaatcaccgtgactgacaagaagcaaatatttcatctaaatcatccctttatcaagactatgaaaatatggatttaccgcaaaaggcgacaatcaaccgaagtacaactgaaagtgatccattattgttcggacagtattgcggttgtccccgcgaggaacgccctcccttctgcaatcgttatgtaagtcgttttctctctatatctggacgtcaacaaggttaacgcttacaatgattatgttaagcacattactaataaaagtcacgaagacgttgtgcttaatttgcgggaatagtgcttaaggggtggtttctttgaacgcagtagaaaaactttatgcgacaattgtgcaacactttccaactgaacgaatcacaactaatcaggctgccgatgcagtggggctaacacgcggcgtgaccagtagttatttatctaagctcgaaaagcaaggcaaactgctcaagaccggcagtagaccagtttactggcaagtcaagcgggaccattccgcttttgacgacttaatcggtgtccacggtagtttaagcactaacattcagctggcaatcgaagcaatcgtctatccaacacatggattgccgatcttcatcactggtccagccggtagtggcaagttgccatttgctcaggcaatttatcacgaagccattcgtcgtgaagtgcttaagaaaacagctgtgtttaaaatcattgattgtgccaactataaggatcatccagggacactcaaaaagaagttgcaaagtgagaacaatgcaacgacggcagatggcaccgccgaaagtggctacttgtatattaaaaatgtgcagatgctaggctcatcagatcaacactatcttttcacgcacaccaaccagcaacaaaccactgcttttcgttacatctattcaggaacaactgaaatttttaaagcagcgcgtgtctggttcaaaagtgcagcggttcagattaaactaagcgcttttagcgatcgacctttaaacgagcgcattacgtttgcggcgatgtaccttcaacaacaggctgatcaaatcaataaagagatcttgatcgcaccaaacgagttgatcaaactggcaaattttgatcacgtcaataacatcacggcattgaataaccgtgttcagttgctttgcgctggcgcctatgccaaagcgcctgaccacacgcagctacggcttggtcaaaccgatacaagtgcgattctggtaacgcctaaacaacagaccttgcaagcaagaatcacatctttgatcaccagcgcgttgcagcttggcccaacaactgatacgctttttaagaaactttctgactcgctaaacaatggcgactccatcactgaacagaattttcttctggcgaaagtgctcaatcaagtcgataccattgctagtgaaaaacttctgtctgtatttgctcaagccattcaaaaagacgccaaaacgtatatcacgcatgtatatggtgtaacgtttccaagcgacaatattttctggcaaaatgtggcacttgccttcgcattcgcgggtctttgtcgcgacaacttgccagacacacaatcagcactgaaaattcagaaagcaatcaagcaccgttatcctcgaagttactaccttttcaagcactttttgactaagttaaaagcgcagtatgttcaaagcccttactattatttgccattcttcatgatgatgattcattgcgaaagtaaaatcgaatcagtgcaatacaatgccatcctgcttgctcacggcgaacacaccgcatcgagcatccagcaagtggtgaattcgctttgcggtaattacttttttgaggcatttgatatgcccattgatgtgacacttgatcaaatcaacggttacgttcaggaatacctaaccgatcaaagtccatctgctaagggtaatattgtcttattcgatatgggttctttgcgccagatgttcagagaaattaaaaaggtatctgatcaagaactgattgtggtcaacaacgtaactactgctatggcgctcgatattggcctgcgcgttcagcgtaatgatgccttccagtccatcgctgaagccagcgagcaatatggtgcaacaactgaagcccaatattacgaaggcttatcaaacaagaagaacattatcgtctcttgcatgtctggcgtcggtctgtctgaagaagtcaaaaagctaattgatgcgaccctttcgccagcacttgaagtcattgctgttgactacaaagaactccataccctgctcaccaatcatgatcgaaaatttttctccaatacccagttaatcttaaccaccaccgatgttgctggcgatatcggggccgatatcgccattgatatcgtgaatgtctataatgttttcgataaggcttcctcacaaaaaatgcaaactgtcctacgcaattgtggtgaaagcccccagtccattaatgaactcattgatcgattggttcgcttcttgtcgatagaaggtatccgcggccgcttgcagatcctgaatcccgatattgtcattcaagaaagtcaacgcattgtctcccactacgaagatttctacaacgtcaaattcggatccagactaaagctcaatctcttcatgcacttgtccttaatgattgaacgcatgatgaccagcaaacgcagcactacttcaattgatcgcgcaaccttaaccccccctgagcaagaattcttctccctttccagcggcatttttcagccagttgagcaaaaattcaatatcaaggtacaggactacgaaattgctttgctttatcaactgctcaaggactttatttttgtggcgtgatcacatgacaaaaaggcacgaaggtgaaccataatttcctcttaggacttgtgattcattaaattccaaataatccacgagaagcaaaggcccccactgtctgcagcacagcgggggcctttgcttacttgagcctaacaagtacctgtaagtccatcaaaactaccacttaaaagtattctctgaacaacgcaactcatcatgagcagcttcatatatttgacaagggattcaagctatatctgcgacatttcacgcgctaattgacgatgtttttcatagaaaatcaagtcactaaaaaaggaaccagtctgctgctgtttgaaatttattttcaacatcttgagctttaccttctatgtcaaaaaggagagtacgttgctccagcgtaaggtgatagttatgctcggtcatttcatctctgataaaacgactgattggacgcacttgtgttgaaatatcgatagctaccgttcggttcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggtactggagtgtttttgacttaagctgttttattgaagcagcattaagttctagaacgcaagcttgtttatcgtttcatcttatccatatccgccaacgggctattgtacaacttagcatagaacccaccagccgctagcagttgctcatgggtaccagattcgatgagtttgccttggtcaataacgaggattttgcttgcattgcgaatcgtggataggcggtgcgcgatcacgaagctggtgcgctgttgcatgaggcggttcatggcatgctggacatcagtttcggtgttggagtcgatggaggcggttgcttcatcaagaacgagaacgggtgcttgggctgcgaaggcgcgggcaatgctgaggagctgccgctggccttgcgagaggcggctagcgttttcgctaagcatagtgtcgtaaccgtctggcagttggttaatgaagccgtcagcatttgcggctttggcggcagtttcgacttcggcgtcagtggcgtctggccgacccatgcgaatattttcgcgaatggttgcggtaaaaaggaaagattcttgctgaacaactgtgacgagccgccgcaaactagcaaaggtaatttgggtgacatcgtgatcatcaagggtaatgctgccgctggtgagtgggtatagatcggtgagcaggttcataatggttgttttccctgcaccagtcggaccgacaatggcgacgacttccccttgatgagcagtgaaactaatatcgtgtagcacctcggttttaccgtcataggcgaaggagacgtgatcgaacttaacattgcccgctgtgtgatctaactcgacggcattcggggcatctttttcaggctcagcatcgacgacttggaaaacgcgttcggccgaggctaaggaaagttgcaaggtgttgataaggttcaaaatattgttgatcggcccagtaaagttgcgcagatagatcaggaaggtgaaaatgacgccgactgtgatactggtgccaccgcgaagaatggcaactgcaccggcaaacgtgatcagcaagtaggcgaagttattggtcatgttattgaagggaccgatgaccccggagaagagttgcgcgcgataagccgcagcggtatagcgggcattggtttcattgaagcgatcaatggtatcttgctgatgatcgaaaagttgcaccaactgtttaccagaaacattttcttcaatttgggtgttcaagctgcccaattcttgttgctgaatcgtgaaggctttttgggtgatgcgtgctgcggttcgcgagtaaaagaaagtcgcgacagacgccagaacgacaatgccggttagtagcgggctgagtagtaacatggcaatacccataccgacaacactgataataccggtataaagctgtacaaaagtttgcatcagtgcggtgttgatgttgtcgacatcgttggtcaatcggctcatgatatcgccgttatcatgcgtatcaaaataccgcatcggtaaacgctgcattttggcaaacaggtcgtgccgaatcgcagcactagtgcgttgtgcgactttggtggtgatacttgtttgaaaatacgtgaagatactgctcagaaaatacatcccagccaacaaaccgctgacaatgaacaattcgcgcagacggcctttggtgataaactggtcgaccacgatcccattgacccggttgccaacaatggtggccaacgttgtgaataatgtgaggccaaaaacgataagcaacttgcggcgatctgtatcgagatagccccaaatccttcgcacggtttgtttccaatcaactaaggtgactttttcggggtgcaaattacgtggcccgcgtctgccgttgagattaatcaatgtagtcacctcccagttgggtttgaaccagttgcgcgtaaaatggcgaacttttgaccaactcggtatgcgttccgcgagccgtaatttgcccgttttgcatgacgatgatttgatcacagtccatgatgttcgggacgagttgcgaaatgatgatggttgtacggttgcggcgggccttaaccaaggcatcttgaatctcagtgttggtttcctgatccacagcactggtagcgtcatccatgaccagaatatcaggatcggggatgatggcgcgggcaagattcagacgttgccgttgaccgccagaaaagtttttcccagcttcttcgacgggggcatcataattagtcccgacaaactcagttgcctcagcgatagcaacgccgctggctaattgtgtcggcgtggcttgcggcgcgccataactcagattatgcgcgacagttccagaaaaaagcagtgagtcctgtaaggcgaccgtgatctttttgtgtaaagccggtaaggtaatttgttggatatcggtgccaccgaccgtgattttcccttgataatgctcataaagtcgggttaataaggcgatcagcgtggttttgccggaaccagtagaaccgataatgcccaaccactgcccacttggcacggtcagattgatatcgtcaaggattggccgactttgcgaaaacccaaagttcacgtgctcaaactggatggtactatcagctggggcaggtaatgtcctactggcctcagtgcctgcttcttcggccaaaacggcgttgacgcgtgcactagaagtgatcgcccgcgaaaaggtcgtgatgaggttaacggtattggtcatcgccgtcgtaatttgaatcatgtaattgacgaacgccatgatttcgccagtggtgatggtgcggctgatggctagattaccgccataagctagcgcggcaacgactgccagattaagtaccagcatgatcagtggcgccaaagtgactgttgccaagacggcacgctgactaatcgtttgcaggttgcgattttcagtgttgaattgagtcagttggtggtcttccagtacgtacgccttgatcgttttggcgccagtcaagttttcactcataatccggttcatgacgtcaacttgtccttgcatcgccgtgtaaagtggcagcgaccggcgcacgatgacgtagatgtagatggcaagaataggcaaggcaatcaaaatgatccatgacagccgcggcgacacaataatcgacataacaatgccgccaaatagcagcataggcgagcggacgagtccgcgcgtcagcatgcttaccagcgtctgcatttgcgtaacatcgtttgtgatgcgggtgatgagtgtttcgggtttgagtgcttggggatcgcgatcggccagtgaaatagccagcagatgagtccgcaggttttggcccattttcaaggctgcataggaggagaaggcgttacagatagcacctaaagcgaacgcagcaatagcaatcactgccatgagaatagcggtatgccaaacataagtcatatctttcttagctaatcccacgtccacgatgctagccatcaaggtcggttgttgcaggtcaagcaatgcttcgcccatgatcgctaacggcgcgagaaaaaaacttacccgtgcccagccgtgcatatggtcgaacaaaattttcagcatgtcagttgcctccgttttggttattgagctcattctatggctggattgaaaaagatgcatgtgatcagcttgttgaatgggtagacaaaagatgcttcggtgctttttgaagatgaagaagtttccagagaagttggaggttgaagtaggtagatagacataaataagccgccacggaaagcttgtacagctccgtgacggcttatctttaaactgggttgctcgtgaggctcgtgatggcttaagttatcacaatcgagctaccgttaagcaatattgttgaaccatagcgtttgctcccatcagcaacgcttttggtacactcaaattctatcatgcactactgagataaatcaacggattagcacgttttctatcgatgcctctttttaatatataacaaacggtatatatggcgtgagctaatagcgactgatagactggaaacgacaatgctacgcgacggtggctctttcttaagaaggaggtggtggctatggttttagaactgtagggatcacaaaattctttgaaaggaggagcaagatgtcgatctatgaagctttgagccttatgatcatgttcgggttgtttattctcggactgattactctggttctgaagctgaacgatcggtgatatcaaaaagccgtcacgatatgcttagtcagctcgtgacgacttagtacaataaacgagctgccgttgagcagcattgttgaatcatggagtcgctggttcctgccagcggctctttttgttacatctctattaaaccataccaaggccttttttgtaacaatctgtccacacctttaaaaacaaaaaagaaaaaagccaccacaattcgctgaagaattgtgtgatggtttataaatagtgcttagtcaagagcaaaagattatcaacagttgcccaaataaaaggtgttgacagattgttgcggctcaactgacgcagctttctacgttattcaataatcttagacttccgcgtgatatggtgcattttctcgatccacgggcgaattggttcttttaggaaaagccccagaaggaagaacgcgacgccgaatgccacgaggatgatgagatcttgccacagatttggccagtagatcccgccaacggtttcgcgcagcaagttgacggcataggtgaatggcagccatgggttaatggcttggaagaacttacctgagagtacaacggggaagttgccacctgcgccggagatggataggactaaaataatgattcccaggcccttaccgatattgccgaacagggaaatcaacatgtatagaattgagacgaagactaggcttagcaacatcgcaaacagcaaatacagcggcttgtcgacaacgtacgtcccgattaggaagagattaccgagtgcggcgatgaggccttgtagcatccccagtcctgcaaacgttaaccagcgagcggtgtacatctgtttgacggtcgcatgagccagcgattccggcagctgatattcggtaatgagaatggcgccgagcagcaaggcaccgacccaaatacataaggctaaataaaacggggcactttgtgagccataggttgggatatgatagaaactcgtttgcttgagctctaccggtttagctaaaaagccggcttctttcgtggcatcacgtctcagcagtttgatcaactgcgacagatcaacggatttctcgccttttttgattgccgttgcgcctttttgaatggcatctttcaatgttggccagtcatctttgattaaggtttgcgcatcatccagcccgctttgtagttgcggcattttttcgttggctaaagcaagcgttgatgtcaggtcactttcaacgcctggcaggtcttgattgatgaaattagttgccttggtcaatttcgttttaagacttgggaagtcattttgatataagtcagcgactgtcgtgataccactggtgatcaagttcatatgaccgttcagcagcgtattggcatcagtgagttcctgcttcaaggctggtaactgtttttgggttttaaccaaaaaagtgttggcttgtgtcagtaagtcctttgttccgctgagtaaactcggcagttccggcaatacttgatcgttgattttagtcagcgttgtggcagcatctgcaagcgcagtcttgaaagcgttcagtacttgcttcacactcgtgccgagatccagatccttgagcgtattggcatcacttgcaaatttctgagcgacatcattgagtgtcgccaaacgactttgtaactcattggtacttaaatttggcacgtctttggctagatcgctggcggccgtctgaacagcagtagcggtagtcgcaacatcacgcagtcgcgtaatggcaccggccaacggttgatcgtccttaccggtcagcttgttaagactggcttgcaggcgggttaatgtatcggccagactggtggcattggctgccactttgccttggcgatcagctaaagcggttaatcgggccaccattgcctgtttgatagcggcggtatcactgctagtgtccaactgctgcaactgattttgcaaggtagttaagtcagcacttaaactagtattcgcggcggctatcaatgtcagaccagcatcgaccgcattttgaaccacatcaagtgctgtgctgacctttggcaagacttcatctttggtcgtgccaatcgctgtctgggcgtttttgcaaaagtcggtcagagcaggcaaagtgccgtcaacttgattgacgacggtaatgccctgactggtgacccccacggccttcgtaaccgctgattctagttggccaaagttggtggtcactgtattaagctgcgcaccggcttgttgcacttcaggcaacttgctgcgaacattgaccgccaactgaccggcatcggctaccattggtaaatacccgttggctgccgttaatttttgggccatttgattgacttcaggcaagtaggtggccatttcgttggcggccgccagtttttctcggatggccggcattttactctgcaaaaccccgacttccgcgatgtatttttcaattgtcggtaattgatcgtttgtattggttaccagacttgcaaagcgccgaatcatcggcagattgtcatccagcttaatgcctgcctgattgaagacggtcaccaaggttttggcaacggttgacacaaattcgtctgaaatggtgttttgcagcgtggacgccccgcttgcagtaattttaggggcgatggcattaattttttcattcacataataatctagctttggtttgtgaatcttaccatcgacaaaactaagcaagtccgttgaaaaatctttgggaacaacgacacctgcgtaatatttgccgcttttgaccccttcctgaaccgcctttttggagtccacaaaacgccagccgagttgcttgttatgctttagttgggtgaccagctcatcgccaatggcaatttttttatcacggaattcggttgatttatccgctgaatacacggcaacagtaagatcttgggtattgctgtaaggatcccatagcgcccagacattgaaccaacagtagagactggggatcacaaccagcgccaaaatgagtaagaaagcgaatgggcttttaacaattcgcttccagtccagtgcaactaattttcctatgtttcgcattgtgctcctccagtgattttcaaatttgtatttgtagattataacatgcgaatattgaaaagttttttaatgcctaagctgttccccaatcatcttttcaaacctttgtcttgacattcacaagcgcgggccgtatagtccttccaacaagactttaggtgttactcagcacaactttcaaagcgagctgaatgacatttataaaaacaacactttgagaagaagagtaaccttggcgcagacgctgtagaaagcccggttgatggaaaagggtcatctgcaagaaggtgaagatgagcttcgaatagttattcgtgcggttaacgctcacgagtcggttacggccgttatgctgtcaggtatcaacaggtactggagacgatgtatcaacatcgtgaataagggtggtaacgcgacactgtcgccccttgactacaacaaaagtagttaaggggcgtttttttgtggcagcgcaaggttatctaaaataaatcaaagttgtttaacgagatggtcttgatagtttgctggtggaaatgtttggaggaggatctcttatgagtcgttggaaaaaagctatcttcacagggattgcattggtttcattattaacactaacagcatgtggcaaagcagctagtagcaatagcagtcatactggttcaaaaagtgagtcaatcatcatcggcagtagtggctcggattatcaaatttggcaacatattgctaaatcaccgcaggccaagaaggctggtctgaggattaaagtcaagcaagtttcagatggcaacgtcactaactcagctactgccgagggacaattggatgttaatgcattccagtcatatgcttactttcagcaatataacaaattaaatccgagcgaaaagttagcagcattaggcacaacctacctggaaccaatgggactgtattctaaaaaatataaacagctgcgagagattccagatggtgcaacgattggcatctcaaacgatcctgctaatgcgacacgagggttacttttgctagcaacggccaagcttgtcacccttaagtctgacttcaatgctttaagtaccgtgaaggacattcaagccaatccgaagcacttaaagtttaaagaggtcgacccatcggtgcaaatgctgcccgatttggacgcagaactgatttcgaatacgcgggcacttgatggtgggctgaatgttttgaaagattcattggtgcatgagaagttgaaccaaacgacgcgcgccaacgtcaatatattagtgactgcagtgaaaaatgaaaaaaaggaagaatttaaaaagttagtgccgctttaccatgacccaacgattcagagttggattaaaaagactttttctggcacgaaacttgatgtgaataaaccgatcagttatctccaacaaaaataataataatgagatcgctgtgaaaccagtacttatggggctgtagagcagctttttgttgaaggggatcgagccattaagcatttcgggttataatgacagtaatcgtaaaaattaagctttaaacactgacatttattttcgaaaggggtcgttgctatgtgttcttcaatgacaattaaatcgctacaaggtgatattttctggggccggaccatggattacaacaccagtttctttcatgaatcaccagtcggcggggttcctggtaaaattgtcagtttgccagcaaacaaggcattaccaacacaaagtgccaaatggaccacaaagtatgcagcggttggcgtcggtattgatcaaagtacggcacttttcgacggcgtcaatagcgaaggcttggctggcgacttgcaggttttggtagagtgcagctgggcgagtgcagattctttgaaacagcgtgggctgaaagctattaaaggcgaggagtttgtgaccttggccttgacgacatgcaaaaatgttgacgaagtacgcgctttggcgggtgagtatggcctgctggatgaaccttatgagtttggcggccaaggggtgaaaatcccattacattacacatttgttgatccatcaggtaaagggattgttgtcgaaccaaccgatcacggcgcctttaagctgtatgatagtatcggcgccatgacgaatagtcctgaatacgggtggcatgaaaccaatttgcgcaattatgtcagtctgaatgacaataactatcctaaggggtccgaattaggcgactaccatattgagccgattgagttaggcacaggctacgggatgttcggtttgccaggcgattacacatcaccatcgcggttcctgcgggcaatgtttgtttcgcgtaatcttgatcccttcaacagcaaagacggcattcgcgtgttatacaatgctttcaagactgtcttgattccgcaggggctaggtcgcgacccacaacatcaggttttaacggattacacgcaatactggtctggctatgacctgacgaaaaagacgattttcgtgcaagattcagacacattgacaatgacaacgaaaacacttgatccgactattactgacgtcacttatgaagatttggctaaaactgaacagttcaatcaactgtagactgacatcattgatatgaaaaaaggcaacaccgaacgagagaccaatcattggttttgaggttcagtgttgtctttttgatttgtcatctaacgagccggagtggtgacttggtatcgttatttatcgtgtttgtgcttttgccacccagcgatcggaacaactcgattattcgttgtcgtttctgttgggttactagtaggttgttggggtgctggtttggcggcaacaagttcttgaacgcgactttcggcagctgtagcaagtgcctgtcgctgggttggtgtccacaggtgggaggttgttgtagatcgaatgaaaatagcgaccatttgtccaatgactgcgcgctgatcaggaccaatggtttttttgtcatatagtagcatggacatggcagccttaatgtcctgagcggtccaattctttggatcgtgcccgaacaaactctgaatcgtgtgggcaaggaacaacgtggtggcaccaaagagttcctgattctgaactggcttaggaacctgcagccacgttttggattctaaaaaggtcatcgtcaattgaaataactcagccatattttcggaatcaaagtcaacgtcattatcggggtcactgaaggcatcatcaacaccgggaagatcaaaatcatcattgccgaatggtgatgtgagggcctcctcttccgtcaaaccgagcagataggtggcagtgacgaacacgttcattaaggcatcaacaaattcaaggatagtcaatttaatctcatttgttgcaatcaaccagatcataaatgtttttaacagttccgccgcgatcgctaacgactcgctgcgatccaatgcatcatcatgataagtctgtaaggtctcctgcaaaccagctgcaacgtgttcagtatcaagtgcttgaatggttgaacgaaggttatcaaaggcatgcacgaaaaaggtgacgaggattaatcgaatttcatctggtggcacctggctaaagccgggaactgtcagcaggtgttgataacttgtgcttttctggaaattttcccagtatttatcgatttcgcgactggcatggcgtcgcagttttaattcgtagtccatgatctgcctccattaaaattggttggattcactaagaacagtttaacagtaacaagcctgagctgatagctgttagcattatttttagtgcacaaaaaggaaaagcgttgcccatgcacggacaacgcttttgatattgaacgttattattcaaacatttttttcgtggcacgcatcaatgtcttgatgtctttatcataccgcggtgttttaactaaatgactcattggaatgccggtgaaatgataagcggcaatctcacctgaacgaacagcactttgctcagtgaagaccatttggaatggttgttcagcgaactcaccggtaaaggcaaggtttgttgaatgtgctggaatcacgtctggccgatcaaccttggcgcgattgttgaagagtgccgaagcatatggcatataaacagggatgttgttgatgatgcttgccataatctcatcttgatgatcacgaatattaccaggaccgggatcaactttagcaagctgaccaatcaattcaagggccatctctttacccgtcatttcgatatacggcttgttgacaaattcaccgtagcgccgtggataaaggaagtagccccacaagacggtctcgtttggtttctgggtggtaaagtgcggctgatgatgtaccacgattgacatcataacatctttttgcccaagtgccgtgattggttgggttgacatgaacgaattcagggcgttaccagggacttgcgttgtaatacgttcgatttcgttaagcaacaaatggtctttggtcgtcaaggtgaagctgacccactcgctggctgaccgatccgcaaagaacttatcaggattaccaaggttataaaaatgctcagtcgcttgtttccacagactcgcggcagcaccgtagtccatgttttcgactggtgcatgatcaaagtcaccttgagttgcggagtcggtgatcgatccattcgtgaagaaaacggcggtatcatcatcaacggtaacatgttcttcgtcatcagtctctgtgttcagaatggtgaggcccgtaactgtaatttcatcggtcatggccgtgtctttaaattcaaacgctgtgacacgccggttcaaaatgatcttgcagccttgctccttcaggtaattaatcagtggcagcataatgctttcaaattgattatagcgggtccggttaacgccgactaaatgctcaatttgagtaaattcataaatcatcatgtgcatgtaccgccgcaattcctgcgcagaactttgtgtgcggaaggcaaaggtggtttcccacatataccagaaattggtttggaacatgtgcggatcatccttgaagtagtcggcgatgctaacattgtcgagcttttcttcttcggaatcaggcatcatgattaacttcgtcagcaaaaggcgatccgtgttattcaggcccaagtgtcctgcttggatgatgccaataccgccttccatcaaccgagctttatcaaacgtccgatgttgtgcatcgaattggcgcgtgtcttcttcagctgtgagtcccggttccgttgccgatggaatccgactaagcaaatccatcaaatcgacatacgtccggtaattcaacatccgaccgccccgagcaacatagcccttcgtgttttccatgggatgatttttgttccaatattcatccacagtatcgactgttggggcaccatcatttgaaccatggtcatccagtgaatagaaggtgatttgatcaccttgccaatgagcttcctgaatgagataaacagctgcagccatattggccagccctgcaccgatcatgatcgccttatgcttgatcattttcccgcctcctagcgactttcgaacttattgtatgcgtcagcgtcatctttaaacagctccattttgtttgcgaagtagcatgcggtgccgccagcaaccagcgcaacgcctagcgctgtcaataagaatttcttcatctaaaaacgcttcctttctgatgtcacctatattataggcacaagtaaaagaagcgtctttagtcaaattgtgatgtttgttcgaaaattaacttttattgtgggccaagtgaccgcttgcggacaatgaaagcaatcgacccgtttaacatcaaatcagcccgcttgatcagattccgttccggttctttcaaggactgcgctaaccacagcagcacttgcccgacgatggctgcaccataaaagttgcagatatcggcaacggtttgggctggtgttgctgggtcaatgtccaaaacgactggtttcaccatgtcggtggctgactgaaataagaattcttccagcatgtcacggccaactgaatgaaacgcattcagacaaaagatctgattagccacgatatagtcaagcaccagctgatactttgtttcccatgtggctgcgcctaagtcctgcatcactttacggccaatgtcagcctctaaggtccatttcagtaaggcatagatgtcatcaaaatggtaataaaacgtgttgcggttgacatgtgcagctgcgcttaactcggcaatcgtgatgcgatctaatggtttgtgctgcatttgtactttgagaaccttggcaagatgcgccttagtttgatcagatgtggacatatgcaatctctcctgtagccatggtcaacatttttggcatgaaaaaccgcttgtcagttgttcaagccgacaagcggcgatgacttactttacctttagtggtttcaattgcgcttcgattttgtcgagggtgacgttggcttctagcaatgctgcggctgcataagccccttcaacaaacgcgacatcataaacatgcatctgtttatcactgacttcttcggcaatgtccaaattcattttcgcactgccgaggtcgtagaaaacaagcagttcagaagctggattatcgccaattgctttttgaatatggtcgagatccgtgccgattttgccgtcgctagtaccgccagctgtggtgatgggaacatctttagcgacttgtttgattaaagtttcaacaccattggcgatcgccggaacgtgtgaaacaagtaaaatgcctagtgccataggatcactcctttacaagtatttgccttcatagtttgtcggttgtcgatcaagcggtcgcatctaaataggctttcaacaattcgccagttgaagcggcgccgggatcaatgtggccgacactcttttcaccaagataagacgcccggccgcgtttagcgatcattggctcggtggaagcaaccaacttgtcaatggcggcgtcatcgagcttgccttgtttgatcaaatcagctgctggtgcccagacatcaagcattgtcttatcgccggttttggcttggccgcgcttagcgataccctttgcggcagcatcgacgaggtcgccaaaatcggtgtcggttttggcaagcttagccatttcgagaaaagccgtaccatacaaaggtccgctggcaccgccgactttgctcagcatggccatcgcaattgtcttgaagtcttgagccagatcggcagtcggtggcgttttttcgaaggccgctttgatcgcttcgacaccgcgctccatgttgttgccatggtcagaatcgccaatcacgcgatcaagttcggtgagatagtctttttccttggtaatgcgggtttcaaaattcgtcatccatttggttaatgtatcagcgtttaacatcggtatccccccaaccaacagtgtgggctgacgcattcaggtaggtcagccattgcggatcgtctaaagccaacatggtcaatgagatgccagccatgtcgagtgatgtgacatagttgccagctttggtgaagctgacaggtaacttttcagtcttcagttcattcagcacatcgcccatgaaaatgtattgttcagacaacggggtagcacccatgccgttaaccaagacggcatacttgtgggcttgtggatctttgaactccgccgtcaacttgctaatcagttgcttagccaattgtttagaggtcggcagtttttcctgaccggtgccaggttcgttatgaatgccaacaccgaattcaatttcatcaggttttaaatcaaacccgggtttgccgacttcaggaaccgttgcagcgtgcaatgctacggcaaaggacttggtgttcttaacgacggcatcgcctaacttcttcaggtcatctagacttaaaccagcttcagcagccgcaccgataattttttcggcaaaaatagtaccagcgacaccgcgccgaccttgcgtgtacagtgaatctttgacagcaacatcgtcatcaacgactacggattcgacggtgatatcgtcaacactggcaaggtctttggccatgtcgaagttcatcacatcgcctgaatagttcttgacgatcatcaaaacgcccgcaccttggtcaacttctttaatagcagcgtaaatttgatctggggtcggggatgtgaagacttggcccgccaccgcagcatcaagcatgccttgaccgacatagccggcatgcagcggttcatgaccggaaccgccaccagagatgacgccgaccttcttatgttgtttgaacgcggcatcatttctgacgaccgccgttgtatcaggaatctgtttcaaatattgcggatagctggcagcgagtccagcaatcatttccgggacaatatcgcccggtgcattgatgattttcttcatatttgcaactcccttctagttatcagtgtaaccctaacaatgctaaaatacagtgattttctagcagatattgatgttcagattgccttaaaaacggtgatggtgcatgtcatgctgaggtgggtgggtatccagcaaaatcaaatagatggcaatgctttgctgcagaaggacgcataagaaaacccgttttgctgatagcagtcggcaagcgggtgggaaaaacttttaagggtgcatggttgatcaacttatcttaatcataaagtaagtctaaagtctttgcaatcgcttacacaaaaagacacaacaaatttgactttgttgcgtacgcgcctggcagaagacacatctgaaggaatcaggcttcgatcattggcctcgggcagtttagtctttaaaatcagtcactgtttcgatcgtataattgccactatttttgagcaacttcgaaacgggacagcgattttcgatttcgttggtgaaagccttagcagtatcgaaatcaacgcctttgaccatgacctgggcgtgcaccaaaaattgatattcagcgcgggcgccgatgaaagcgaccttcacccgcacggctcctgtatgcggcaaaccgtgctccttttcaaccgcttccagcgtggcttctagacatgtgcttaatgatagccccaaaagttgctctgggttggttccgggatgatcattcatcggactgctggtttgcactttaagtccgccgggaatataagcgtggccctccagctcttcgtcattaatagccgtcgttgtatacagcgggtggttccagcgttcatcttgcatggtgatgcctcctcatataggtcattgcggtaattcaagttttggtgcgtggatgttaaaccgagtttttcttgaagttattgaaattgaacagacttttgtctaagttgataactctattcagtataagcgcttacatgatcttcgcaaacagttaatttttcatggcacgaatttttcgatgttcatgatttaaaaatattagaaatcattttataagcgatcacgatcagaatgaaaaagctgctcaacccagaagctattgaggtcagcaaaagcatttctgcgccgatacgctcatagaggattcctacgattaaggcgataacgaacgttgccagatcaagaagccacaatttttgcatgtagtttatacctcactattagatttacacgatttttattggtcaatgattgagtgcgaaaaatgacacgacaaccatgctgtggcagatgccaaactatatgaggcaacttcagatgctgctttttttagcttacccttctattcttggcgttcatgttaatatgaaatcattcatattttggcaaaaaatcaaacgaggtgttcatgtgttggattattcggcaggggctatttaccacgaggtgcgtcggcgacgggacttgcgaatcaaggaagttaagggtgatttacatcaatccacgatttctcaccttgagcatgatcaaagtgatatgacgctacgcactatggtaaagatacttcgcccgacttttatgtctgctgaagagttttgccgtctgatagacaacggaagtgaaacatcaactgcaatttttaaacagattgctcattattatgattcgactgacttggcgggtttatacgacttgctagcgtcttataaagagcaaaacattctgacaacgccaaataaaatggttattttgatgattcaaagttgtattgatgaactatctcaacatgaaactttattttcgaaagaggattgtgatttcgtgcaagactatcttctcagaccgggacggtggtttagttttgagtacatcgtttttgccaatcttgcattctcaatgccagccaagatcaatttgagaatttccaagaagatgtttcatgcttatcagcaatttcatttacctagttacgatgaattgatagtgaatgctctatacaatttatcaatttcttttcttgagcaagatgatccttcttcggccattcaatttttaagttttcttgatttgaaaaaattggatcatcatgttctctatatgcggcatcacgtgacttttttgaaactcatcattcaatttatgttgaatcccttagacgtaaaaaacgcaaacgaattgagaacatttttagaggcaacgaagctgattgatgatgtactttttgagaaaaatattgattggatcagatctttgaaaattaacccaaaaactattttgaaatgagatttgaccatcattcacagtcaccaagaaaaggcaaacagtttccgctataaagacggaaactgtttgccttttcatatggatgatttattgcaattttaaagatctcagtgccaaggcggagcaatcgttggccagatggggctcgaagcgccgtctccgctctagcttcgtattgccatcccatctggccggagattgcggagtttggcatggcaaggaattcttaagcctagatccttctctgactattcggaacctaatgaatcaccagttcactgcgagaattatgacccatcctctagataatggctcgataattgaatggtggaacagttagctggtacttggatcaggtttctgataaggttctgggtcattggcgtgctcaggtggccgttgttcaaagccaatgtctttagtgatgagtggactgccttcccagatgagatgttccaacaacgccattgtggtttgcgcatcgctcaaggcggtgtgggaaggcaaatcaaccccaagcgcctctttgtaatgttgcaacgacggggtgtgctttttgccgatgccgaatgttttacgtgccaaagcagccacatcgaaggcttgcactggggtgatatcgacattcagtcccgctcgtagcgcacgcaggtcgttacttaaggcaaaacccacaacgagttcatgcttcaacaattgttcaacggcagctttggcaagtggcaacggctgaccatattgggacaacagatcatcggtgatgcctgtgattttgactgaaaatggcatgacgtggtggtcctcaggtaattgggtaaaaatatcgaaggcgccatcaacttggtgatggcgtacccggagtaaactgatttctgtcagatcaagttggttgcgatcggcgacgaactcagtgtcgatgacgatgtagtcgccgcgtgccagccgatcaacaacgtccttttgcgagcgcagtggggcttgatctgaagctaatgtggccatggtagctgcatcaagttgaattgacttagcagcgcgatcattagctgcttggaccaacggcgcttcttcaatggcaaacttggccgcaagtcgcgttgtcaaacggtcggcctgctcttgccgttgacgacgcagatcagttaaagactggtctggattgcctaacgaaatgccgaagagtctggccagccaagtcgcaggagcagttggcatgctggtcaaaacataggcgccgttaagatcggctagggagaaaacgacctggccattttcaagccaattttgtaagccaattgcaaggaggtgcacccagtcgctaaaaggttgcatgatcaacggcaatttgttggcggctttcatttgatctaactggtgagctgccccagcgacagctagagcgaggccgcgcgtcagacttttgcgatgattaccaaagtcttgaacagtgaatgcgattgggagtaaggcgccacgcggtcgtaaggtatagcgtaggcgaccgccttcaggataccagcgcgcgaggtcaaactgaacctgcccatgtgtattgacttgattggttgaacttggctgctctggacggtactcgcgatgttggagaatcgccatcatctcatctaagcgaatgcgaactgcggcggcattgtggggttttacgatggggtcacgcaacaatttattcaattgtcggcgagcctgccgcggtgagcgtgtatttctttgccgatcagttgtacgagccatggtgacacctcctttgagtgaaattttgaacacaggaatagtataccaagtggacactagatttcacatttttgccatgattattcgagactagcaggtaaaaggggcctttacccatgaatgtgggttaaaaacttatttacccaaaacatgaaccgtctatggagaattgaaaagcttattttttcaaaaaaagtttgcttacagattaagtttgtggcataactgttgtatgaatatcaaacaatcaacagacgaaactgccttcaaacaacgaattttctttgctttgtctgaacctggtcgctatacgattgtccgcatgctttaccacgtcggtcatgagatgggctgcaacgagctgaaccagcacgtggagattgacaaatcaacgatgtcatatcatttgcgaacgcttcgggaaattggcatgattaccacgcgtacccaaggacgacaaaaatttgttacgctgaatacagggaaaattgaatcggttttcccgggtttacttgagaagctataaataagcacatggttgcttattttttagcactgattgtttgataactttaaaaccgtaaaactgattggagactttctgatgaaagaacgtagactttcgtttctattcttcttagtgatgtttgtgattggcaccgatacctttttggtttcaccgttgttaccgacgttgacgcaatactatggcatttcgactagtctatctggttttattgtcagcgcttatgcagtgggctacatgatatcggcattattgattggtccgatttctgaccggcacgatcgcaaacgtattttggtcatcgggttagtggttttcacgttggcgactgccgggtgcggactggcgaatacgtttgcgatgatgcttgtcgccagattcgtcgctggtgtcgcggcggccacggccggaccgcaaatctgggcggctatcccggtattgtttccaaagacgcaagttgtcaaagtaatgggatatgccacggccggtctggcggttgctcaaatcgttggggtaccattggggagttacttagcggtatggtcatggcgatttccgttcttcttcgttggcgtcattgccttgatgttgacgatgttggtcgtgcgtttcatgcccagtcttaacgaggtgacaacttcacgtcttgcaactggtatctatcgcaaactttttcagaacaaaaccgtgcttaaactgctaggggcatacttattgtttcaaactgcaaatttttgcggtttcgcctttatcggcacttggtttgcgaaaagcttccatttatcagttggtgccattggcagcttcattcttttaatcggcgttggtcagtttgttggcagtttgctgggcaaccgattagtcacttggttgggtcagccgcatgcgtttctgcttgagttcttacttttcattgctgggtatctggttttgcctttcaccaattcgccactgacggcaacggtcattctggcgtttatctatacaatcggtggcgcactgctgccattgtttatgagtaccttgcaagaacacgcgggatcagcccgcagcacgatttccgcgttggccaatgccgtcatgtacttaggtgaggccatcggtggtgtcatcggcggtatcttgattaaacagtttactggcttctcggggattgccgtttttacagcgattggcgcaagcttggcgatgttgttatatgcccagcagggatattttaagcaattgcagacgagtcgttaaacacatacagtacggctcaatgaagctagtactggaaggctaaatttttttgctaattcagttatgtggccgccccacagcatccaagctatttacaacgaagacactattgttcttgaagaatgagaaaggtatactcgagataagaacatatgtttgctatttgggaagaaggtaccagcatgcaagaaaatttatctcagaagatcttagacttgttagacagtggccggttcttgacacttaaggaaatagctaagttattgaagatgccagagaagccggttgaggaaactttattacacttagtacgattacagaaaatgaaccgacgtcactttgcagggcgcgattattttcagaccactcagccgcaacaggcgaccagcaaattaagtgcagttgcagatgattacttagatcaacgacaggcagcccatgcgcttggagtagcgcgaacttgctaccaccatttggctgggaaagctggtgttgccttatttgaccagctgttagccaaaaagatgcttgtgctgacggcaccaaatgtgtatcagcttactgaaaaaggccgccacgcatttgcgcaattcctcgggcgtccagtgcatcagctgaacattcagacttgcattgatttttcggaacgccgggttcatttggctggcaagctaggcaatgatgtcatggctaaacttgtcgctgagcatcaacttgctttgacgcagaatcgacgcgtgcaagtgacccagccgattaagatacaaccgctggaggtacgatatgctggctgaaaaacaccgttgcgcatggggacaaaccaataatgacttgatgcgcgagtatcatgatgaagaatgggggcggcccagccatgacagccgccacttatttgagcttttgtcgcttgaaatcatgcaagcaggtttgagctggcagaccgttttgaataaacgcgctgctttcaaacaggcttttgctaactttgactatcggcaggtgcagcagatggcaccgaagattccggtgctcttagaaaatacgcaaattattcggaatcggctgaaagtgatggcgatcattaacaatgcgcgcgtgatcgcacagttagctgccaaaggcgaggactttgatcattacgtgtgggcctttgtcaacaatcagccgattcggcatcatattaccagtcatgatcaggtgcctaacacaaccgacttggccaagcacatgagcaagcaaatgaaggcagatggctttgcatttactggtcccgtcgttatctactcatttatgcaggctgcagggttggtcaatgatcatgaagccgactgttttgttaatcaaacacttgatgagtaaagaaatatgtatgaaaaagcccactcgctgaaatttgcgagtgggcttttgaatggcacttaatgaaaaaattaaagtgcttctggaaccatcttaactggtttgttgccaatccagccggtgatttctttgaaggtatcggtgatagcatcggtgcctggcttgagcagcttacgagggtcgaagcccttgccttgctgatccttaccagcttcgatgtattcacgcgttgccttagcaaaggcaagctggcattcggtgttgatgttcaacttggaaatacccatggtgattgccttttgaacttgttcttgagggataccagaaccgccgtgaagaacgagcggcatcttaacagcgtcgttcaattcttgcagacgatcgaagtgcaggcccttccagttgtctggatattgaccgtggatgttgccgataccagcagccaggaagtcgatcccggtagcggctaatgtcttggcttcttcaacgtcagctaattcgccttcgccgacaacaccgtcttcttcaccgccgatagaaccaacttcggcttcaacagaaatgcccttggcgtgagccaacttaacgatttccttggtcttttccaagttatcttcaaagtcgaggtcgtggccgtcgaacataacggagttgtagccggcagcaatagcttccttggcagcttcgtagttaccgtgatccaaatgaatcacaacaggaacggtgatgcccatggctttaaccgttgcttcgatcatggtctggcagaattcatagccgcccatgtacttagcagcacccatggatgtctggatgataaccggaacgttcaattcttgcgcaccggcaaggatggcgcgtgtccattccaagttattggtgttgaaggcaccgatacagtagtgacctttatgtgcagcttttacaagctctgcagcgttaactaatggcatgtagatatcctcctaggaaataaacaattcacaaccgttgtattttatcatatgttgcgggagaaaagggcgagaaaatgatgagagctactcgagcagcgtgacggctttttataacacccgtcatacatatgtctgtgtgtacgcaaagtcacttcgaatgtaccccgtaatcagggaaaatgctactgatttgctcactttttgccgacaaaataaaaaatgaccatcaaattgaaatttgtttgaaactggtagttgtgtgaccgcaatcggatatttagtcaagattaaatgagattactctcataaaaagaagacggaaatttgtttataagtggcacgtttcacaatttaaaatgctaactaatagaaaagcaaatcgcaataagtgggtatttcttaaattgggttagttgttgtatggtttgaaaaaatctgaattcacaaagtctgatctctttgataaatgagatcacactaagagcagttgaccatgccgttgaaagaactaaggtggagttgtcaataaattgataacaattgagttgtttgcatgacgaaatgcgataaaggagattttgatatggcaacaaaagcagcagatcagttagtcagcgttttgatggattggcaagttaaacacgtttttggattgcctggtgattcaatcgataccacagttgatgccttacgtcgacatcaggataagatcaagtttgtgcaggtgcggcatgaggaagtcgccgctttgtccgcagcggcaactgctaagttaacaggcggtttgggtgtttgtctctccattggcggccctggcgccattcatctattaaatggtttgtatgatgccaaaatggatcatgtcccggttctggcccttctcggtcaggtgacgacgagcaacatgaatgaaggctttttccaagaagtgaatacaccgaagctttttgacgatgtggcggtttataacaaaactgtcatggcatcggataacttaggacaaattgtcgatacggcgattcgcacagcctttacagaaaaaggggtggcagttttaaccattccagatgatttgccagctcaaaaagaaactgctagttatcaggacagcgctgctgcttttgccttgaatgtgccgaaagttgatcctaaacagttagaggacgttgcttcgatgctgcaacaggcacaaaaaccacttgcgttgatcggtcgcggtgctgagcatgcaggtgcgttggttcaaaagtttgtcgaggccaatcacataccgtttattcaaacgatgccagcaaaaggcactatcgccgatgatcatcccaatagtttgggcaatgtcggtaaactaggtacgaagccggcatatgaggcgatgaaagcgactgatctcctcttcatgatcgggacgaattatccatatacgccttatttgccagccgaaggtcaagctaagtgcgttcaaatcgacacgcgcccagaaaacttgggcaaacgttattcagttgatgttgctgttgacggcgacgttggcacctttttcaccgaactgaatgcgaagggctccttgcgtgatgatgatcgttttctgaaagcttgccagaagaatatggagagctggaataagtggatgagtgaaaagcgcttgctggctactaatccggcatcgcctgaagcagtcttcgcgacgattgatcaaaccgcgccaaaagatgcgatttactcgattgatgtcggtacatccacatcatggggtgcccgtttcttaaacgttcagccaacgcaaaagtatacaatttccgcatggttgggaaccatgggctgtggcttgccaggcgcgattgcgggtgctgaggcttttccaaagcggcaaaatatcagtgtcgcaggggatggtgccttcgcgatggtcatgcaagactttgtcacagcagtcaagtacaagttgccgatcatcatggttgtcatgaataatcagaagttggcatttattgaatatgagcagcaaagtgccggtcagctgaactatgaaattgatttggctgatatggactatgccaaaattgctgaagcagcaggcggcattggctacaccgctcgcagcaatgacgaattcaaaaatgcattagccaaggcatacaaagagaccgataaaccggttctgatcaatacctacgtccaagacgatgcaccgcttccaggcaaaatcgttggtgatgaagcaaagggttacatgaagtacggttccgaatatcttgagaattattggaagattccgtccatgccgccattgaaggatattatgcggcaattcttctaattttcgattagcttgtatcaaaaataaatggcttcaataaaaaatccccactccgagtcacgtccgaagtgaggattttttttacttagagggtctcccgccaagccgccatctctgtttgccatgtcttgcgagcctcatcgccaggggacatgttgttaagtgtcacttgcgccagctgcttgtcgaacgaaacatcgaaataggtccaatagccgaaaacgtgaccggcatggctgaaccaatttggcgttttcgaatgcatccaccccataccgtagaagtcgtgggtgagggtcagtgcctcgtgccaatctttttcagacagaatatcgtggcgcaacacggcctgcgcccatttggcaagatcggttaaggagctgacaacggccccgtccccaccttggtaggcacctcggccaagcacgacaggtttaccagccgtaacgtctaggtcatcataactgttggcctcagcatattgtgtcccaagtcgtgtctgagtcatcgccagcggttcaaagaaatgttcctcaaaaaagcgtgctaacgaatcgccagtaatttttgagatgatgaaaccaagcaataagtaattactgttggagtaaacgcctttttcacccggtgtaaaatccagtggatgttgatttagcaacgaaatgacctcggtaatctcatcgccatgaccaagatcttccaaaatagggtagctaagatgggattcactggcaccaggcatgcgtttggcataatcagttagtaaaagctcggtgtaatcaggaatgccactggccatattcaacatctgacgcaaggtgacttgatcggcatagcgatagttcggcacataatctactaaggacgcctctatgtcgagcttgtcagccgcgttcaggagcaacacgttgtcagcggtgaattgtttacttagcgaacctaagccactagttgtttgaagggtaaacggccgtttcattgaaaaatcggcggcaccattttgccaacttgaaagtatttcagtcggattcacgatgatggtcgccccattgagatggtacttttcattaatcttttgatagccttgccaatcagtcaattgatttcctcccaaccgcgccagctcaggctcttaaacgcgttcaccagcccagaaacagggctggtgaacgctctcttaaagtcggacgtcaacgccgaggcctggtcaatctgataaggttaaggtcggaccgtctgaggtgaagccgccgctaagccagtcagtttctgccagcaacatgaaactgtcgatatcgccgtagtgcacattctcgtgtgcggcgatgaagtgagcggatgcggctgttcctaggcgagtttcggcattgcaaccgaccatgcaaggtacgccggcagctgcggcagtcgcgtcaatcgccgcggcgccgaacagcccgcccgatttagccagcttgatgttgatcaaatcggcggcgttcaggcgaatagcatcggcagcatcatgggcgttgtggatactttcatcaagcatcaaggcaacgtgtgactgtgcgcgtaacaaaggtagagacagcaactgccaatcaggcaccggctgttctatggcaattaaattgggggctctgagttgggctgcaattcttaacgtttgcgatacagtccaagcttgattagcatccacttttaccgagatggtggggccgactgcagcacacaccgcgttaatggcggcgatatcggcggcttcgttgtccccagcttttaactttaatgccgtgaaaccagcggccacatatgtccgcgctgaagccaccatttgagtcggagtgccaatcggaatcgtgatatccgtggtgacgatatggctatgaccaccaagcagttgccatagcggcaagctggctgctttacctaaaatgtcgctacaggcggtgtcaatcccacattttaatgctgtatgaccagccatcacgacatccatgcgtgcatgcacctgttcaagattgcgcggatcgcagccagttaaagcattgacgaaaactggcagagcagcttgttcggtttcattggtttcgccatttaccggtgcgtaaggcgaggcttcaccatagccggtgacgccatcatcagtctcgattttgatgatcagtgtggtgatgtcccgcaactcgcccaaggctaacttaaaaggcgttttaagttttacctgccgagggaacgccgtgattgctgtgatttccatcgcttactccttcattttagacgtggtgtctgtacctgaacctgacagacaacattcaaaaagtatgaagcaactgtagcatcgcttgccaccgaattcaaatcaaaatctcattttgccaatctgtttgttttgcgtcatatgcacaatggttgcacatgctagcggtgactgcgatgatggacttatattcttagaaggagtgttatgtcatgtcagatatatacgatgatcccgcattttttaaagcatacagccagatggatcggtccaaaaagggactagcaggtgccggtgagtggcatgaattaaaaacagttctgccagatttttctggtaaacgggtattggaatttaggctgtggctatggttggcattgccgctatgctgctgagcatggcgccaaaagtgtcctcggcattgatacctccgctaaaatgttggctgaggcagcagcaaagacgaccgaccagcggatcacttatcgccggatggacatgcaggcgattgatcaattgccggatcagtttgacattattttgagctcgctggccattcactacattgaggattacgcccagcttgtgaaaaaaatcagtgataagctgccagttggcggtcattttgtcatgtcggttgaacatccaatttttacagcccaaggcaaagaagagtgggtcacggatgatcaagggcacaacctttactggccagttgatcgctatttcgatgaaagccagcggaagactgattttctggggcaccagattaaaaaataccatcgcactttgacgacttatctcaataccttgcttgatcatcagttacggttgaatcgcgtgattgagccgacaccgacagatgaaatggttaaaaccattccggggatggcggatgaattgcgacggccgatgatgctcattgtggcgactaccaaaacggcgtatactcatgaaaaataaatcctaagtagaatagaaggaaataaatcgtgaagccaaaaattgggattcccacagatgaattgatcgaagttaacccagtgatgccaaacaaccatcctgcctatgcgccgcatgatttgaaagaggcttttattaaacttgatgctttgccgctgatcattgcgtttcctgatgatgtcagccaaactgagcagcttgcgcaagattatgtgcagctgattgatggcctcatgttgcctggtggtccggatgttgatcccacattctatggggaagaaccgcatcccaagattggcatgacgctttatcagaaagatcttttcgaaattgcattgatcaaagcggcactggcggcaaataaaccgatttttggtatctgccgtggcattcagatcatgaatgtggcgatgggcggtacgttgtatcaggatttggaaagtcaataccctgatttgaaaattcagcatccccaagccacactgggccaatttgcgacccaccatgttgatttgacacctgatagccgattggctgccttgtatgggaagaccacgattaaagtgaactcgcggcatcatcaggcagttaaaactgtcggcaagggcatgcgggtgacagcggtggctcctgatggcgttgttgaggggatggagtcaatcgacaatgatctttttctcggggtgcaatggcatccagaaaacatgtggcaacaagaagatccgcaacaattagtggtttttcaagactttttggatcggattgctacacatcaaaaataaggatgttacgattagctcgaataacagaacaagcacctgatcagctcaaaaattctttgagattggtcgggtgcttgttttatttcgatgaaggccttggtgcttcatgattgtcgatagtttttcgggacaaggacatggtagctgctgtaaaacctgccaaattagtgacgctatttgcaaattcccccgcaacaatttttagacaatctttccttttatttaaaatcatgtaacattagggccgaacgatacatatgtaacggtgttttttaaccgggtgtatctgaataattggcgagggcattctaagaggaggaaatcaacatgggcgatgaagccgtcatcgagcagctgacagagaagcaaactgagctgatcgagtttctgtatgtggattataacgggttaacgcgtggtaaggtgattccgcttgccagcttgaaggccaagctggctgatgggattgggttgaccaaagcaaccttgaatgtcagtgaacgtgatacgattttgccggtggcggacatgacgcctattggcgaactgcgccttgttggtgatccggcgtcggcacatgtcctaccctatatgccgcaagtcgccaccttaatgggggatatttacaatcttgataaaaccccgtacgcatctgatccacggtccattttgaaaaaagtcgtcaagcagcttgctgatgctggcttcacggtcaaaatggcctatgaaaatgaattcgagttatttactggaggtaaagatcatcgcgaaccggcaatgccacatgtcgccttttccaccgagtccatggattttgcgtatccattcattctgaaggcgatcgatcaactgcaaaaagtcggcattatgccgaacgcttattacccagaaggtggcattggtcagcatgagctgagcatgttgccgagtgatccggtgaccgctgcggacaatgaggtgatttacaaacggatcatcaaaaatactgcgaaggcttttgacctgtatgcctcattcgcgccaaagccgctagttgattcggccgggtcaggggcacacattcacttgtcactttggcaagataaagaggatgctttctttgatgacaaggcagcgatgcaactatccacgattgggcagtattttgtcggcggtgttttgaaacatattcaaggtttgctggcattgacctgtccatcggctaattcatatcagcgcttggcacctggtcattggagcagtgcatacgccacatatggtcaagacaatcgtgaggcggcaattcgcattccgtcaaccagttggggtgatccggccagctcgatgaacatcgaactcaaggcaagtgatgcgacggctaatccttatttggcttttgctggtttgctggcggcaggacttgacggcatcacaaatcacatgcaaccggatggctattgcgatgttgatccagccagtctcagtcaagctgagcgcgatgccaaagggattcagcttctgccacgcacactgagccaagcggttgacgcttttgaggcagattcgctattccagcaagtatttggcaagcaattggtcgatgcctacgcgaaaatcaagcgcaaggacgatcagtattatgccaaattggcattggaaaaaattgctgccttgcatcgcgaattgtattaaactattttgacatgatcgttgtcatgaaggctggcagcgatcacgttgtatgaaggcacttcgctttaaaacttctaggaaagcgtgagctggtcattgcaccagcaaacgtgtgaaggaggaagtattttggacgacttatctgaatttgtcgaccaagtcccattgttggatcatcattgccattttttgattgacggcaaggtaccgaatcgtgacgaccggctcgcgcaggtatcaacggaagcagacaaagattatccgcttgccgataccaaaaatcgactggcttatcacggctttttagccttggctaaggagtttgcgcttgacgcaaacaatccattagcggccatgaatgatcccggctatgcgacctacaaccatcggattttcggccattttcactttaaggagctacttattgacactgggtttgtgccggatgatccgattcttgatcttgatcagacggcagagctcgttggtataccagtgaaggcgatctatcggcttgaaacgcacgccgaagacttcatgctggaacatgataattttgcggcttggtggcaggcgttcagtaacgatgtgaagcaggccaaggcccacgggttcgttgggttcaaatccattgctgcttatcgggttggactgcaccttgaaccggtcaacgtgattgaggcagcagctggattcgatacgtggaagcattcaggcgaaaagagactgacttccaagccgttgattgactacatgttgtatcacgttgcgccgttcataatcgcgcaagatatgccgttgcaatttcatgttggttacggtgatgctgataccgatatgtatcttggcaatccgctgctcatgcgcgactacttgaaagcttttaccaaaaaaggcttgaaagtggtgctgttacattgttatccataccatcgcgaagccggatatcttgccagcgtgtttcctaatctgtactttgatatttcactgttggataacttagggccaagtggggccagtcgggttttcaatgaagctgtcgaattggcaccatatacgcgcatcctatttgcctccgacgccagcacctacccagaaatgtacgggttggcagcacggcagttcaagcaagccttggtggcacattttaaccaattgccattcgttgacctcgcccagaaaaaggcatggatcaacgccatttgctggcaaaccagtgccaagctttatcatcaagagcgtgaactgcgcgtctagaaaccagagcataagtgggcacaagtgcgatggccgttctttggccattgtgtttgtggtccttatgtggaggtttctgggctggagaacgcgtttaaagaggagttccttcactaatcatgcaaaaacgtaaaaaattaaccttactcgaggtattcggtctctcgatagccatggttgccccaactggcgccatgtccttcaacacggcaagtgccgccgccaatgcgggcatcaatatgcccattgctttcttgcttggtgggatcggcgtgttattcgtcgcgatttcttttgtcgaacttggcaagcgcattcccggtgatgggtcagcctatgcttataatgccaaagcgcttggcgaaaaggcgggcttcatttccggctggctgctcgtgttgacgtacgtgacctttgttttcagttcgggcgccattgtcggcaattttgctgacgtgtttttaagtcattttggtattcatttaccagtcaacttgtacaacatcattgtgctgctgcttggcggctggcttagccataaaggcatcgaattctcgacaaggctaacgctggtgcttgagctgttggcggttttggtgctgagtgtcctgactgtcgtgatcattttctcaggtggtcgcagcggcaattcagttcagccgtttattccacaaccgcatatggcgaccggcctggggatgggcatggtatttgctttgatgtcttttgccggctttgaaggctcggcgacgattgcgccacgggccacccatccgcgcaaggcgattagtattgctttgctgggtgccgttagctttgcagcaattttctactttcttgtcagttacgccgaagtcatcggttttggttccgcccacatcggcgatcttgcgaaaagtaccgcgccaatgaactttcttgcgacccattatctaggcacgaacgccgcaattttcatggactttgcggcgatggttagttattttgcctgctacttcggtgcgctcaatgccggcgctttcatgctggaagctttaggcaaaagtggctatctgcatccttggctggcagaactatcaggtgacaagcagaccccgacgcacgcgctggatggcatcactggcttagcgttaatcgtttatgcgatttttgcaatcggcttaggtgtgagcgcgagcgacatgtacaactggttcggaacgattggcatgctcggcttgctaacggtttacgtgctggtcaacattggcgccattgtctacttccgcaaagacaaggggcgatcaatgtttaaacatgtgttggcaccagtcatcggcattctcgtgctcatttacccaatttacaccagtctttggccgattccggcattcccgatgaacaccttcccatacatcgcgatcatctggttcctgatcggtctatggatcgcaaccaagcggcgcaatgttgaaacgagtttagaagatttttaaagttatgacccaaaaaagctcaccatttttgatggtgggctttttgattggacgtaggttgcgactatcggtcggtcgctacaacttgcgaatgtctaatgccggccttgacatacttctccgtaccatcagccacggcttggcgatagtaaccttgcttgtactcgattttatcgagggttcgttgtaggtcagccatttgggcgagcaccgtgacgtgtaactggtcaaaaaagtcacggcgtttctttaaggttgtatcgccttcaagattccactgcatgaacgttttgatatccttgatcgacatacctgctgttttcagacactcgatcatttcgagagcgccaagattctggtcatcaaaacaacgggcaccagaagcgtcttttttgagttcagggatgagtccttccttgtcgtagtaacgaatggtggggatcgatagctttgtcatcgtggcaacttcaccaattgaataagatttggacatatgatgacctccaattttttaaataatcgcttgacctaaatctaactttaggggttagggtgagtgtagcacttgatcaagcgtaaggaaaatccactcggtcacgaacgtttggtagtgatgactgggatgaaagatcaaggcagcattatttgtcgaggagggactattatgttagaagcaacttatacattagcaaatggcgtacagattcctaaaatcgggtttggcacttggatgattgatgccgatgctgatgctgcgaaagctgttcatgaagccattgacgccggttatcgccatattgataccgcggaggcatatggtaatgaagtcggtgttggtgaaggtgtgcgtgcgtctgggatcgatcgcaaagacatttttgtgaatacaaaactggctgccgaaatcaaaaaccatgatgaagcggtaaaagcgattgatgactcattgcagaagctgaacttggactacattgacatgatgattattcatgcaccgaaaccctgggctaagtacgatgaacccaatcgttattttgagggcaatttagaagcgtggcgcgccttggaggaggcatacaaagcaggcaaactccgcgcaatcggcgtttctaactttgacccgactgatttggaaaatatcatcaagcatgccaaaatcgcgccaatggtggatcaagttttggcccacatcacgcagacgccattcaaaacgattgattatgctaaggcgcacaacattttggttgaagcttactcaccatttggtcatggcgaaatgttcaaaaacaccgcaattcaagccatggctgctaagcaccacgtttcggttgctcagcttggtatgcggtatctgttgcaactgggcctgctaccattgccaaaaacggtcaacccagaacatatgaaggcgaatgctgatgtcgatttttcaattgacgatgctgacatgaccacactcaagcagatgaagcctttgacagattatggtcagtttcagaagttcccggtttacagtgatcgtttgagttagtgccgacacactgctggtaatatcagaaaattgatacgacaaaatgaggtgctgataaaaagcgcctcatttttgctatccttgtggggatttatcaaaactgctcagttgattgccgatattaagcccaaggcccatcaaccacgactttaccaatcatatgtcctgactcaaccaatgcgtgggcttggcgcagatttttggcattcaatggctgaagggtcttggttagcgtgcactgaatggtaccttcatcaagcagcttagccatctggtcgagaatgtgaccttgtgaggcaaggtcataaccataccaagacttagaaaacatccattcccaggcgaacgtcgctcgttttttagtgagtttctgcaagtcaatgccgcgccgattttcggtaatcgctgcaacccagccatcaggacgaatcatctccgcgatctcgttccaatggtcatcaagatgggagagatttaaaatataatcgacgttcttgaaaccagccgcttttaactgtggtggcaatggctgccgatgattgagaacgaaatcggcaccgtggtccttgatccatttttgcgaatcaggccgtgaagcagtggcgagtacctgcaggccggcccaatgtgcaagctgcgtcgcgactgaaccgaccccaccggagccattgatgattagaatggtgtgctcagcgttcgtggctcgatcatgcagtggtatgtgcaacttttcgaataaagcttcccaagcggttaaactggttaatggcattgcggcggcttgcggatcacttaaagatgccggggcatgcccgacaatgcgttcatcaactagctgatattcagcatcactgccagaccgcttgtaactgccagcgtaaaagacgcgatcaccaatcttaaagcgggtaacatcgcgaccaataccggcaacggttccgactgcgtcccagccgatcacttttggatgagctaagcgaccatgaccagcgccacgcgtaccggtatcgacaggattgactgagacagcatgaacgttaatcaaaagatcatggccctcaggtgttggtgtcggtaacgttatattttcaagactatgttcatcagtaatcggcaaatgctgggtgaatccaattgctttcatgacgagacttcctttcaatgacttaagcttcaccttgtatgttaactggaaggcactatcatagtaagtgaacaaattgtaagtgaaaacgatgtggaagtcagcttctgcatcagcaaatgtgtttttaagggaagtcctattgatgtcacgagaaatttacgattgtgctgcaggctgtcccgtccaaaatacggttgacgtgattgccggtaaatggaagagcgtcattctctatcatctttttcaaggcgatgcgactcggttcagtacactcaacaaagccattccatctattaccgagcgcatgctggcattacagttggcgcaactcgaggccgataatattattgtcaagaaagctggttatgcagacggacgggctacagaataccaattaaccgcactaggccagaccctagcacctgtcattcaggctatggcagcttggggtgaagcatataaagtgcggcgaaaagcattagtttaattaagaatagtctttatgacggcaaaaacggctctacgccaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgcgggatgtttcttcaccatcaaagcatcatgaagcgctaagtaggtctcgtaggtttgcttgagcttgggctcagtatcaagtgcgatatcgatggcctcttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttcttagtctctgtctgctaaatgacttctggtgcatttcgtttttaacagcagaagtttcgactgcccaccgccaattcattttttgaaaggattgtcacgatgtcaattttgaattatgccaagcagtcttcgtggccaaatagtttcggcttccagcaatcaccgattgatcttcgtcaagcgacaaccactgccgacaccgacatgacgattctcacaccatggatgaccgatcaagaaattgatgaccaggtcaccattcggctcgctggccaaggaacgactcggattaatgaaaccacttggacttttgtgcaggcccattttcacgtgccagcggagcatatcgttgctgagaaaacggtggcggagctccattttgtccatcaatcggccattggtgcgctttgtgtcgtggcggttttagtgccagttggtcaagctaacccgatcatggccgatgtgctcgatcattttcaaccacatgtcacgcagccaatcaactttgacctgactcgcttactgccaaaacaaggcacggtttttcactacctcggctcactcaccaccccgccgttaaccgaaggcgtgacttggtatgtcattgagcaaaccgagatcacaatgagttcgaatcaggtcgcccgctatcagcagttttttgaaccgaataatcgccatgtgcaagcgatcaatcggcgaccaattttccgaggcgttttcaagcaactgaagcgtccagcaggagatgaccctcttcatggctgaatcagcaaaacgctggcggcgagtaagcatatcgatactggtaactttgcttctcgctagcggcggctattggctttggtggcaactgggcagccgcgcaattcaccagcaagcctatcgtcatacgggtatcgtcacagtttttgtccctggttatggcagtaacagcctcaccttcgggccaatggttcaacgcttcaagcaggataaggcatccgatcaagtcactacgattcatgtcagtgctgacggaaaacgcacgatcactggagccgaccgctacaatggcaaaaatccgctcatcaacgttgtttttgccgatgctaagtcaccacaaaaggaagtccggcaactcaccgacttgctgcactggcttcgcgtccagcgtcatgtgactcgtgtgaatctggtaggtcattcaatgggcagcaatctgagctttaattacatgacgacaccgcatgccaatcttcagccgcaagtgatcaattatgtctcgtttgcgagcgagttctatcgtgatccaacgacccagattcgggcgttaccgaaaacattgcatatcttagtgattggcggacaggtcttcggggcaaaaggtgactgggccgtcagccttgctggtgtcaaacgtttagccgccaaatttaaggcggctggcttatccaccaccctctttgtttatactggcacaccagttggcgcttatcactcgacgctgcaccaaaatccttatgtggatgctgaaatcttgcgctttttatttacctgagtagctaaaaactatctgcagcttgtggcttgattctcacaagctgttttttgttgcctcgataaaatcgcattcccaactcattcgtaaattgccaagaaaaaattctatttttcatttgctattttcaaccacttgccaagcattttgcaccacttaccgcctttctcaagacacttggcacaatcgtcgttatgctaaggccaacaaatcgaaagcaggtgacatcaatggccattcttgaagcaaagggtctgaccaaaacatttggtccgaaagtagcagtgaacggcattaatttgacggttgaccgtgggcaattcgtggccttcttaggtcctaacggggcaggtaaatcgacgacaatcggcatgctgacaggcttgattcaaccgaccagtggcaccattaccgtcgccgatcacacacctgggcaagtggcctatcgtcaacagattggggttgtctttcaggatagtgtccttgatcgccaactaacagttaatgaaaatctacgattgcgggcgcgcatgtatcaacacccagatactgcttggttcgatcaactgattaagcaatttgacctggcacctattttgaatcagacatatgggacattgtcaggtggtcagcgacgccgaaccgatattgcccgcgcccttttgaatcatccccaaattttatttttagacgaaccgtcaactggattagatattcagacgcgccaaacgatttggtcagcgctggctgctttacgcgtccaaacgcaattgaccgtcattttaacaacccattatttggaggaaacggaaaatgctgacttcgtttacgtcattgatcgtggcgaaatcattgcagcagataccgttgttgacctgaaaaatcgctatgctgctcatcaactgacaattcaaacaacagctgccgatcgcgtcaaaacagtcgccaatcaagccggattgcgggccaatatcgttgcaaacgaggtgcacgtcaatatccatcatccgcaacaggctattgccttactgacggaactcaccgatacgatcaccgactttgagttccatccagctgatatgaatacgatcttcgtcacattaaccggaaaggagattcgctaatgctagcttttattaaacgtaatctattgttgctttttcgcaatcgcgccggcgtttttttctcagttttgggcgcactgattgccttcgttctctatttggtttttctcaaaaagaatatgaccggactgtggcctatcagtcatcctgaaaagctgcttgatccctggctaatcggcggcacgcttaccatcacggcagttacgaccacgcaagatggcttagcaagaatgattgttgatcgtgagaatggtaatttaagcgactacctgttgaccgaagcttcttatctgcgcattcaatttggctatctggccagtgccgtcatcatcggcaccatcatgcagctgctcatgttcggcgccatgtcaggcgccttcgccctgcttgatcatgtcgttattccatggcaactaactggcaaaatcattgctctcgcattgttcagcagtgtggtttggacaagttttaatttacttattttgagctttgtttcccgcgtgaccaccatgagcggcattgcaaccattgtcggtactgcagcaggcttcttcgctggggtttacatgccaatcggggcagttcccagcggcgcacaagccttgatgaaaatgacccccttcccatacaacgccgctgcttatcgccagattctgttgcaacagccgttagccacgaccttcactggcaagcaagaggctgcaaggtccagttttgaaaaaatgttgggtgttcgcattgacgtcaacggcttgctttctagcagccacacttacctgattctgattggttttacgcttggtgtgagcatccttattttccttcttgccagattcagtcgaaaggccgccctcgcccgcgtataatgaaacgtaatcgtgcgatacgctggcgtcatgcggaaggagactgagcctatgaaagtttcatttgatcaagatcctgacttgaatccggatgatattgaggtgctcatcaaggctgcgcggctttcaccggctgtgttgcagctcttgcaacaaattcaacaattatcagacaatcgaccaacccttccgctaactgttggtgaccgcgttgtggtactggccgttaatgacatcgtggcaatcgaagtctacggtgacgagctcacggtccacacgatgaccaaggtctatacttcgcgtggccagctaaaagccattcgcgctaagcttgatcctcagctttttattcaggtagccaaaagtaccattctgaatatcaattatttgacatcactggaagcttctttttccggtaatatgaccgccttcatgagtaatcagcaaaaattgacggtcagtcgtaaatttcttcctgacttgaaacgtttattaggattgtgaggtggcccttatgagaatcgcaaagcagttattgaccgaggccgtcattggcatcatgatcggcgcaaccgtttatctgaccactttgatgttgcatttagacacgattaatccaacaccgcgctctatcgctggactgttcatcatgagtgccgtcattggcatcctatcttcgattttcgatcttgactggctcagtttaccagttgcatatggcacccatttcatcagcacctttttgatcgtccttgcaacgaactacctgatgggctggcaattcttgattggctctgccttaaccagcttcatcatttcgttcatcgtcatctacaccttcatttggatcgccctatacctctcttggcgcgtgacggctagaaaaatgacccgcattttaaaaaagcgattgaagaagtgagttgtcgttgtgtcactaacgcataatctgtttaaagtgtcggttattctattctggttaggttgttcccggtagttccgcggtcgccacccccgaatcaccgcgtagccagctcaggctatcggaaccaacatcattagcatagcaataaagatgctcaacccaatgaaaaagaatacttacaagccatccttattgtcagcatacccgccgttgtagaaaacgcgctcacagtcgcagaaacttccgtgtaaggaccttgaagcaaaaggaccaaaaaccggccctttcacttcaaggccacttacactacagtttctaagcgctcctgctcgcgctctcagaccaatgagcggttatttttttgcattggtgctaaaatagaaaggtcaaataaggtcaatcaaggaagtgatcatttttgaaccaggttgttatctttggcatcatgttggcaatcgtcattttaggcaacatcttggcacggcacgttcctaagatcccgttgccattcttcttgatcggccttggggcggcattagccgttatgccttctcttcgtaatttcacacttgatccatcggtcttctcctttgcgatcattgccccgctgttgtttaacgaaggtcaaaatgcttcacgtattcaaattggccgctctttaaccaatatcgtgtcgttggcagttggcctcgtgctggtttcggtcattatcttaggctttggcgttcatgcgttgttcccaattattccgttaagtttggccttcgcactcattgccatcgtcacgccaacagatgcatcagcggtcagcgccgttgcccaaaccaatcctttgagcgacagccaaatgcaactattgtccaatgaaagtctgttcaacgatgcagccggcattgtcgcattcgatctggcactgactgcctatgtttccggacaattttcaccaacagacgccttgctcgattttctcttcgtcttcttcggcggtatcctggtcggggcagtcttaggtatgctgatcgtgaatttgcgggcctggctgattcatatcggcgacgatgagccgttgatcatggtcggtattcagttactgacgccattgttggtttattttctagccgaagaacttggcctgtctgggattctggcggttgttgcttctgggattgcgcaaggtgtagagcgcgatcgtttgcgactaaccagtgcccgcatgcaaatcgtcagcgccaatgtctgggaaatggtagcggccattctttccggactcgtcttcgttttgctcggcctctcgctgcccaatgtcatcgttagcgccttgcgcggacaagctggcttgttcagtttgcttgtgggtattggcattttcatttacgcagccaagtcactggttcgcctactatggagtcgaaccttgctgcgaactggtaaaaaacaccgctggcgcaacgccgtcattatgatgctgggtggtgcgaatgggaccatcaccttatctttggcgttttcaatgccacaaattgttaatggtcacagttttccgctccggcaaggcttgattctgatcgcggcaactgtcattttactcagtctgattgtgccggtactggttctaccattctgcgtgcctaagcagccaaaacgcaatcgccaatatgttttgttgcgccgaatgttatcagctggcattgatgccatgcgggatgaatccgttcatcatagcgaagcccaaatcgttgcagacgcgttgtctcaggaaatgattctgaacgataaaccttcgcgaagaatgcaacgggatatctttgataccaccataaaagttgagaaaagaaccattgaagctttacgggtcaatgggaccatcacgcatgacgaagcgcactattacaatcgctttattgatttaaatgatttcacagcagatcagcgaacgtggaaaaatctttttctccgcttacggttcacctttaatatgggacgtatgtataaaggtctagacgaagcgcaaaatgcttttttaaccacactgcttaaccttgagccgattttttggaaacggcaatttactgagcacggtgaagatctattacctatcgagcaggccggctatgatgcggtgatgaagtacttggcaagtgccgaaaatagtcaaaatcgtagtgccatcaacatcgttcgccgcttctatcgtgatcggcatcgccgggttcatacggattctttcgatggtgatgtgctatatgccatgttcctaaaggcattccatgctgaatttgagttcattcaaggtgcttttgctgaaggcaaactcaaccgggagatcatgcaacggttgcagacacgcattacttttgacgaaattacgtacctacaaaaccagaatagtttcattgcttaaaaagatcacactaagtaacaacacttgataatctaaaaaagggtactgcaacggttaaattgcagtaccctttttgtcatttaaaacccaattaatgcttggctttatcgtcagaatcaagtgccatttccagttcgtcagcggcagtcttcgtcacgctttcgatctttgcaagcacccggccatatggttttggatccttgttgatataccgtaatagtcctgccatccgcgctgtcatgtcataccagctttggtttggcataccggagatttgaccgacccgggcatttggcaaaacatcgatgagttgctcgaccgcatttttgacaaccggcaacgcaccgcgtacctgatcggaatcggcgtaagtggcatcaaagatcagttgcatgaagcgatcaggttgtgaatgttttgatggtgttgcagctcgttcggcgcgcacacccatcacaacctgttgcaagccaagtaacgtcaatcggactaattgatcgtgttgcgaaacgcccaactcaggcattggcgagatcccaatgaggctcagttcgtcattactaagccgcagagcagcattggcaacaaagtctgacagttgcaagccgagatgctcgcgagaatctgcaaactcaaaccgaaccttgattggtcgttccaaggaaagcgtcaagtagcgactcacaatatcagcgcccatcaccagctgattaccttccaattcattccgatgatcgatcatgatcacaatactatcaaaagtagtgtcaacatcacgcaacacgtgaatcgtggcgccgatgtatggatacagatattccattgacggggcgaaatcaggatacgtcgttttctgtgaaaagacggtatacatccccatgttttcatggtcggctgctttgatcagctgtgttaaggcatcaacctgtttaccgcgggctttaacttcatcccctggttcccagccatagggatagagcgcattacggaaaccaatgagactgtcgtcgtcgccttctgggaaaatagccgcgatccccatgtgcatggtacgcggatctggacggtgctcttcaaaactttcatcaataaagagttgcaactgtttgccagctaccaacggtgcttcatcatgagtaccataattagtatgcatgttggtactgttcgttgcctgttgactggtcgtatcgctggtactgctgcttgcagtattagctgaattgtatttgccgttacggtcatttgaggttgatcgaatcacacttggtgtatgcgtttcaacgtgattaaccactgctggcacatggcgattgttggtcgacgctttggctgtcattgactgtgaggcacttgatgccgccggctgagtcattggctgccagttttgaggatcagcgttggctgcgaatcgattttggcgcgtgcggttaggctggcgattaccatttggcttattgcgattgttgcgcgtatagccattatcacgccgggcaggttcgtgatcggttctattcacattgcgccgtggggccgttactgtccgcttcttgatgtgacgctctgtctgattgtcgtgacgctgctcagtcgattgctgacttgaagatgagctagccgatacagatgaccgattagcttcagtctgacgtttcttagcctcagcttctgcttcctgtgtcgcaacatccggctgctggcgaatcgtgaagcgatgctgccgcgtcggattttttttctgaacaggcgtctgtttcggtgtttgctcgttgttgttgtgctcttgctgattgttggggcgctggttttgccgtgacgtgacagttgaacgcgtcacccgtttggcagtgcgccgtgccggttttgaacttgctgctgcttcagtttgtggtgcagtcggcgtttggctagttgcttgcgactgctgattggctgcccgcttagtttgaacacgcgaggcttttggtgttgtcgctgatttacttgctgacacttgttcagccgatttagtttgtttggcttttgcagctggctgcttcgctgtcgcggctagtttaacctgtttacttgcagctggtttcttaggtgccgtcttcttagctggtgccttcgtagcggttttgtgagcttctgctggcaccttgccagacttaatgatgctttcaatcttagccgcggtcttgcggctcacgctttggccgcgcagtgctttacgcaaagtcggcacggaaacacccatcgctgcggatgtcgcattggtgttcaacttgtgttttgccatataggcatttaatgatgcagtgaatttgtttttgttatccaaaatatttcctcatatcctactttattgaatgatccgtcactagtttaccgcaaaagccgataacggacatagtgacttgaatgtcaagaagcgtgttaacggtgatgcctatttcatgtctacgtttcatagccacctgtttgcgccggttagacttttcttgtatagtcattacttgtatttctcaagacgaaagaagcgaaaataaccatgcaacgaaaactcagcagccgtcacatgcaaatgattgcgcttggcggtaccatcggcgttggccttttcatgggagcaggcgccacgattaaatggacagggccatctgttctgatcgcctacatcattgccggcttattcctttacatgatcatgcgtgcattggtcgagatgctttatattgatccggcaactggttcatttgccaagtttgccagtgaatacatgcatccgatttttggctatctcactgcttggagcaacattttccaatttgttgttgttggtatgtccgaaatgatcgcaattggcgaatatttcaaattctggtggcccgggttgccgggttggctgccggggttagtggccatcaccttccttgtactagcaaatctaatttcggtgcgaatgtttggcgaattggaattctggtttgccttgattaaagtcgtgacgatcgttttgatgatcattgccggccttggcgtcattttatttgggattggtaatggcggccatccggttggtatcagcaatctctggacccacggcgggtttttcaccggcgggtttaaaggcttctgttttgccttgtcaatcgtcctcggctcctaccaaggcgttgagctgcttggtatcacagcaggtgaagctgagaatccgcgaccgaccatcgttaaagcagtgaaagacacgattggtcgaattctgattttctacgttggtgcgattttcgtgatcgtcgccatttacccttggaatcagctcagcacgttagggtcgccgtttgttcagacatttgccaaaatcggcatcacatttgccgcttcactcattaattttgtggtgattaccgctgccttatctggctccaattctggcatttactcagccagccgaatgttatacaccttagctgatgccaaacaactgccacgaattttcaccaaactaaatcgtcatggggtacctttttatccggtcatcgccgtgggcggcgggattttactgggcgtcattttgaatgccttactgccttacattgcaccagccgcgaaaaatgttttcgtgctagtttatagttccagcgtcttgcctggtatggtgccgtggatcgtcatcttagtcagcgaaattcgctttcgcaaagtccacgctgatcagatggccaaccatcctttcaaaatgccattcgcgccttatagcaattatctcacacttattttcctcgcgttcactttatttttcatgctactaaacccagaaacaagtgtttcattattagtaggtgtcgtctttcttggtttggtcgtgctgcattacttgttgtatcaacgtcgaaagcctgcgacgcaacctgttaaagctaatcggcaatagcaaatttcagcaactaattgatatggagaagcgtgaaaactgtctcgtgacctgcaaaaaaatgcacgttcatgcgtaggtaacacgctttttttatcttctttcacaggctctatttaaagcggtcatttttttcacaacttgtataatagatgtgttgaaagaaaggagtcggatcatgaaaacaatcaagattggtggcgtcaatgtcccgatcatgggtatgggtacttggtacttaggcgaaggcaatgcggcacaaagtgaacaggaagctgctgccttaaagtatggactgaatcatggtttgaccgtgattgataccgcggagatgtatggcaacggggcggctgagtcactgattggcagttttcttggtgattatgatcgcgccaacatctatctgatctcaaagttctatccgtcacacgcagacaagcgacagatgcgaacagccctaaaaaatagtcttaaacgattgcgaactgattatctcgacctatatctgcttcactggcgcgggtcaaccccgttagcagaaactctcgaaggcctgcaggatttgcaaaaagaaggtttaattaagcaatatggtgtgtcgaactttgacgttgatgacatggatcaattaacgctggaaccgggcggcgaccaaattgcggctaatgaagtgctttataacttacaatcgcgcggtattgaatatgatctgctgccacagcaaaagcaggccaacattaccacgattggttactcgccatttgggtcaggcagtggcaagtcaattaaactgccaccagaactaagaactttggccacagagaaaaacatttcaacccatcaactgatgcttgcatgggtgctgcgtcatggcgatgtgctcacgatccctcgttcaggtgaagcaagccacatggcggaaaatatcgccgcggcagatgttactttttcaccagacgaattggcgttgttcgatcaaactttcccggcaccgcggcatcatatcccgcttcaaatgatttaacgatggcaacagcgcggttgatgcaagcagccgcgtttttttatggccgcagacagaactgctttaaatccctgatgcatgggtttctgcgactgtaaccgggttattctagaaactcaccgcactaaactttttagcattcctgcctgcaactgctttcttgctgtcataaaaaacgttatactaatagcaatcattttccatgaaaggatatttgttttgaaaatctttgttgtcggtgcccacggccaaatcggccagttgctggtccacaaactgcttgatcgtggtgatacagttacaggcggttatcgtgatccaatcgctcagacacctgatcccgagaaaaactttcgcgccgtggaactcgatctttcatggccggttgatcgcttagctgacctttatgctggtcatgacgcaattgtcttcgcagcaggctcccgcggtcaagatcttctcggcgttgatctagatggtgctgtcaaaacgatgaaagctgctgaacgcgctgatattagtcgattcatcatgctcagcgcccttgatgctgaagatccggacaaatggccagaccagttgcacgattattacatcgccaagtactacgctgacgaatggctcattcacaacacggatctggattacgtcatcgtccagccaaccgcgctcaccaacgatcctgcaaaaggcagtatcaccttgcagccgcaacgaccatcaactatttcgcgcgcagatgtcgcggacgtcctagtggcagccttagacagcaatcgccatcgagacacagtgaagattgcaagcggtaatgaagcgattgtgaaagcattacatgtttgacgacagtagcttcacgtggtaatttaaagctaagttaaattcgaaagtgaggtttcgtccattgaagtaagccaattgttgaaaatgtccaagtcctgtcatcatcaacgggattagtacggactttttgacaattgggcttgatcaagtacggcacccccgtttattttggtcagtcccaaagtgttattggactggcttttttgttgcatacaagccaacgcagttatgctgccaaataacccaatagcaaggctgatgccgctaactttcaacacttttcagccataaaaagtcataccgattcacgttctgatcacgcaggcacatccccgaaaggacgtggctgtatgtctacgattcaaattaaacagctcaattttgcttatgacggtcaagcaccgctttttacgaacacaacctttgaccttgataccaactggcatctcggattggtcggtcgcaacggtcgaggcaaaaccactttgttgcgaattttacaacaagcactcccctacagtggcacggtgactgttcccttgcagttgcaatatttccctcaaacgctggatgaaacccaactgacgctgactgccgcacaagccatcaccgatgttgcgcaatggcaactcgaacgtgaactaaatctgctccaagctgatcctaacattctctggcgcccatttgtcgatttatctggtggtgagcaaacaaaagtgcgtctcgccttactgttcattcaagacaatggtttcgcgctcattgacgagccaaccaatcacctcgacctgcgcagccgccgacaagtcgccgcctatctccaacaaaaaaccggctttattgtcgtcagccatgatcgtgattttttggacagcatcaccgaccacacgctagcaatccagcggcagcaaattaccctctatcaaggcaatttctccaccttcatgaccgaaaaagagcggcaagatcaaactgaactggccaaaaatggtcaacttaaaactgaaattacccgacttaaacgaacggctcatgataaaaaagtttgggcggaaaataaagaaaagagtatctatggtaatccgcacatcaaggacagcggtcataatgctggtcgcgggtttattagcgctcgagctgcacggacgatgaaaaaaagtaaaaatctcgaacaccggatgactaaagaaatcgatgagaaggaaagtcttctgaagaacctagaaaaggttgatccactcaccatgctgccggtatcgacccatcaccatcaacttgtggtcgctgaaaaggtccaagtcggattcgatcaaccccttttccagccgatctcttttactttgacccgcggcgatcggattgccattgttggtgacaatggcagcggcaagtcgaccttgatccgcgccttgctgcagcagttcaccggcatgcagtcagggcacctcaccttggcccccgtcagtcttagtcttgttcgccaacaatacaccgataaccgcggtacattagtcgactttgccaaacagcaccagcttagccgtgaaaccttgcttaacaacttgcgcaaactcggcatgccgcgagccgactttaacacgccgattgagcatctgagcatgggccaacagaaaaaagtcgaactagcgcgatcactagccaccccgggagctttgtacatttgggacgagccgctcaattatttggacacttacaaccaagaccagctggtcgccgccatcaagcattatcaaccgacgatgctttttgtcgagcacgatgagcattttatcgagcaagttgcgacaaaaatcattcgcctgcaaccatgactgactgaacttttatggcgacactagcgataactgcttagtttttttgacaaaacaaaacccattgaaaatgtttgttatccgttccaaaacgccttggtacgtagcgattcaggcgttgcaaacgagactcaatgcccccatgtaaagcggttccatgttatactcacggtgatagctataagaaaggatgaatagcatggcagaacgttctttgtatcatacctatgtccgcaacgaaaatggtttagtcggtgaaagttatgttgaaggtaatcaaggcttagcgttgggtgtttctagctccttgattgatgcccctgggaccaacccggagcagttcattgcttttgccttgtctacctgttttaatgcgaccatccgcatcgtgcagcatcgcgaaggcactgctgaagattcccagctccgtactcgtgtggacatcacccgtgacaagattggctacaaattcatcgtagacgcacaaatcttgatgccgagccacacccgcgaagaagcacaaaagattgtcacccaggcactggacgaatgcccagttgccaaacttttgaaagaaaatgaaaatgtcagcttccgcatcgttgatgatttcacagacgagccgacactaggcgagtaagtcatcagcgccacaactttttctcaaagataataaagaaggtaccggcgtttaggctgataccttttttgttttttcgtcaagaagcgcggtcactcgactattgaatgcaacaatgcgctagcgtatggactaattggaggttattaaaatgtcaaaatcatctttgtgggtccgcaaacatcatcttgttttggcacttagcctgctactgggcagtgtggttttccttgctatcggtttatgggcaacgattttactgctgttaaccgtccaaccaactgtttcattaattctcgtcctgcttggcggctggcttgtacttggcgggatcgccgccagcgccatcaccttgtggcaaatcatccgttcaccgcagcaggtcaccaacggcgttcgttgcttgcaatggctcctaggcggcataaccatcatcattgcgatcatcagcttaaccttcagctacctatgggctgaaagcggcgatgcaccaggattaatcttcataggcttgtttgtcgctgcgatgccgtttgcttgttggatgcttgttagtgtgtggcaattaaccttgaagcagcaagcgtgagagcctgcctagaatgaaatcaggtggcttggactactacaaggaccagcgccgcaataatgctgtcgcagtcgcaaaagcctgaatataggcgatcctgtttgcgctcataaaaaaagacccaatcggtttcccgattggatctcctttaacgaaccaagaattaaagcttggtaacgttagcagcctgagggccacgatcagattgttctacatcgtaggaaacagcctgaccttcgtcaagactcttgtagccttcgccattgatggcgctgaaatgtacaaagacgtcttggccgtcttcaccagtgatgaagccgtaacccttatcagcgttgaaccatttaactgtacctttttgcatgaaaatgaatctccttttcaaaactaacaacaacagacaaccgtaatcctaaaaaggaaattcacgtaacatgatgtttcccgttcaagtattaccatgtacagagtataacacgttcggaaaaaaacacctaattatttcgtgtttttttctaattaatgtctaaatatacctacatgccttgataatacatcgcgtcagccactttcagaaagccggcaatattggcgccggcctcataatcaccggccataccatattcagcggcagcatccgcgctagctttaaaaatatgctgcatgatgtcatgcagttggccatcgactttttcaaaactgtcactgaggcgccgcgaattttgactcatctcgagtgcggaaacggctaccccgccagcattggccgcttttgccgggccgtacaaaataccggcatcggtgtaggcagcaatcgcctctgggtcgcttggcatatttgcaccttctgccaccgcgatgacgccagcagccttaaaacgcgcagcctgagtgccatcaatctcattttgggtagcgcaaggcagagctaaatcatactgaagatccgcgtcccaaaccgagccttcataataatgggagtcagcaacccgatctgcgtaagcttttatgcgcccacgttccacttccttaatctgcttaacgaccgcgacatcaataccattttcgtctacgatatagccgtttgaatcagaaaccgtgatcaccttgaccccaagctcctcagctttctgcgtggcgtaaatggcgacattcccggcgcctgaaatcaccgcccgcttgccagccaaagattcaccgttggccttcaataactcgtctgtatagtaaatcaagccatagccggtcgcctctgtccgcgccagcgatccgccataactcaaccccttgccagtcagaacgccgcgttgtgcgcctttaagccgcttgtactgaccataaagataaccgatctcgcgcgcacccacgccaatatcgcccgccggcacatctaagtccggtccgatatacttactgagttccgtcataaagctttggcaaaaacgcatcacttcagcatctgacttacctttcggatcaaaatcggcgccgcctttcgccccaccgatcggcaatgtcgtcagactgtttttaaagatttgttcaaagcccaagaacttgacgatgctcaaattcacggaaggatgcaggcgcaaaccgcctttgtatggtccgattgccgaattaaattggacgcggaagccgcgattgatctggatttggcctttatcgtcctgccacggtatggcaaattgaatcgctcgttctggttcaacgatgcgtccgagaatattagctttcatatattcaggatgtttttcgagaaccggtgtgatggtttttaaaaaagctgatgctgcttcaaaaaattctggttggttcggatcgcgttgtttgagggttatgagaatggactgtacgtaagatgctgctgacatgagggaccacctttctggaagaaaatgtaacaagcgttgtttcaagactaacagaaagatggcagtttgataagaaagttatcttgatattaaaaatattcccagtcgtttatcaagccctgcatgcagacctctgttacaatgaaatcggatacatgcaacagctttggcggcaatcgattttatggcgcgtcgtaatcggcttcataactgctcactcatagtcgtttgtcgcagttttgggtacctgtcgtcaagatcttcatgaggaggaatttgagatgcggaacaacggcaatattattttaattggtgatggcgcgattggatcaagttatgcgttcaactgtctcaccaccggcgtcggccagagtcttggtattattgatgttaacgaaaaacgcgtgcaaggtgacgtcgaagacctttctgatgccctaccttacacgtcacagaagaatatttatgcggccagctatgaagattgcaaatatgccgatattatcgtcatcacagccggaattgcccaaaagccaggtcagacacgcctacaacttttggcgatcaacgcaaagatcatgaaagaaatcacacataacattatggcaagcgggttcaatgggtttattctagtcgcatccaatccagtcgatgtccttgccgaattagtcttgcaagaatccggcttgccacgtaatcaggtgctgggatcagggacggcgcttgattcagctcgcttacggtctgagatcggcctgcgttataacgtggacgcccggattgtgcacggctacatcatgggtgaacacggcgattctgaatttccagtttgggactacaccaacattggcggcaaaccgattcttgattggattcctaaggatcgccaggataaagatctgcctgatattagcgagcgcgtcaaaacggctgcttatggcatcattgagaaaaaaggtgccactttctacggcattgctgcctcattaacccgtttaaccagcgccttcttgaatgatgatcgcgcagcattcgcaatgtccgtccatttggaaggcgaatacggcttgtcaggtgtttccatcggtgtaccggtaatcctcggcgctaatggcttggaacgcatcattgagctggatttgaacccagaagatcataagcggttagcagattctgcagctattttgaaagaaaatctgaagaaggctcaagaagcttaagctcgtcaggttaagcgctcagcttaacggtgtctctccagacgagtatcactaagccaccgtaccaaaaaaccgctgtccgagaccgcccgtcacaacgcgggcaatctcaggcagcggcttttttaatctttttcttgtcctaacgcagcagtttcttgctcaaccgctgatccctttgtcagagccgagtgacgcatgccgtacaggaaataaatggcacagccgatcaggaaccagacaccggaatacagtttggcttgaatgtcgagcccaaggaaaacgataagtgatcccagaaaggcaactgctggcaaaactggatacagtggcatccggaagcgcggtttggcgatatcttggccttcacgcggacgcaatcgatagattcccagtgtcacgaacataaaggctatcaaggtgccagccgaaatcagttgggccaaaaaggcaaacggaaagaaagcgccgatcaaaacgccgatggtaatcaaaacagccaaggcatgattaggcagcttacgactgttcagcttacccagtttttgcggcagcatgccatcacggccaaaactgtaaagcaagcgcgacccagccatggacatcccgatcaaagccgtgaacattcctaagaccgcaatgctttcaaccacaacggcaacgactgcatggccagaatgacgcaatgcccagccaacgggctccgcgttattggcataatcctgatatgggaacatacctaacaacacaagaccaaccgaaacgaacaagaacactgcaatcagtaacgaacctagaataccgcgtggcatcgttttctctgggtcaatggcttccgcagaattagcagcgatggaatcaaagccaatataagcaaggaaaatcattgaaactccggcatagatcccctgccaaccaccaaatggtgtgccgtcagcattgagatgataagcaggaaagaatggatggaagttttcagggtgaatcgcagtcaagccgaccaccaagaaaagcaggattgccagcaccttcatgacaaccaagatgttttcaacgcgcgcagcacttgataccccccgcgacagtaacaagccgaccagcaccatgacgaccactgcaacgagatcgaccatgccaccatcggtcccaaccggatttgccaaggctttaggaaaattcacgccaatgattgccagcagcccgcggaaattagctgaaagtcctgacgccacaaacgccactgcgataaaatattccgccaataaagcccagccggcaatccagccaaaaaattcgccgaaaacaacattgatccaagaataagccgaaccggcaaatggcatcgccgctgacatttccgcgtaggcaaacgcaaccagccctgcgactatcgcggctactaagaaagaaatcgacacagcgggaccagcatgttttgccgccaccacccctggtaatgtaaaaatcgaagccgacacaatcgtcccgacccctaacgcaagaaaatcgcggacgcgtaaaacgcgcggtaaatgtgaatccttatcttcataaacacttggatcttcttttctaatcaatcgttgccaaacttgccccatcggtaacctccatggcactgctcatcaagcagtcagtctctcacatatttaaaaaacgtatgagaaataggttagcacatttcagcttggctggaaagcgctgtgagtttaaagacattcgttattgtccaatgtgagtttaaagacactcgttatcattttgtctgaaattagccggacataaaaagaatcgcgaaaaaatcgcgattctttttatcaaactaaacttgttcactttcttcagcttcattggccttttcaggtgtgacaacttctgccgttcccttgcctgccgctttgaccttagctcgaatatcaaccggatgtccttcacggcgatcgtcggcatactcggcagtcgcggtgaacagcaagtcagacgcggagttaacagccgtttcaactgaatcttgaaccacgccgatgataaaaccgataccgacaacctgcatggcaatatcatttgaaatgccaaacaatgaagccgccattggaattaacaacagtgagccacctgcgatcccggaaaccccggtagccgagatggcagacaagaaacatagcagcaaggccaggaaaatgctgacatgtacacccatggtattggcggttgccaatgtcatgatcgacaccgtaatcgctgcaccaccagaatttgccgagccaccaagcggaattgagatcgcataactttcttcatttaatccgagatcttttgatgccttcaagttgatgggaatattgacagcgccgcttcttgtaaagaatgccggaatgccactgactttcagcgtccaaaaagtcaacggatacggattttgccgggtcatcaaccaaaccatgaatgggtacacgactaagtaaacaaataccatcgtggcaaccagcagcatgagcagctgaccatatgccatgacccctttgacaccagttttgctcaaggactcatgtaacaacccgacaatcccaaacggtgcgaactgaatgacattttgagcgacagcgctgacagtatcggccaattccgtgaccacctttttggtcacagcactggtcaatcgtaaaccggaaccgatcagtaaggaccagaaaagaatagctaggtaattaccttcaaccaatgcagagattggattggcaacggcattggttagtaagctcgtcacaacagtccccagatctttcggtgcactttcggcgatcttcatcgcaccgggcaacaccaatttgatcggaaaaagatacgagaccgccacggcagcaattgatgaaaacaacgtggcactgagataaagcacaataacggtgccaaagtggttcttcgcacctgagcgatacttagagatcgccgacataattaatagaaagaccagtagtggtgcaatcgcttttaaagcgccaacgaataatttaccgagaacatcaataaaggaccaggagggcaccattacccctaacactgccccaacaatgatcccaatgacaatttttaagatcaacgaaacatctttgtaacgtttatacatcttggcccctccttcatctaaaattaacttttcatgagagcacctcttagtttgccttatttttacaacaactgcaagcaatttaattcaaataggatcactttttaaagcaagaacaggaaaattgaataacgcgcttaattaaaagcgcttatccaccattgccatgatttgctcatttttaactaagcgttagtaccatgtatcgtcatacgagcaccttgctcttcggcatgccttgaaatcgaaaaaagcacaatgtccgctgacatcgtgcttttttaatcaattgttgccgctcacgcacacatggaaaccgtaagtgttggtgaacacgccattattcaactgttttgcctaaacgctttttctttggcgccgtttttgcttgattggcgtcagcatctttataaccaaagaagtaaaccagtaggaaggcagccacaagcgtcacaatggaagcaatccagaaattccataggttgttcggattgtttgcccaacccggagcagcaaaagaagggaatcctaagaaactgccagtaaagccatacatattaaccccaagaagtccattaacgagaccgccgattgctgcaccaatgcttgcaaaaatgaagactcgaccatacttcaagttaaccccgtacatagcaggttcggtaatcccacagcaagcgctaataaatgccgaaagcgataaccctttgagggccgggttatgttttgtcttcacccaaacagccaacgcacctgcaccttgcgcgatcatagaaatggaaacaattccgtttagtacagactcaggatgtgctgaggataattgtgctgtaatgatcggaataaccgcccaatgcaggccgaaaataactagcacttgatagaaaccagcaataatggcgtccgaaatcattggtgtcaaactcagcaaagcctgaatgccagccgtaatcgcccctgacgccacggtaattagcggaccaacaacaagcacaacggtcatcccgactaaaaagatctcaaccaaagggctgaaaatcattctaagtacaagtggcatccagctcttgatccatggctcaagctttgctgccatccatgcagcaaaaatcattgggaaaatggaataggtgtaattggcaatgtgtactggtaatccgaagaagttggcgttgatacccatgcccagcaaagtgccgctaactttacctgtagttgcaatttgcgcaatcgagggataaatcaggaatgccccgataatgccgacaataaccggatctgacccaagtttctgtgccgctgtgaatccaacgataactggaagaaagtagaaagtggcatctcccatcgcattaataatctcataagtcgggtttttaactgataaaccgccccaagtggtcaaaatattcaaaataccttttagcataccactggccgctaacagtccaataactggaatcatggacccagtgattgtaccaatcaacgcttgtagtccatgcttaaccctgccccatccgctagtatcttgagcttccagctgggtttcttggattgcttgcgcagtaccttcagcatttgagtagccgggtcccaattgtttaatcacttcatcatacacatcagtaaccgcttgcccaatgaccacctgatactggccatttgcacgcgcaacatcaattacgccgggaatattcttaacggtgtcaacatccggtaactgttcatccttcagataaaaacgtaaccgcgtaatgcaatgaatcaggctattcacattctgcgaaccaccaacatcggcaataatctgccgagcggttgcggcatatttgctttcgttctttggcgcagcagcggctgttgcggccattggctttggcgtcatcacggcaacttcttcaccgcggttcacttcaccagcattgacgtcgagatgatcgaggacttctttgctgttggtaatcgcaacaatgacggttgtctttttcccagctttcttaatcgcatccaaatccatcgatccgatgagatcacctgctttgacacgggcgtccatagccgtatcaatttcgaatggtgcgcctttaagctcgactgtgtcgattcccaaatgaaccaataattctgcgccgttatcggctttgatgccaatcgcatgtttggtgtccgcgatcatcataatccgaccgtcaactggtgcggcaatctgaccatcagtcggatcgatgccaaaaccgtcacccatcattttctgtgaaaaaaccggatcagaaacatcggtaattgccatggccaagccggagaccggtgccatgagctgcaactttttcgtatctgccatttcttgttcccccttttatcaacacgcttgctggcacgaaaacccagctgcgctttgtcttaagtgccttcttctagcgaaccagccaaatcaagctttctgcaataacccaatcgtcgcgtatggcggcaatgtcatggttgcggttggcgtcaatgtagcttcgttcgtgattaatacttttgcagtttgaaacttttcgggtagcggtacggtcattgtcttgtcgctgaaattattcagcaccagcaattgttgtgtgccatatgttcttatataggcatacaaccgatcaatttcagttccaaacggcgtgtagctaccgtcactgatcactggatactgtttacgcaatgcgatcagctgctgataaaatttaaaaatttcaccatgtgcaagctcagcctgcacattaattgcagcttgatttgttggtcgcaaccaaggcgtgccagtggtaaagcctgcatggtccgaggcatcccattgcattggcgttcggctattatctcgggctttcgccaaaataatgccgaatgcttctttttcagacatgccttttcccagcagtgctgcataagcattcttagcttccacatccacataatctgccatgctggtgtaatcaggatcagtcatcccaatctcctcgcccatatagatataaggtgtgccgcggctcaaatgaatcgccgctgccagcaattccgcgcttttaacccgatattgcccgacatcgccaaatcgattgatggcccgcggttgatcgtggttgttccaaaacagtgcctgccaaccaccaccttgatcaagtccctgaccccaagtgtggagaatatcgcgcaaggcgttgaaatcatatggcaccttgctccacttttcaccgttcttgtagtctgttttaagatgatggaattgaaaaaccattgaaagttcatggttgtccggtttggtataagcaatcgaattggcaattgtggtggaactcatttcgccaaccgtcacacgattatcatcttgaccgaagctgtttgctgccagctccttcaaatagtcctgaacaatcggtgtatcggtatacaacgttttgctggccacacttggcggtgcatcaacaagcttatcggctttaccaataacattgagaacatcgaaccgaaaaccatggacaccttttgctcgccaaaaattgataatggcagcagcttcttgtcgaaccgctggattgtgccaattcaaatctgcttggcgtcgttcatataaatgcaaataataattgcctgtatcgccaaacggtgcccaagctgggccgccaaacttgctttcccaatttgttggcaaactgccatccggctttggtggtcgaatgtaatagtatgcctgataatgtttgtcacctgctaaagccttttgaaaccaagcatgctctgtgctggtatggttcagcaccatgtccagcatgatgtcgatacctgccgccttaagttttttggccaattcgtcaaaatcggccatggtcccaaagcgtggatcaatttgacgataatctgcaacgtcataaccattgtcatactgcggtgaaacaaaaaatggattaaaccaaatcatgtcgacatgtaatgacttgaggtaatcgatcttgtcgataatgccgcgcagatcgccaaccccatcgccattgctgtcataaaaagacttggggtatagctgataaatgactttattatgaaatcccatggtgactccctttcctgaaaagcgtttgctgagcttgagacctaaacacaaaggctttcaaaaccacttaaattttgagtctcaacatatcagatcacgctatgcttgaaacgcgttcgcaggcgcagaaacctgcatgtaaggaccttgaacgcaatagccaaacccaggccatcacgttcaaggccgcttacattccggtttctaaacgcgcctgctcacgctctatggtcgtgcgcgccgggcgaagtcgtggaacttgaagcgatctgcccggtgccgtgactctgtgtattgaaattttctagtgtctgccaaactactgcaactgcgaacaactacaaccatggcaccttcaggaagatttagataacgacgatcttcttcagttgccgtttcaaccgtgatctcttttgtggcataagcaatttccaagccaatttgtccttcgagatacgcatacaacgaatcccttgccaccgactccggaatcggcggcacgactcttggatccaaataatcgatatcaatgatatccggctctttttccaagtaacgcactcgcttcagcaaacgcatctgcttgacttcaacatccggatcaacatctttaaaggacttggccggaagtgcggcaaaatgattggccaacaccacggttcttgtctgcaagtgaagctgcttagccaattcggcataactgacgacacctgacaccgggaagacatattcttggcgattgatcacgattgatcctctgcctttctgcgattgaatgaagccatcatctttgagcagccgcaaagctttacgtaccgtgtcgcgcgatgcctgatacatatcctgcagcgtattctcgctcggcaataatgaaccagtcgtataaatttcggcctcgatcttatctttcaaatcctgatagatcacatcatacttccgcatgccttctcctccagaaatcgctttcacttgcaaactttattttacctgtacgtacaggtatgtcaactaataatgtttaaacgtttttaaatacttcgcgttatgaatcattaatgttgatataccgggattttagcgtgcaaaaaaaatccatacatctgtatggatttttccagagcttattcatttataaacttcattgttatagaccaatacaaccgtcaatttccccaatcattcgttgatcacgagcagcctttttcgaggctgtcacagtattagccaatcaatgttccctttcgagtgaatccgtcaccttttcatcacgagccacaacgctgaactgccggcgaatgcgaatcgagagaataaaagcaaccaattcaagcgcaacgaagaaaatcaaactgtaagtatagctgtggaagtattgatcgctaaggctaagcagggtcggtccaacaactccagcaactgcccacgccgtcaagacatagccgtgaatagcgcctaactgtttcgtaccaaaaacatcgccaaggtaggctggaatgacagagaaccctgcaccgtagcaggacatgatcaggcataaggcgatcccgaagagcaatggtgagctgaataccagaatgccagccaacatagcgacatccaccgtaaaaatcagtgtgtacgtcagcggacggccaatcagatccgagagtgttgcccaagccagtcgaccaaaaccgttaaacaaacctacgaccccgaccatcatcgctgccgtagccgcagacatgccggtttgctgttgcgccatcggtgacgcaacagcaaccagtccgatcccacaggtaatgttgatgaaaaacatcagccacaggtagcggaatgaacgcgttttgactgcctgattggctgtcatggcagtaccggtcaaactgacacttttagcaatatcagcagccggaacctcacccggacgtggcttccggataacctgcgctgctgtgagcataataagtaaatatgcggtgccgagcacatacatcgttggcaccagtccaatcccagcaatcaagttctgagcaatcggaccggtcagcatcgcagcaaaaccgaagcccataatggccatgccggttgcgagcccgcgcttgtctggaaaccaagcaatgatggttgaaaccggggtcacgtaacccgcacctaatcccaaaccaccaacaacaccatacccaatgtaaagtaacggcaaagactcaagttgcaccgccagtcctgtcaacagaatgccggagccatatagcaacgccgcaactgtccctgtcagtcgcggaccaaatcgctcaaccagccgacccataaaggcagcgctcatccccaagaagaagatcgcgatactaaacgcaactgtcaccgatgacaacgcccaaccggtttgtttggcaatcggtcccgtgaaaacactccatgcatacacggaaccaatcatcaggtgaagcaaaatgccggcgatagcgaccagatatctacgcttactcattcgttacctccatcatcccaatatttatcagaaccgtcctacccatcgttctgatataaaaaggataacatatattattgaggctaggaagccattgcaaccgtttcacaaacgaataaaaataaaaaagactccgattttattcggaatctttttacaagttattcaaacaccatttgattgtggtaaagctcggcatagaagccattttgcgcgagtaattgctcatgactcccttcctcaatgatgttgccatcacgcaagacaacgattttgtcggcattcaaaatggtctttaaccgatgggcaatgacaaaactcgttcgcccttgaatgacgttatccattgccgcttgaattttggcttccgtaacggtatcaacattacttgtcgcctcatcgagaattaacaaccgcggattggtcaaaatagttcgcgcaatcgacatcaactgcttttgtcctgccgagaaaacactttgttcatctgaaacaaaggtatcgtagccttctggcaagctcacaatgaaatcgtggatgttagcctgtttagccgctgcttccacccgcgcttgatcagcatcgggatcgccgaagcgaatattatcgcgaattgtgccggaaaagagttgcgggtcttgcaagacaataccgacattttgtcgtaatgaggcgagcttgaattcgcgaacgtcgacgccgtcaaatgtaatcgcccctgagtcaacatcatagaagcgattcagcaaattcataaccgttgttttaccgctaccggttgggccaaccaaggcaaccatttcgcccttatccaccttgatggtcacgccatgcaaaatttctttgccagggatatagctaaaatgaacattgtcgatcagtaactcatgcttgagtccgtcaagcgttttcccttctggcggatccacttcatcaggttgctcccgcacttcagtaatccgtcgggcgccagtgatggcgagctgaatcatgttgaatagactggtcaactggacaattggctgataatactgctgcgcataattgacgaacacaactaccaaggccagcgccgcgccttgactcaaagaaccattcagtgccaaccaagaaccagcaaaaatgacaatcgcggtgttcaacaatgacaagcccatcaacaatggatttaaaataccgctccagatctggccgcgcaggttggacttacgcaccgccgcattatacggctggaaaccggcgacactttcctgttgcaagccattagtgatcaacattttttggcctgtaatctgctcgttgatataaccgtttaggcggccaatatcatcttgttggcgatcaactgagacactcgcttgatgcatgacgaaggccgacagcccaactgcaacgggtgttgatgccattgtgatccaggccaacgtcgcattttgggtgaacatcatccagataatcccgataaactgggcaccgcttaagaagatttcaatcaacgcctgattcatggcgttgaaaatattatccagatcacttgtaaaccgcgataaaatatcgccgtcactgtgactgtcgaaataattcactttcatccgttgcatttttcggaataatccgacccgcatggtaccagtcgagtagccactgattttagacaacaataggcttgagataaggatgctagtggcatcaatgatgtaaagcaagacgaaaatcgccaaggtatggttaaatgtcgtaaatgttgcttgtgccctagttgctgggttcatccactgctgaacataggttgccagttcttcgatcgctcgtcccatgtaagtcggtgcgaccacaattgcccaggtcgagatgccaaccaaaatcgtcgtgatcaaaaactcaatccaataaggtttcagataatgcgcataaaatttacctgcatttttcaagtctttcatttaatcacaccccctcttccaatgccttttgggtggcatagatctcgccgtaaacatcgttatgttgaactaaatcatgatgtgtgccactgccgactaaacggccttcatcaagcactaagatacgatctgccttgatgatagaactgatcttttcggcaatgataatcgtcgtcgtatcacccagctcgtgtgccagtgcctcttgaaccaatttctctgaatgggcatctaaagccgaggtcgcatcatccaaaatcaaaattttcggctggccgatcacgccacgggtaattgacagacgctgcttttgaccaccggaaaagttagaggatcgctcctcaacttcggcgttgtaagtgcgtggcaagcgttcaataaattcagccgactgagcgattcttgccgcccagcgcatcgcatctagattgacgttaggattcccctgctgcaagttttccgcaattgtaccggaaaaaagcgttgatcgctgcaagacgaagccaaccgttttccgcaaatcggcttcggtgacagcacggacatcgtgaccgccaaccttgacaatcccggtatctggatcaaacagtctgggaattaactgtgctaatgtggttttaccactcccagttgcgccaacaataccgatcatttcaccagatttcaccttgaaactgatgtcagaaatggttggcttttcatcaccaggataggtgaacgtcacgtcatcaaattcaaccgcgccatctaagtcacggtgcgggccagagacgaatgtcatactcggctttgtgtccatgacttcttgaatacgtttgagtgaaaccaacgcacgtgaagcaaatgtcaacatgaagccaccattgataatggcaaacagaatctgcatcaaatagttaataaagcttgtaattgccgccagattgctaggatgactagtaatgtcctgtccgatcagccaaatactaccagccatggctaaattagccacaaggaagaacgccggcattagcagggcgaacaagttcccgatcttgacgctgacatcccgcatttcatcactggactcagcaaatgtcttgatctgattcgcgccttgaacaaacgacttcaccacgcgcatgcccatcagattttctcgggctaacgtgttgacgcgctcaattaattgttgcatccggccaaagtatttgcccatatgactgaacgagaaaaagctgacgccaaaaactaaaatcatcatcaccgcaataacccaccacaattcgggcagtgtcataatcgcgagaatgaccgcgccaacgaataaaatcgggattcgcgtgacttgttgaaagaagcccatgatgatttgctgaacttggttgatatcgttggtcattcgaacaaccaagttcgatggcgaaaacttttcaacatccgcgtacgccaaactctgaatcttagcatattcgtctgcacgcaaatccgttgccacgcccagcgcaacccgcgccgcgtaaatcgtgttgacgatcccgccaataatcccgatgatcgccagtccgatcaaatacagaccattaatccagactgtctgcttatcatttttcatgatggcattcatgattacctgcaacaaatgcggctgccacaacgttgcaaaggccacaatcaagatcgccaaaaccgaccagatcacgtcccaccgatattttttgatgtacggaaacaataccctcatgatgtctttctccttctataacttgttttaatagcttaccgcaatttggaaaacaagtcagtgaaaaagtttaagagcgtgagcaggcgcgtttagaaaccggagcataagcggcctcaagtgcaatgaccgcactttggtcattgtgcttgaggtccttatgtgcaggtttctgcgcctgtgatcgcgtttcgaagcagagcgtgagccaccccggttagaaaccggagcatagggcaacataaagcctacatttagctttctatgccgagctggctacgcggcgattgggctggaacgcactgggcacgacttcaagcccgcaaaacccgcggtcttgaagctcggcctttgtctaggcggagaaaaccactccgccaagacaaatttcagtgctgagcccatcgccgctccgccagctctcttcttttagttcaagcgtttaaatcgtctgctattgccgcgaaaaaagggttcgcagtcgcacttcgctacgccgaactaaccgctacttctcacgctcttcgaacaaagttcttgacaataacaagcttcgtcagtaaactagcttcaacattgaaatgcggaaagatgagtagttgttagtttcttgcttagagagtgtccatttggtgaaaggacatcaagaaacggcagcgaatatggtcttggtgatgcaggaacgctgagcgattgcgaggcggtcatggggacgcccattattgcgttaggtctcacagctatttgctgtcggactgattgaggaaagtcgtgtgaacggctttcaaaccaaggtggtaccacggtaagccgtccttggcgcagacaatttgtctgcgctgagggcggcttttttgacattcacgattttctcgctaaacaacctttcgtgaacccaaacaagcaccgcacctttccgcaactaaatttccgctataacgcgttcgtcagaccagcaaccggtctggctcgcgctcactaactgaggaggatttcttttatgacaacaacaatcatcggctacccacgcattggcgaacatcgcgagcttaaatttgcgacccagaagtatttcaaacatcaaatcacagcacaggaattacaggaacaagtgaaagccctgcggcagcataattgggaaactgttcaagcggccggcattaaccagattccgactggcgatttttccttcttcgataacaccttggatgttgccaacttgttgaatatcgtgccaaagcgatatcaagcgctgggtctgtcgccgctggacacctattttgcccaggcgcgcggttatcaaggcgaggctggtgatgtcaaagctttggcaatgaaaaaatggttcaacaccaactatcattatctggttcctgaattcgatcaggacacacaaattaaagtgacagactggcaactatttgaccagtttgaagaagcaaaagcattaggtatcaatgcgcgcccgaccttggttggtccatacacgttactaaagctatcacggttcattgatgtcaccccagatgattttgtaacagatttaattgctgcatacaccgacattatcggacgcttgcatgctgctggtgctgagtggattcaggtggacgagccggccttggtctatgaccagacggacgctgacctcgccttgttcgaacggctgtacaccccacttctggctcaaaagcaaagcgccaaagtgttagtccaaacgtattttggcgatttgaccgactcatttgatcgcatcagaaagttgccatttgacggttttgggcttgattttgttgaaggccatgccaaccttgatcttctgaaaacgcaaggcttccctgcagatgcaactctttttgccggtatcattaatggcaagaacatctggcgcacacattatgccgatgccttagcaaccattaaaacgctggcaaagatcacagataagctggtgttaagcacctcaacctccttgttgcatgtgccatacaccttacgcaatgaaactcatttaaagcctgaggaaaaacaatacctcgcatttgctgaagaaaagctcagtgaactgcacgaattggatgctatcttcgaaaccggtgctgatcacaaagcctatcaagccaacgtcgctttgttcagcaagccccggtacgcagaaaataaggcattgaatgaaaagattgctgccttaactccggccgactacacgcggacgccggaacggaaaacccggttggcgattcaagctaaggcgttcaagctgccgctattgccaacaacaacgatcggctcgttcccgcaaaccgctgaagtacgacgcaatcgggcaaaacttcgccggcatgaaatcactgaagaacaatacaccgccttcaatcacaaagaagaaatcaaatggatcagattccaagaggaaatcggccttgatgttcttgttcatggtgaatttgaacgaaatgacatggttgaatattttggtgaaaactttggcggcttccgcttcacggacaacggctgggtgcaaagttatggtacgcgcggtgtgaaaccacccattatctggggtgatgtttatcgcaccaagccgatcaccgttgctgaaactgtgtttgcccaaagtcaaaccgaccacctcgttaaggggatgctcaccggtccagtcaccatctacaactggtccttcccgcgtgaagatctgagccaaaagacgagcgttgaacaaattgcattggctttggaagatgaagtacttgatcttgaaaagcatggcatcaagattatccaaattgacgaaccggctttgcgagaaaacttgccgttgcgcaagaaagattggtacccgaagtatctcgattgggcagtaccagcttttcgattagtcggcagcaaggtcaagcctgaaacacagattcacacccatatgtgctattcgcagttcggtgatatcatcaaggcgattgacgacctcgatgccgatgtcatctcgtttgaagcggcccgttccgacttcagtctcttggacatccttaaggcaacccattttcagactcatgttggtcctggtgtttatgacatccattccccacggattccttcaaaggacgaaattgtgcacatcatccacgaaattctgaaacgtctgcctgccgatcatgtttggatcaatcctgactgtggcctcaagactcgtgatgtcccagaaaccaaggccagcctcatcaacatggtggcagcggctaaacaagtacgtaaggaactcactcatgaaaatcaaccagtgctttaaagatcatcaagtcatctcatttgaagttttccccccgcgcaaaaatgcgagcaatattgctttgactccgattctcaacaccctcgatgcggtcaaagaagccgatcctgacttcgtttccgtaaccttcggcgccaatggcaacaagcctcacatggggacactcgaagttgccaaactgattaaagatgagtttgatatggaacccgtggcccatctgccagccgctcaactcacccgagaacaggtagatgcagaactgcgcggttttcaagatgctggcattgacaacatccttgctttacgcggtgatatacccaaaagcggccgcgttagtaacgattttccctatgcctgtgatctgatcgaacacattcaccaagttggcgacttcaacgtagtagcagcctgctatccagaaaaacatcctgaatctcctgatgtggtcagtgatattcaccatctcaaagaaaaagtcgactccggtgcaagccaactgatcagtcaacttttcttcgacaatcaggttttttatcgatttcgcgaacgagcacaattagccgggatcaacgtgcctatcgaagccggcattatgccagtgatcaatgaacaccagatcgaacggatggccaccatggccggtgtcaacttgccaccaaaatttgtcgcaatgatgcagcatttttctggcaataaagaagcgatgcgtgatgctggtattgcctacgcgattgatcaaattgtcgatttgctggtgcatggcgttgatgggattcatatctacacgatggacaatccaaccgtcgtcaagcgcattgctgctgcgactcagacgattcggaatgcttaattcagcttgattctttctattaaatggtcacggcacgatgccggggccattttgttttatggaagcgactgcttttgggttcgtgtttaaaggagggcgtgatgggtctcataacgccttggtcagaccagaaacctacgtataaggacctcaatcctaagtggccaaagatcggtctacttgtgcgactccgaaacgcgttcgccagaccagaaacctacgtgtaaggaccctgaacgcaatgacccctagattgcataattaaagttaccacccagaaaatgtgaaaaaagacctgtccgttcttgctaaaatggtgtttgcataacataccatctagagagaaggacaggtcccatggccattataaccttaattgaacgatctcagatagcttgtcataaactgggaccaactgcttcgagacagcctccgtaatgggatacagccgtgtacctgatcctccggctagaatgatacctttcatcaaaatgatcctccttctaaaaatcaaatcagtaatggtttgctctgcagccacacaaaggccattcacaatgtacataataccagtttacgcttacaatctgaagtatctaaaaacagcacagatgcttctaacgcaggattacaaacagcatttatttataaaacgagtcgtcacgcgcgttagacaactcctcaatctcttctacaattgtattcaaaaatttcataagattgatgcaactttgacgtaggttaagactccagtttttaaagtctgctgacactcctaaaaatcccgctttttaactaaaaagcgatagatcctttttgagttgcaaagccttgctattttttaaaaaacctccaagaagtttgttcttgaagggttacgtcacctaataccttcgagaaactggcgtaaaagtcactaacgcgtttcagtgccttctcgaatggtcttcattggatcaaggccagaaattaagaagacctggctgccttccgtccaagtgatttgattttggcgggtgtcggaggtggtgacagataaatcaaccgttccgtggctatctggcaccggcaatgcgttgctagcaaaccatgcgactgcctgtttagccagtggcaatgggtcttcgccattaatcgttgaagctctaacagtgatcgtccagcgcccttcctgccacgtcaggtaagtcgaccccgctgccccttgcttagttgcggaaattccatcgcctatcgctacttgtggtaatccctgagttgattgatcagcactaatttgcgcttgagcctgacttgcattcgcataagtcttcttttgaatagcaaattcagcattcacactttgtaaactagcgtcattatacgccaacgcagcattaccttgactgaagaagagtgagtagttgtgactgtccccagttccaagaacgttcagatattgattaggattgactgaataattagctggccacttaacctggcctagctggttatatgttgcttgtttcaaagccgcgtaccgctgctcagttgcatccgcagtcccgttagctgaggaggacggtgttgcgacacttgaactagaaccagatgcattgtctgtttttgaagctgcgctgcttcgcttgctgctcgttgatgattttttagcctgttttttggattgactagttctcacagagtcacttttactgctgctttgactattttgaccgcaacctgtggcaaaaagaagcagaacagcaggtagtaataagagtgtcttcttcatttttatacccccctatttggatatttatattatatgcttctatgaacaataattcattgccccaattaatcatagtcgcgaccattaaaaaagcatgaccgactcaagcgtcatgctgaaatcattgcatttgagtttgttaactcaaatgcgtaatatcctgttcaacaacaatatcatggagcttttgtcgcgctggttcaggatcttcctcgagtccttgagaagacaccttgtcaaacaaaatcttaatagtctgtagcaagatccgtgcatctaagaaaatactgtacgttttaatatacaacagatcaaactttaacttgctgtgataatcagaggcatacttcccgtaaacctgcgcgtaccctgtaatacctgcgcgtacgttgtgccgcaaatagtaatgcggttcctgctcattgaactgatttacaaagaagggtctctctggacgcggacccacaatcgacatatcaccctttaacacattgaaaatttgcggtagttcatcaagccgaaattttcgtaaatatttgccaactggtgtaattcgcgagtcgtgttccgtggccaaaaccggtcccgatttggcttcagccgtggctgacattgttcgaaacttcagaattttaaactcacgttgattcatggtaatccgaacctgcttgtaaataatcgggcctggtgaagttaacttaaccaaaattgccgttatcagcataaatggcgatgccactatcaacatgagaattccgacaacaatgtcaaaaatccgcttaagaaaagcactttcaggcttaattctaaattgagtcatacccatgacactctcatcttcaaagttcataaggttaggtcgcaacatcaacaaattatcgaacgtggatggcaacagaatcgttttctcatgcttaatgatgatatcgataatttcacgtcgagtctcatccggaagcccctttgttaaatagaaaatatcaaccttatcgataatggccttggcattctcgacaaaatgatccgagacaacataagtcaccttatgtttattgtttttggctgagttaaagttttccaaaaccgcaggcagttcatgttcatatgagagcactgcgaccttgtagttgctcgtgaaacggacatacatgtaataaatgaaaatccgccatatgccaagaatcagaatactcagtaggaatgaataaccaaggaccaaacgcggaaacgcaaacaggcggcccataaacgtgatcatggtcagccctaatatggtaattgtttgcgctaaaaccgtgttgaaaataatgtcgcttatacgcctattgtaataaacataaacgcctaaaaagaagttaacgaacaggaacaacagcgaaatataaatcgctgagcgctcgtacatgtcaaagttatactctggaatcacccggccaaaccgccagtaaaaggctaacaagatgcttaagttaaaaagaccaacgtcaccgatcattgttaacagtcgtttaaggccattccattcggcactctgtttcatacagcaaccctctcagtaattatctttgcttgaattgaaaacaagctcactcattatagcatatgtatgacattcctctatctaaagcccccaacactgaggtttctataaagaatttttcttcaaagtcacaccgatgagttagcctgaaaaatatcattcaaccgacgccacatacttcgccaacccctcagccagcggcgtatgcggcataaagtcgaactgatccagcttgtctacctgagcatacgagtcacggatatcgcccaatcggggttcttgataagtcgcgtgcagtgttttgccagttaacttttcaagctctttagcgacctgatttaacgaggtttgctggccatttgcaacattaaatacgtcgtctcgggcactcggtgtttcgagcaaaccgcgaatggcccgcacaacatcgcctacatagataaagtcacgtgtctgctcaccatcgccgaagaaggtgaacggcttgtcggcttttaacgcatccatcatgattgacaaaacgccgctgtatggtgatttcgggttttgctttggaccgtacacgttgaagaagcgggtgcagacaactggcatgttgtacagccgcccatagttaagaacttcccgttcagtagcaaatttatccaccgcatattgtgtcaacggtttaactgccatggtttccgctttaggcaatgctggtgaatcgccgtaaacggctgcagagctcgaaaaatacagctttttaaacgtgatttgatgcgtacgcaaagtttccagcatgctaagattggactcttgattcaccaaatgcgttgcatacgggcgctcaacggaatctgccacactggcaattgccgccagcaaaacgatgtagtcaaatttaccgtcaatcagcaaacgggacatgaaatcatggtccgtgatgctgtgttcataaaaagtcacccgatcagagtctggaatattttcccgcagacccattgataaatcatcgacgatggtcacggtgttcttcgggtcggttaatagcagttcggttaaattggacccaataaagccggctccgccagtcactaagtagttgctcaaaatagtttcctccattatggtggcttcattttcttcattatcgtatcacagcttctgtcatgtcaccgccacttactgaaaatgttagcaaaatgataaaaagcgccgctgtctagcgccgctcctttactatgatatttttttaagctacattgatcctaattcgactgcacgagccgccgatccaaccaacgacttgccagtgacaaggcatagttgaccacgaagtacatcactgccagcgccacgaacatcgggatcatatagttgatattctgcccataaataatttgcgcgtggtaggttgcttctggcaagagaatgatggtggccagcgaggtgtccttgaccagcgagataaactggctgacgattggcggaatcatcttcttcaaagcttgtggcatgatgatgtagcgcatggcttgatagaacgtgagcccattgctgcgagcggcttccatctggccacgcggcaccgcgttaatgccggaccggacgatttcggcgagcatggccgattcgaaaatgctcatggcgataatcgccgcagcgacaacattcaagcgaataccaatgtcaggtaaggcaaaataagtgaagaacaaaatcagcagtaatggcagatttcgaatcaaatcaatcacaaaacctacaattgctgaaaaatatttaattttcacgtaacgtgctaggccaagaatcacgcccagaataaagctaaagaatatcgagacaatcgaaacttccagtgtcacccctagtccttgaagcaggtaacgcaggttaatccatgaatacgcgtcaataaaattatgcataagccctgctcctttctaggcggtgacccattttttctcaagatatcgcatcagataacttaatggcatcgtcaacacgaggtagaaaaccccaacaatcagatacgtatcaaaggtggaaaacgtcgtggcggcgatcagtttgccttggtacatcaggtcaaacccagcaacaaaggcgaggacagaactgttcttgaccaagttgatgaactgattgcccaatggcggaataaccattttaaaagcttgcgggaaaataatctggatcatcgcttgattgtacgtcataccaatgctacgagcgccttccatttgcccgcctggcacagcttcaatgccggcacgcaccgtttccgcgatgaatgcactggtataaatcagcaaaccaatcgtcccagccgtaaaaccgtcaattttaacgatgaactgcggtacgatcacgtaaaaagccaatgtaataactagcagcgggatattccgcactatttcaacgtaaatgcgcccgatcacccgcaaactcttgaatggcgaaatttctaggagtgcgaacaaggtgccaacgattaaactgccaatcaaggcgagaatgctggaagccagtgtgtaaccgacaccggacataaaggttccccagttattggtaagaattgaccacatgctattccacctccttgagactgaagcctggcacatcaccaaaccacttcttaattaacttggcataggtgccgttttgcttaagttgcttaatcgccttattgacagcctgcacaaatggtttttgacccttgttgatcgcaatcccataaggctccttcgtaaaggttccgcctgtgacgatataatttggatcttgttcggacatcccataaagaatgccgttgtcagtcgtgagtgcatcgccctgccctgatttcagcgcagtaaaagcctgcgcataatcagacaactgcaaaacggtggtatctggcgcggcttttttaacgttgtcaacggaattggagccttgcaccccgatgacttttgtccccttcttcaagtctttgacggacttaatcgggctgccttttttaaccaaaatactttggccagcgttgaagtaaacatcggaaaaatccaaaatcttttgacgttctggcgtaattgtcatcgttgcaatcaccgcatcgacgttgccgcctttgatcatcggcacccgagtatcactggtgacctggaccagttgggccttgcctttgctaccaaggatctgcttcgtgattgccttagccatatcgacatcaaaaccttcaattttaccggttttgatatccatcagtccaaacaaacgggtgtcagctttaacaccccagacaatcgtatttgtcgtcttggcagttgttaaaatatcgcgatcggcgacacttttgccgcaactacttagtggcatcattaacaacactaagagcaacggcaggagcatgcgtttccacaattttgccattcaacttcctcctctttaaacgcgatcgccggcgtagaaatctgcgcataaggatcttgatcatggtggccaaggccatcacttccaaggccgtttacgcgccattttcaccgcccagctcacgcccttagtggttaataattttactgagaaattccttggcccgtggttcttgaggatcatcaaagaattgatcgacattggccgagtcaaccagaatctggccgtcatccataaagacaatccgattaccgacgtgacgagcaaagcccatttcgtgagtgacaaccaccatggtcatgccctgttcggcaattttctgcatcacatccagcacatcgccgatcatttccggatccagtgcactggtcggttcgtcaaacaaaatagctttaggtttcatcgccaaactgcgggcgatagctacccgctgttgctgtccaccagaaagctcacctgggaaactgtcggctttattttcgaggccaaccattttcaacagatcatgcgcttcctgctcaacttcttgcttatttcgtttcagaaccaaatctggtcctaaggtcacgttttgcaacacattcttattggcatacaggttaaaatgctggaaaaccatacccacatttttgcgaatgcggttcatatcggttttcttgtcagctaggtcaaaatcattcacgattagttgtccagatgtgatccgctccagcccattgatgcaacgaagtaaggtacttttgccggatccagacggcccaatgatggtgacaacttcaccacgatcaactgtgagattgatattctttaaagcatgaaatttaccaaagtacttattaacgtcatgaaattcgatcattgacatgttcgaggacctccttgggttcactgatgcttatcatggattttacagagaaacttaataatgcgcaaatatttcttattcattatgacaacctttttactttgaagagcttctcatcgcctttatttgggacttctgagcgttctatgaagttttaaaaggtgttgtgatcactggtatctaaaaccgctcaaacgtcagtagctacccttctatgacaaatgaatcagtcctaaaacgttatgattgccttgctaccattcaaagggacagttatcttgattgcctgccgctggttaatcacctaactcacactcaaaaaaatcaggccaacgtcacttttgcgtttctagaaaagtaacgttggcctgactgtagccttatttcaattgatggcacaactatttcataacagtttattcatcgtggcgatgccgtctgctttcgcgagtcggcaagggcctggatgctgcctgcgaggttgacggggctggctcacgggtcattttagcagtttcgcgttggctttcgcgcgttgtgtgtcgtgaatccaaaggctccgcctcatgctgccgatcaccagtagttgccttgtcctgatacgccaactgcacggttaaactgtaaggttgcgcttccttgcgtaagccgcttcgacccagcagcttctgttcaccaccgatcaaaaagacattggcaaccacaagatgatagtcacgctgcgccgcttcgaccggcaacaaaccaacccgatcaacggtggccagtggcttggccattaaggcattcaagccgcccgtgatgacaagcttactgtctaggtgctgtagatcaaagaatggcaacgggaacggtgcgccaatcgccagaaccggttgttgcgtctcctgtgccacacgaccaacggctttgtcatctagtccttgataattcaaactcagcacaccttgtttaacgaggctatcgacaagcgtatccaaattggcttgctgttcctccgtcatggtgacatcggccgtcagcaattgatcttgtgaaaaaacgccttgagccggtgctgcacccaattgtgtgcgcaattcattttcgacagcggtttttttggcagcgttactgccaagccatttttcaaccttgggtgaaatgtcaaacttcgttgtcttatttgtaaaataatataagaagttcaagccaataaaatacaaaaagacaacaaatgcaagcataaacagtgcgccgcgaatgcgaaagtccggatagcgcaggttttgaatcgccacatatagtaaatagaagttggcaatgagtgccacccacgtgaaggctttccccttgggtttgtcggcaacgttaaaatagcccaacacgcggttgataatatcaataacagttaacatgatctcatcctttccgcgagttactgaccgccagagccggttgtgtctgtttcttgaccattttgattattattctgctgactaggtgttgttgagcttgttgaggcagaagcagacgaggttgacgttgtgtctgagctgcttggttcctgagttgaagcagccgagctcacggtgctgttatcatcattttgatcttgattgctggtttcagcctgcgattggctagcctctggttgccgcgacgccgaagcttgactcggtgcaacatgtgacgacgcggactgaccagcacgcgaggcagattctgattttatttttgataccaattcactttgctcagtcgccgattttggttggttcaccggattgatcgtgttcacaatgttatatgcactaatcaaaacaatgagtgacacaatcgcagtcggtggtaataatggcggggtacgataagccatgaagccagctcctttcatccatcgtttaattgtacctcaataactagatgataccatttaagttcttgctaagatgacaagtttgccatttccggagtctttaaatggtggtcatgtctgccctgataacacgctcccattcaaagatggaagaagccgacaacgtacatctaaacgtcttccacctcaactcattcgggacgcattccgctgacgccctgtcttcaaagcgctgccgcctgcgttcataaaaaaaagcacatacatcaacatgtacatgctcgcctgtcgcttaggcatttttaaggcggtctgcatgttgctggcattccgcacacagcccataaagttcaaaattatgactttgaatttttgcacccggcacttgtttctcgaagtaattgagtggacacattttcaactcgatcactttcccgcaatttgtacaaataaagtggtggtgatgcggatgctggaaatcacactgtaatttcacaacaatctgatcatcttgcatccggctttcaacaatgcccatctcaataaatgatttgacatttcgataaatagtatcgtgagagactcccggaaattgggtacgcatataacgatccagtatcgtcaccgccgtgtagcgatgctgattcctgccgagataatcaaccatcgattcacgctgcttggtcacgcgataaccgtgctgtttcaattcttctaatgcaatcgttgtgttatccatgcgaactcctttagcttgacactttgattaatggcgtgtagactattaaatcgtattgattacgattaatcaatcattagtgtaccacgcaaaacaggaggaagcaatatggcagaaaaaactgactacgcatccgcagcacggcggttgaagagtaaaaacccgaaaacccgttcacgggcaaaacgcatgattaaagccgttaagaaaccagtcaagtaattttatcgcattattcaaacaaaatgtagcaaggcgcgagccacggtaatgatcaccggtgctcgcgccttatttttgttctaaatcaatgcgggcaaggccgcaacttttcaaagccaaggttttcataaattgatccacttgctcgcgcgcctcatcccaactgtcatttttgatcacagtggcaaacggctttagttcgtctggcaaggttaaatcgcgtttatattccggacttttcaaccgcgcagcaaccatggcaggatcatcaccacggctcaacaaccgatcttttaataccgttgggttatcaattgttaaaaataagaccacgacctcctttggcaactcacgcacataggtaatggcaccttttgtgtctagaacaatactaaggaagggatgcttggtccagtttttttcaagcgattcatgggaggaaccgtactcataaccagcataagtgactttttcgataaaatgtttggtcgcaaaactcgccggtgtttcgaaatagtaatcgaccccattcttttcccctgtgcgcgccggacgggtggtgtgcgtcatcacgcggtggatgcgataattatcgcgaagataaccactcaccgtcgttttgccagtccctgttgccccagtgatcacaatcaacttatgcgcagctttcatgatcagcctcctcttaaatgattgcctcgattgtaccaaatcagcgcggattagtcagcttgaaaacaggttgattgattcggtttatcaataacgctgttaccaactaagaatggctaatgctcatcatgataaaaagcaatcacgcccacttgttgactctccacaaacccagcggctttataaaagtttcgcgttttcggatcatcgtccgtcaataaaacccgttgccgcacttcagggaaccgctccagcaaagcttctattaattgtttgccgatacctcgacgctgatattctggcaaaaccaacagatcctgaataaaaagaatggtttcgccgtcaccgactgctcggattaagccaactaactgtttgccctcatacgcacctaacaccatcaatgaatgggtcagtgcccgttcaagtcgcgcaggatcgcgagtatacatgctccaaccgacacttttataaagtaccaaaacctcgggcatagttggtttttgatcagtaattgtcaccatggcgtgtgtccccctttataaaagaatgttttgcttagagtagaaaaaaagatcgatcacgcttgatcgacctttcaaatgctattgcaggatgtgaacgatatttttacagacgacgaccgaagcttggtgcgaagtatgccatgctctgaatcgtaacgctttgaccaggagctggtgcgtgaagatattggccaccgccaatgtaaataccaacgtggtaagcactaccaacgccgccccagaagaccaagtcaccggcctgtaggtcagaaacggaaacatatgagccaagcgtactttgagcttgggaagtccgtggtaagttgatcccagcttctttagctgcatagtagatcaagcctgagcagtcaaagcctgatggtgaagtgccaccataaacgtacggaaccccgatatacttagcggcattgctggcaatactgccaccggaaactgaaaccgagctggtgtttgaagcaggtgcttgtgaagcgctggcgcttgaagaagcactggtggtgctggtgttagcactacttgaagctgcactgcttgaggcggtgctggttgaagaagcagatggtgttgcggcaacagcagcggttgctgcggcagctttagcagcatcttcgctggcagccaactgagccaacttatctttgttagcttcaagtgtttgctgtaaatcggatgcagatttttcagcatcactctttaagctttcgattttagccttgtcgctttccaactggctctttgtcgcaacaagtgtttcttgcttggcttcttgttcagtttgcagagccttaactttggcctgtgaatccttaaccgcctgcaatgcttctgcactggcttggctaagtttgttgaccgtcagtgaacgaccaacaagatctgaaaggctgttggaattcaaaacaaagtcaaaatagacattgcctgtaactgaattaccaacctgcttttgcaatgaaatcaattgttccttcagattgtctttacgcttgccgacttcgacttgcgccttaacaatttgttggttgtaagaggcaattttagcctgactagcactaattttttcttcagcattcttaatgtctaatgctttgttagaaacatcattgctcaacttcgcggttttttcatttgccgtttggatttgcttgagcaaggcatcattcttggcagtcaagctagacttatcgtcatcagctttaactgttgtggcagccacccctgaaaccccaaccccagccaatgttgcaactgtgataaagcctgtaactaattgctttaatttcatctttatcgtcactcctgctttcgttttgttcacaactggtacattaacactggactgttacagtctcgttacagcatgtttactatcagaatactttcttcaacatattgtcatgctcaaatataaggaagttcataagaactttttatttcagttattttcaagaagaaaaggagaatcgaaggcaccaaaaaaaggcctgtgataaacgtttgttttatcacaggcctaaatcgctagtcgtcatttttattaactgttattgtttaatagtaaattggctataccaatcatgcgacttaaagggttactttgccgtcttgatatcgactaaaaagtaccgctttttaccacgccgaacgatgacatattggccatcaaaatgagtgctcggatcaacctcgaaatcgagctcccgctgacgtgtaccgttgatcgtgatcgcaccattttgaatgtcttcgcgggcttgacgacggcttggttcgattttggtagtgtcgactaaccaagtcacaatgttttctgcggtctccggtgcctcaactgttggaaactgcttgaaaccctgcttgatatcatcagcgctcagctcagcgacatcaccggaaaaaagggctgcactgatgttttcggcctgatcaaccgctttttgaccgtggacaaactttgtcaccgcacgcgccaattcacgctgtgcttcacgtttttccgggtgtgttttcgttgcttcaaccaattcggcaatagcatcgcgcgacaagaacgtgaagaacttgaggaacttctcgacatcggcatcatcctgattgaaccagaactgatagaactcgtaaggtgacgtcttctccggatcaagccaaacggcgccgccagcagacttaccgaacttggtaccgtcagccttcaacatcaatggattggttagaccataagcacgggcttctggtccctcgatgcgatgaatcaaatcgatcccagccgtaatattgccccactgatcggccccgccaatttgcaattgaacatcttcgtgtttgaacaagtgcaggaaatcgaccgactgcagaatctgatacgtgaattccgtgtacgagatgccgttttccaaacgactggcgacgacttctttatttagcatactgttaacggaaaaaagcttgccataatcccgcagaaaatcaagcatggataatttcgataaccaatcataattatcgacaatccgaaaatcatcggttccgaataggttctccatttgggcggtcaatttctttttatttgcagcaatcgtgtccatggtttgcaagacccgttcagaattgcgcccggatggatcgccaatcgagccagtgcccccaccaatgacaatcacgggacgatggcccagaagttgaaatcgtttgagaatcatgaacggaatcaaatggccaacatgtagtgaatcaccagtcggatcggtgccacagtatacactgactgctttttcctcggtcagtttcctcagaccatcttcatcggttaattgattcaacgccccacgccactttaattcgtctaaaattttgcctctgtctgtcatgttacttgttcctccctaaacacatttgctggcacagcaaccgctgtataagcgccttgtggctattatggccaaaaggcgtttacattcaacttttaagcacgccagttcacgctcttgactaaaatttgtctttgccagaatttaccgccacctgtgagctgagatgcaggatggcaacgtctagatcgttggtcaaggtcattcacaatggcataaaaaaagcccctgatcttcaacgatcagggacgattttcaccgcggtaccacccacattatgctttgcatcactctaatggatatcggcatgacccgttaaccaggctttcattgaggtgtaattcgtgatcaaaggcggaacggtttgcagcaaccaccgtttttcttagacctgcctaggaccactactgcggctcatctggtgactttatggtttagatcttaacacatgtaggcgaacggttctattctttttggacattcttccggagttcgcgctaacgacgcagtacttctgaagtgcgcctaacttttcacttttgcgggtcctgtggtgcttcttttggatctcgatcggctggataggctttgacgtcagcgtctagaatatcgtattcatccatgagcctgcgttcgacgcgctctcctagatcataggaatcggctacggtcatattgggattgacacgaataccgatggttagcaagacagcatcgcctgcatatcgtgcttcaatactttgaacgcctttgacacctgggactgcactgatggtttggcggtaggcagcaatttttttggtgtcgaatccatctgttaattcaaaaatggattctcgcaggatagtccaagccgcatataaaatcaaacaaccaacggccacagctgcgccaccatccagccaaagccagccagctttggcacctaagatggcgagtaacgtgccaccgctggtcacagcgtcggcaaagctgtccttggctgccgctcgcaaaacactgctgtccaattgcttcgccctaatatggttaatcagtgaaacggtgcccattgccaatcctgccgctaagctaacataaaccgcaagttctccgggaacctgcagcttaccttgataccaagcttgcagaccgtgatagccgtcaatgacaacatctagaccgacgacgagcatgattaagccagaaaagagtgttgcgatggtttgaaagcgccagtggccaaatcggtgttcactgtcaggacgttgttgggaaatctgcaagccccaaagtaaaatcagcgcagaggccacaccagtcaggttattcaacccatccgcagccaatgcccgagaatgagctaactgcgcgatccacaattctgccacggtcaacccgccatatacaatcagattcagtgcagcagcatgctgggcacttttcaggcgggcaaaccggcgttgttcatcttttaaaatatttcgaccagcatccatgcgacatcctcctgactaaattaatttgtttattaaagactattataattcgaataacgtaccggtgactggttataactttgcaaaatgatagcgagagcgctttcttacaaaatttttcataacaataaaaaaaagcccagtaatagccgggttttatcaagcatcgttcatatcagccgttttcgttttgccgcttcaaagcgcttgtcaatcgttccaatcgagcaatggtgtcatctaaggtcagataataataaaccatattgccttcgcggcgtgagccaaccatgccaatgtctttgagatgcttcagatggtgcgaggtcgctggctgtgacaaaccgatagcatcagccaagtcgttgacttttaagcctgtatcattgtctgccgttcccaaaatcataatcaatttttgtcgacttgaattcgataacgcattgagatgtccaatatcttgcttaaactcttttaaagcctcttgttgcgcagagctatatgccgccattatgatggcctccttataaacgcgtttacgattgcagaaacttgcgtctttagaacacggtatgcatcaaatttcactcataacgaatattacctgaaatcgtaacgattgcaaccaatatgcaaaccgttcatactgaatgcatgtcaatcgattatttttggaggtgccaatatgaccacgacgaccacttttcatggtttgggtgcggataacacgcttaccgtttatgcagatggtgctaatgaactattgaatcaaagcatcagcatgattaatgcttatgcccatttattatcgctgtatgatgaagcatccctgctgactttgatcaacaagcaggccggcaaagaacctgttcacattccggttcgccctgtgttcaatctgattgctcaagcgatcgcctggagcaaacgcggattaggttacaacgccttaatcggcccgatcgtcaaactttggcgcatcggtttcgatgatgcccatgttccgactgccgaagaagtcactgccgcgcttgctttgactgatcccgatcttgtcgagcttgattcagaaaatcaaactgtttttctgaccaaacccggcatggcccttgatcttggcggtatcgccaaaggtttcattgtcgatcaagtctatgatctttgggacaaaaccggcgttgaaggtgggctgattgacttaggtggtaatcagcggctcgtcggtaatgcagccagcggcgtaccgttatggcagtggccaatcattgacccgcggacaccgggaaaacgcagtatcgccaccttgacaaccacccctaaagccgtcgtgacgactggtatttatgagcggcactcagagatcaacggcaaagaatatcaccatttgcttgatcctaacacaggctatcccgtcgaatcagacatggccagcattaccgtcgtggccgatagtggcctgatcggagacgtgttatcttccatcggtttttatgctggcatccctgccggttacgatgccgttgaagccgagggtgaggaagccatcttcgttactaaagatacccgcgtttaccaaaccagcggcctgcgcgaaaccttggccgttaccatgtaaaccttagccaccgttgtcttcagacataatagtttgggacatcactcataatcatcaaaaaggcaaacaaattccactgtaaagcggaaactgtttgccttttcttattgtaatctattggaattttaaagatattagtgccaaggcggagcaatcgtaggccagatggggctcagccgtgcaaacaacacagcgaccgggctttgtcgctgatgttgttaggcgacttcgagaccggtttttgggctcgaagcgccgtcacagcgttccagccccgtctggccggagattgcggagtttggcacggcatgagactctttggcctagaccttactccccgattattcagaatctaataaatcacaaacccaatacgacaattatgccccattattttatgccaaaatgctataacaaatcacagcattcataacaataacataagcgttaaatctgctgccaaatcacaccgcctgccggtaccatcgtgcctactggcaataaagcgcgcaaactttttggcactaattcagcatgcggatcctgtaacacttgtggtgatccagttggattggccagaactaccagcgtttgggtatcattttggcggacgaagccaaaactgtcttcaaacgtaaatgggaaaaaagcggcacctgcagccaaggctggctgatcaatgcgggtctgaagcgcgatttgataaatatccaaaacagcctgatcttcatggccccatggataaaaggcgcggttatccgggtctttaccgccagttaacccggcctcatccccgtagtaaaggcatggcaccccaggcagccagtaaaatagcgagacgataaactgcaacttacgccgatcaccatccaacatcgttaaaatccgtggtgtatcatgactgccaatgttgttgaaattgaacgcaaacgcatttgttggataattctccttcaacgtcatcaattgacgcacaaagcctgccgcgtttaactgcccatttgtcaggtcaatcaacatagatcggagcggataattcatgaccgcattcaattcgccgccttcaaaatattgccgccgcttgccataagcctgtttattagaggcatcctcccagacttcgccgatcagcacccgctccggaaattgatcaagcgtgctgcgaatctgccggataaaatcgtccatcaattcatccgcaacatctaagcgccagccatcaacgcctaagtcagtccaataactgatcaccgaaccttttttagccgcaatgaagtcatgaaaatcttgattatccttattaatggctggcagatccttcacgccccaccagctattgtagtcatcaggaaatcgcttgaatgaaaaccacgaggcatatggggaatccaagctattagccgcacccacgtctgaatattcattgacggcattgaagtagcggctatcagcgccgacgtggttaaacacgccatccagaatgacatgcatccccaactgatgcgctgccgccaaaaactgcttaaagtcatgcagcgaacctaagacttcatcaattgcaaaataatcgccggtgtcataccgatgattgctccgcgcctgaaaaattggacttaaatataaggcgttgatgccacgggctgccaataatggcagcttttgttgaatgccagtcagattaccgccgtaaaaatcccagcgaatgatctcgccatcgttcccgcgaatatacatgggccgatcggtttttcgcccatacagaaaagagttttccttcggagcattcacgtgaccgtcagcattcccattattgaagcgatctacgaagatgtgataaaaacgggcattttgataccacgccggaacgggatcaaatgcggtcacaacggtcatctgataattaaccacatccacattttccgggtaaagctgaccaagcccgccaaaaccaccgccgactgcaccaaagcgttcccggccattgtcgctttgcaactcaaaatgataaaaccaaagaccggcattaggaggcgtaaacgtcactgtgtagccgttagggcttttcgtcatcggcaaggattgcgtttgatcgcaatgttcgtctggcatgatgacaagtgtggcttgtgtcaccgcaccatcagcctgtgccgtcaatgtcacagccgtgcctttttgcaccgcgccaaaaggtcggcgatcggtaaatgaatcaaattgaaacattgtgttcctccatgtgtcatgtacacgaaacgttctcaaaaccgataaatgaaccttcattaatcacgcaaccgatagcaggattgataacaatgagcgccaaggcatgctgatcagatgatattctacatcgagtgtttccgataaatccgagctggcgtcgcggcaattcaggctggtggctgcgcggccaactttctgcatgttatctaaaaaacaatcaccagaagtagcctctgtatggccgctttaagcctcgtgatcatcttctggtgtctttgccaccacatgccaaatctcgcgaccatagcgttgaaccgtaaagtcagccgagaatcggccgctttcggcaatattagccaacgcctttttggcccaaatgcgcggttgttgataaagcttatccaatctttcgttcgcagccagataactttcaaaatcggccaacacgaagtattcatcgttgtaagtcaataacgaattgaaaatgtcacgaccttctgtttcaatccccgggatctgcccattgaccagcatatccagtgcggcgtgcaagcgtggatcttgatcataaaagtcgcgagcatgataatcgccacgctggtaataaccggcaatttcttcctctgtcaacccaaaaatctcaacgttgtcatcacccacggcatccttgatctcgatatttgcgccatcaagtgtcgccagggtcaaggcaccggcactcatcagcttcatgttactggtgccgctggcttccttaccggctgtggaaatttgttcagaaatatcggccgcaggaataatcttttcagccatggtgacaccataattcggcaagaaaacaacttgcaagtacttgctgacatctggatcaccgttgaccaaatcggcaactgcattcataaccttaatgatttccttggcataaacgtaacttggcgcagctttagcgccaaaaatgtgcaaacgctttggtcgtttttcgccgcgtttgatcgccaagtaagcatcaagaatccctaagacatgcaataattgccgtttatacgcgtgcaggcgtttgatctgcacatcaaaaatggcatcaggatcaactttgacgtgcacaacttgatcaatatacttcgccaatgctcgtttattttcggccttagcagcattcaggtcgtcgagaaaacgggtatcatcggcgaaatcatgcaactgccgcaatgccaacgggtttttccgccaagttgtcccaatttttttatccaaaaggtgggaaagcggtcgatcgccaatttgaatccaacgccgcggcgtgatgccgtttgtcttgttattgaaccgttctggaaagatttgatacaagtcatgcaggacgtcttttttaagcaactcactatgaattggggccacgccattgatcgcatgggaaccaattgatgcgagataggccatccgcacctgtccgttaccaagcggtgcagtccgatcaatcattgcttgaccaaattggggcacgaaaaccagccggaagcggcgatcgatttcctgaatgatttgatagattcgcggtaccatgccgctgaacatgtcgattggccaaacttccagcgcctctgacaacaacgtatggttcgtgtagctcatcaccttgagcgtaatgcgccaagcttcgtcccagctaacatgttcatcatccattaacacccgcatcagctccggaattgccattgctggatgggtgtcattgatatgaatggcaacgcgatctgcaaacccggccatgctgttgtgggttcggcgataatggcggacgatgctttgaatcccagcactcgtaaagaagtactcctgccgcaatcgcagctgcttgccggatgcatcggaatcgtcaggataaagaatctgtgtaatctgattgatccgttctttttgttccaacgtaaaatcggtgccggcattgatcggtgcttcagcagaccacagacgcaggttattcaccacctgattgtggtaccccaccatggccacatcgtatggtacagccaatacatcgtcagtattgtgatagatcacccgcagattgccgctacgacttgggcgtaactcaacccagccgccgaatttaaccgtgactgcgcgattttctttacgagtctcccacgcaaagccattccgcatccaatcatctggcagctcaacttgatacccgttgacaaaggcctgcttaaacagcccgtactggtagcgaataccattgccgttaccagccatgccgacactagccatggcatccataaacgctgatgccaaccgacctaaaccaccattgcctaaacctggatctgcttcagcatcaaaaattttctgtggtcgcagtcccaactcattcaaccctgcttcaacttcactcagaatgccaagatttagcaaattcgactgcagcagtcggcccggcagaaactcaattgaaaagtagaagacctgttttgtctcctcctgatcgtaacgtttcttggtctcggcccaaggttggccaatatatgaccgcgttaatagtgccaacgcctgataaagctgttgggtggacaggtcatcgagcggtgctgcatacagcttcaaagcaatatctttgaattctgtaatgaattgttcctttgttaatgacataaacacacctcaccaaattaaatacagcaacttttaaacgcaacgcaccccgggagtgacaccatgtcgtcgtacccacggcgactccaaaacgagccgaaactcattttgataaacaaaacgaggtcggatcgggtcaccttgccagccggtttgacgcatctacgcctcgcctgccttccgactgatcccgacacgacctcgctgttgtcacctcatgctttgcccagaatgcgttgataacctttcaaatactcagctgcggaatggtgccagtcaaagtccttcaccatcgcatgttgttgcaacttagcatagacttttggctgatccgcataaacactcttcgccatgcgcagaatatttgtgagcacccctgcgttgtaatcccagaaactaaacccatcaccagcgccagtttcagcgttataggctagaaccgagtcacgcaaaccaccagtttcatgcacaattggcagcgtgccatagcgcatcgccatcatttgtgccaagccgcttggttcaaaggcacttggcatcatgaagtaatcggcgccggcataaatccgctgcgctaaaccttcatcaaaatcaatccgcaccgccaattggccagggaaccgatcctgcaatgatgacaaatcttcttccagatcttgatcgccagtaccaagaaccacgacctgtacattattttgaactaagaaattctccaaagcatcaactaagagatcagcccctttttgccgggtcaagcgactgaccatcgcaaacagcggatcagtcctctttggtaaatgcatctcgtcttgcaaagcctttttatctttggccttgccagccaaattcttggcgtcgtaattataagccagattctgatcagtggctggattatagacttcagaatcaatcccattcagaatcccgaccagtttaccactttgttttcgtaacgtgccatccaaatgctcgccaaaggctggtgtttgaatttctttggcataactcgggctaaccgtcgacacaagatcggcgtaattaatcccgcccttgagccaattgattgacccgtcttgaccaaagccatcgtcgttgaaaccttcacggccaataccaaaaacggtcgctaacgttgacggcgggaaccagccttggaattgcagattgtgaatcgtcagttgtgtcttaatctgttgatacggcttgatccaaccatacttttcttttaatagcaccggaataaaagctgtgtgccaatcgttggcatgaatgacatctggaatccattcaatcacctgaagcatttcaatcacggccatttggaaataaccaaaccggccgccatcatcccagtaaccgtacaagccatcccgatcaaaatactgccgattatcaatgagataatacgtgacatcccccagcttaatcgttttgaggccaacgtaaactggacggccatccatctccaaggtgaaatgggtcaaatccttcactttaggcagatacttcgccgggaacttcttttcataaaatggaatggcaacccgaatgtccacaccttgcttcttaattgctttaggcaaggcataggttacatcccctaaaccgcctgttttataaaacggcgcactttccgcagctgtaaagagtactttaagcacgggccgtcaccccctggccatctggctgaaagactttctgattcttcgaaaagaccaatggctcctcaggggtcccttccaacgcaaggtttggcccaatgaccacgcctttgtctaggatcgcatacttcacactggagcctgtgccaatcttactgccttgcatcacaatactgtgatcaaccactgcatcacgatgaatatgcacatttctgaagagaatcgaattatcgaccgtaccttcaatgaagtcaccagtacctaacaagctgttggtcaccttggattcggttgaatagaaggtcggaatttcattcttattcttcgtttcaatcgaattagcactataaagcaacgcttgatagttttggtcttccaacatgctcatgttcgcgtcaaaataccgctgagtcgtattcagctttgccagaaaaccagtatattcaaacgcgttagcattattttccagtacggcttcacgtagaatttgcggcaaccgtttgaatgttggcgcttcggaggcatccgtcagaagatcaatcaagtcaatcgtcccaatcagataaatatccatgaacgccgggatcttaccttccttgagatgcccacgattttccgatgctgggacaactgagctagccgtgccaagctccgtcatatccaacgttaaatcttccggctccatcgcttcttccggcaaattcttgtaaaccgccgtcacctgactctcgccagcttggtgataggcaacgatggcatcgacatcgacattggccacattttgcgtacccatgataatcgtgtactgcgcgctgcttttgcgcagaaattgcagatagtcgtcaaaataccgcgcacgtaattttggatcttcatagtcgcggcctgccatatacggatacgtgaaaataccaccagtaatctgatccatgttccaagtcgacccgctacgaatgtggtccgtgacactacgaccggactttggcaggaaaatcgccacgctgcgaacattggcatgatccaatgatgacagtggaaaatcgatgagacggtagcggccagcaaacggcaaggtaccgatcgggcgggctgctgtcagcggctgaatttggtcgtctggttcattcagatcaataattgctgctaaatcgccttttctcattctttttcagtccttcctaaaacttccccataaccaacaacgctaatttcattcggtttgccgacaactttaccattgtcgccaataatcgcattttcaccgacaatggcatgaccgacagtcacgttcttaccaataaccgcatttggcatgatcatgctgtccttgatcacggagccttcaccgattttgacgttttgactcaaaatactgtgctgaattgaacctgcgacatagcagccgtcaacaatcatggagccagcaactttggcggtcttggtcaggaacattggcggcagcgcctcgttttgactgaagatccgccagttgcgattgccaatgttcaatggattgttaggattcaaaaattccatgttagcttcccacagactctgaatcgtcccgacatccttccagtaaccgcggaaggcataagcatagctggcttcattatgcgtcaggtaagctggaatcacgtcatgaccaaagtcttccatggcaccatctgttgcataactttcggtcaaatattgtttcaatgtcggccagttgaaaatgtaaatccccatcgaggctaagttgctctttggcttggctggtttctcttcaaattcaataatccggtccgtgtcatcggtgttcatgatgccgaagcgtttggcttcttctttttcaaccggcatgacagcaacggtcaatgaagccttcttggccttgtgataatccagcatcgcttgataatccattttataaatatgatcccctgaaaggattaacaaatattgcggattgtaggagtcaatataagcgatgttttgataaatcgcgtgcgccgtgccttcaaagaacttttcgccttcacttgaagcgtaaggctgcaggatggtcacaccggcaccgcgttcattaagcccccagctggcaccattttgaatatggcgattcagctcaagcggttgatactgggtaatgacccccgcggtgttgacccctgaattagctaaattactcagagtaaaatcaataatccgatatctacctccgaatggcaccgaaggcttagccgtcgttttggtcagtttccctaaacgggttccctgccctccggctaaaatcattcccaacatttcagtactcatgattgcggcgcattgtgcgccttcccccctaacttcttcgattgctgatggttaactttgctaatgtcacgtggttgcgaccgcgctggcgatgtgccccagtcttcttgatgactaatcggttgccgttgatgaccggcgagtgacaacggtgtttcgtgtttcggtaatgccttggttggctgcttgcctttaagtgccaacggttttttcggcaacggcttcagctgttttggtttaatcaacaaagcgcccattgctggtaaaatgacgtcaagccatgcaggaacgccatggttttcgccaatctcagcagtcaaggtctgctgccacttggtccatgtaccgccaaaagccgcatcctcagtatttaaaataatctcgtacgttcccggactaggaactggcacgcggaaatgatctttttgaactggcaccagattcatggccactaccgtaaaatcatctttttgtttgccataacggatgtaactcagcacatccggttcatcggcaatcgtgattttgatgccgtcgggttcatgatcttgttgccacaaacttggccgagctttataaagatgattcagtgtggtggtgaaatgctgcatcttcttattcattgggtctttaagatcggtccattccagctcgctccagtcgcgccattcaagaaactgcccccactcgctgcccatgaataatagctgtttaccagggaatgttgcctgccacacatacatcgtccggagattagcaaactggttataccgatctcccggcattttgtgcatcaggctctttttgccatggacaacttcatcgtgtgaaaacggtaagacgaattgctcgttatacatatacatgaatgaaaacgtcaataaattcatatcactgtggcgataaaccggatcctgctcgaagaacttcagcgtgtcattcatccagcccatgttccacttgtagttaaaccctaagccgccagtatcaatcggtgctgaaacttgcggataggcggagctttcttcagccatcatgagcacatctggatgtttggcaaaaatctttgtattcaattgcttgataaaggcaatgccttcaaggttgtcacgcccaccatccttgttgcgatcgttttccttgccagcgtcataatccatgtacaacatgttcgagacagcatcgacccgcaggccatcaaggtggcagtgatccaaccaatacatcgcactggaaattaagaaactctgcacttgtgccttgccaagatcgaagttccaagtcccccagcggacattttctgcgcggtgcggatcggtgtattcgaaggttggcgtgccatcaaattgggccaacatatcggtgtttttgatgaaatgccccggtacccagtccatgatgacgcctaatcctgctgtgtgagccgcatcgaccaaccgcaagaagtcttgcggatcgccgaaccggctcgtcggcgcgaagtaacccattaactgatagccccatgaagcgtcaagcggatgctccatcaacggtaaaaactcaatgtgggtgtagcccaactcctgcacataagggatcagcttgtcgatggcgtcttgatacgtcatataaccaccatctggaccggcattggtgtcgcgaatgaaggagcctaaatggacttcgtaaatgttaagcggttcatcatacggacgccattttgcccgcttggctagccaatcttcatcatgccaagtaatgcgcggcacatcgaccaacttagccgcactgcctggcttgcgttcaaacccaaacccgtatggatcaatcttttcatgggctatcccatcaggaccgataatccgatacttgtataactgattcttttcggcggcaagctcaccgtaccaacaaccggtggtgccttgcagtttcaacggactgccttgccagtcgttgaagtcgccttcgacgttgacttgttgggcatgcggtgcccaaacgaggaaggaccacttgcctggttcgacttcatgggcgccaaaccgattataactttgaaaatcttgcccggagttgaagaggtataaccaatcttttaatccctgaatcatgatcactcccccaatcaaacgataccgtcgtacatgtgaaggcttctcattcactgtacggccggacttttacctaccaattccagtgtaacagtaagactatcaaaaggctcaagaaacgctcaccaaaaaccttcacgcacgccaacataaattttttgataaggcatatactcccagtcctcgtctcaattgtaaccgcttactgttaatattaacagcgattacaatcttttctgttgagttctttgtgagaatactctaacatgataggtatattatttaatgaaaccgcaatgttcacgcaacgttactctgaaatcaacctcagccggctgttttcagtcagacgcacacaaatactggaggtactgccatgagtgtcaatattgattggaacaatctaggcttcgattatatgcaactgccataccgttatgttgcccactggaaagacggggcatgggatgaaggtaagctgtccaccgatcccaacctgacgatgaatgaaggctccccgattttgcattatggtcaaggtgcttttgaaggtatgaaggcttaccggaccaaatcaggaaaaatccaacttttccggcctgaccaaaatgcccatcgactgcacaattctgctgacaagctactgatgccgccatttcctgaagatcgctttattgatgcggtcaagcaagtagttgccgctaatcatgaatacgtaccgccatatggcaccggtgctaccttatacttacgcccgattttgattggtttcggccccaatatcggggttgctccggctaaggaatacattttcgatgtcttcgccatgccagtcggcccctacttcaaaggcggcatggtgccaaccaagttcatcgttgccgatcaattcgaccgagcggcgcattacggcactggccaatcgaaagtcggcggaaactacgcagcatccttgcaagccggcaaattcgcccacgagcacggttatggcgatgcgatctatctggacccaattgaacataaatatattgaagaagttgggtcagctaacttcttcggcattagcaaagatggtaaaactttgaaaacaccgaagtcaccatccatcctgccaagtatcaccaagtattcgattttggcactggcgcatgatcggtttggcatgaccactgaagaaactaagattgcgattaccgatttggatcaatttggtgaagccggggcctgtggcactgcggcggtcatcaccccgattgccagcatcacctacgaagaccacgaacatgtcttttattcggaaaccaaagtcggtccatatacacagaaactgtatgatgaactgacgggtatccagtttggcgatgtaccggcacctgaaggctgggtcgttgacgtcccgtttaattaatttaaaaatcatttatcactcggaaactgtgagttcttgcacgcgctataacgcatctgcaatcgcgtacgcccgctcacgcttccacaaaaaaagcagctgcccgttttaccggcggctgcttttttgtgaggaaagtcattttgcctaattcaacaatataacagtcaataaattcaaaacttactaagcaactttacgaaaaagcctagaacctgacaacctgaaattgaaagccaaaaaacaatgatgatcactcaacagccttaacgtgcaaaggcaatcaagcgccagtagttacctacgcaagtttgtaaggtaatgcgctgaccgccgccagtacccgtgattgcgttccataaatattgtccactggcagtgacggcatttggattcactgtcgccaattgataaacatggtacgtgcgcgggttaccagcagcgtcggtcactgtgatcggcgaaccaatgccaagtgatagcatcgcggcaaaagaaccaggattgtggccaatgaaatgcgtgttttgaccactattgttactataatttgcttgaccgccccacgttgcagctccagtgcccggtgctgcagtcatactttcatttccaatgatataaggcactgtcacacctgcaaacattaggacgcggctcgcgtaagcaggtgcttgctgtgcttgcggttgtgctgtttgttgagcaggttgagttgccggttgttgcgccggttgttgcgtcggttgttgttgcgccggttgggcagcagtcgcggtttgtgctgcagacggtgctgccgatacagtcacttcggcagtagaagtcgaagcccctgtatttgaatcagatgaatcagaagtagcaacagcttgttgactagccggtgcgcttgaagcaacggatgtacttgccgccgtctgtgatgatgatgcagcagacgttggtttagtcactgaaacagtgcgaacgctccattgcggatgtgctgcagcctgtgatgcaggtgccttggcagcagtggcatcgagcaaatcgttagaactacttacagtattaactttctccctcgtgcttgtgcgcgatccggccaagtcttgacgctgaatggtggtgcctgctgcagtggtgataagcagcccactcacgacaagagcgaaagtgatgagacttctgcgtaacatatagactcccccagtccatatcggcaaaatgacttaccacatattcttttcgagatggccatctcatgcttttcattatggcgcattagttttgtaggtaaatatatatgcttaccgattgtaagtgcttaacgttatttttaagttaaataatccttatttcatgcatttatcagtgtttaacgccatatttgctaaacattcttttcaaaagttggttaaaaccgttagcattcaaaccgacttttgagatttaaccgtctgatttctaaccaagcgactcacgcttgtcaaaaaactgcgacaacgtccgaattttttcgggaacgctgtcgcagtttaataccatgatgaagcttaaatactgccgccatgaacctcagttgctgccatggtcaagatgaaagcattgggatcaattgcgtggactaagtcaatcagatggcggaagttggcttgttcgaccacgaccatcaacatctcctttgactcatccgagaaaccgccaacgacgcgttgcaccgttaagccatgcggcgtttcgtcgcggacttgctgtttaatcgtcgccaattgcggactcatgatgtaaactgcctttttccggtcaaaaccggtttcgacataattcatgaccagtccggtaatcgccaaagcgaacacggccaagatgaaggcctcgacgccggatacggggatgttaaaaagtgacacgatcacatcagtggctagtagcatgactgatggtttcaagccaaagtattttttgaaaatgagcggcggaaccgtggtcccaccgcttgaggcatccatttggtacaggaacccaacaccaaaggcaaacacaacactgccgacgatgatcgccagcaaccgatctgtgaccaggttgatttctggcgtcagccatagcagcaacggcaacatgaagctgccgaataaaatgcgttttaaggtgctgcgatccaagaagaaccaagctaaaagcagcatgagcaagttgacgcccatggtggtgatgccgacttgaatgccggcaacttcttgaaccaaaatggcaattccggttgcgccgccagctgcgacagcgtgaggtgcgtagaacatgttaatactgatcgcgatcagctccagcgctgccacgatccaaaaccatttgaatatcggatgtcgcatcgttttctgcatcaagccaccctttctgttaattatgtttaaaccgactcttatcgtactaataactatactggaaaagtggtggtgtgacaaacaggcgttatctggcgtgtggtttggttttttatgttctatttctgttaggaaatttccgaaagcccgggctggctacgcggcgattcggggtggcgaccacgaagctagcgcactgggcacgacttcaagcccgcaaagcccccacggtcttgaatctcggccttggtctaggcggagaaaaccattccaccaagaccaatttcagtgctgagcccatcgccgctccgccagccctcatcattctattctagaattcgagagaagttgacgctcacactgttaatgaaatgatgcgaaataacacctgcttaagacagccaacccaagatataaccgccaatttaaaaaatagggaaccacatttagacagtacccacgctttctattcttcttcccgcaactcacccaatcgccgcttcaacacctcaacctcatcctgtagctcagtaccaatgtcagtttctgctaccgttcggcgccgggcttcggtttcgacgacgcggcgggttgaaatgatatcggtgaggttggcgatggcatcggcttttgtggtgaatggttggtgcgttactagctgcatgccataggaattatccaaaagcgtgtaaccgccgattccggtggttttttgatacggtttagaaaagccgccgtcgatgacgatcattttgttgtttgccataatggggtcggtgccctttttgactggcgtatggccattaatgacatggccgacttcaggatcgaggacaaattccgccaagatctttttgataaattccgggtccttacgcaggtgataatatggattacggccttcgacatgggctttcggatcgctaatgaaatagcgttcaaaggtcgtcatgtcgtacttgccaaaaagcggtgaatttggaccggtccagagataccacatcagatcggttgctaagtcagcattctccgttggttgactgtatgccaaccgaagatttgcttccagcatgtcaaatagttgacggccagtataagtcgtccctttaatggtcaagccaacaaaattgccatcctcgtccaccggcacacacccgtgcagcaacaaattccggttgtaccgcaaatacatgctgccgtgatcaagtaaaaaatccatgtggcgatgcaacttttcagagtgcgtaaaggactcaaccagcgagtcaatgacctcttgctcctctggcaacaacttgtaaggatcagccggatcaaccgtcgcaaaacagccgttttcaatcgtataagtatcaccattcaacttgatggttgaaaaatcaggtgccagtttctccagcactagccgatgatccatgtcaaattcaggccggcgtttaatcactggtccttccaacttaaattgaatcatcgcaatcgcctgatgaatctgggtaatttgaagtcgctccgcctcagtaattggtcgatctgatcgctccatttttggtgaaaaggcgggattatcttgatagtattgttccgctaatcgggccaaatgccgcaaattaatcccataaacatcttcgagaatacttaaattgttataccgcgcggaaatccgcaccaaattggcaatgcacaaagccgagcccgcggcgccgccgatccaaagaatatcatggttgccccattgaatatccactgaatgacgccgatcacgtctaatcaagctttcaaccacctgatccggcgccggtcctcgatcatagatatcgcctacaacgtgaaagtgatctaccgttaaacgttgaatcgtttgacacgttgccgcaatccactgatcggcctgttcaagaacgattaaattacgaataatttgccaataataagccagcttgtcaggcgtatcggcatcattgtacagcaactcttcggtgatatagacaaactcgggtgccatcgccttgcgaactttcgaacgcgtgtatttggtcgcggtgaacgccagcaagcgaatcaaccggcgaaaagtcgtcaaataccactgttgcaagtcatcccctgccatctcccgatgaatcgccgccattcgctcagacggatagtacaccaaaaaagcgaagcgctgcagggtcgcctccgtcatttcatcgcgaaaacaggaacgaattttgcttttcacattcccgctgccgttccgcaaaacatgctgaaaagcgttatactccccgtggatatcgctcataaacgcttccgtcggcttaggcaaattcaaaatggcttccagattaatgatttcagtcgcaatcgctggcaccgtttgatacttcgccgtcagttcactgtacaagtccatgaaacagcttcctttcacatataccaattttggctcatggcaatatcatagcataatcctctagattgtatacggtttcagccaatttcaccatttccgcttgaaaaatgacctctgattcagctctgtcgtcactatcatgtcctaacattcatacaaaaaacgtccaaatgatcgttagctaatagtcaatgatgaatgtccaaccctagattgcaataataaagttaccacctagaaagaggcttgctcactgcttgaactggggtttgccaacggagacattttctgggtttgttattgataagcgctgtggctcgttgaatattggcctctgaaacctgatcaaactgtgttcccttcgggaaatagtagcgaagttctcgattgaaccgttcatttgtgccccagcacgttcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggtcctaaatgaacccgaatatcagaatcaaaaaccacgcaaagtttctcgccgattttacaagaatttacctttccagtctaatgaaaacttagaagatcatctgcaatggatggcaacgcatacccacaagtgtcagaattcacgaatccggatgtctcacctaacgggctaatcgtctatcgctttccaaagttttttagttcaacgtcaccactagcgatggcagtttcttaattatgacttgaaccgacatcacagatgaaagtgatgagaagtaagcagaaaacctaatgcatgaaaaattgacagatttaaaatttaagcctgctattcttcaaattcgacaaacaatcaccctcatcccctcctagctatgtttcaggtaagtttgagccctcatattgccaatcgcttgcttcaaaataccaagatcaaagggtctttgatcccaatcattccaaaattgcttagtattactatcaggttcatactttggcttgtccaatacaatctttgtcggcatgattaccgcatccccaactgctattgcttcgccagtatcaagcactggtagttgagtcagaaattggctcattgaatctggcagcattgttcgaacactgctttgatcagtgccattggttagtctaaggacaatgaagttgttgcattgactcaagattgtccgatttaagtcagatggtctttgactcaccacaactaacgataccccgtattttcgtccttccttagcaatacgttcaaaatttctaactggttgactttcacccgctgtcatcaaatccctcgtgggcagatacaggtgtgcttcatcacacacaagcgcaaccggagtccgattatcggcatgtatccaagactgtaaatcaaagattagcctcccgattacacctgtgacaattggaagaacatccgaaggaactgctgaaaagtcgattactttgatcccatttcctccctcaggggtagatagcagcacctgatatagcttctgtaaccagtcatatgaatacgtctcttctggcggattaaacatgaaagcatatcgcttatcttgcgacttagattccaatctagctataaatcgtgtcagtttaccgttccaaggtccttttatcggtttgctcgtctttggagaaatagcttttccctcatcatcttgtttcaaagctgtcaaaagcgtcgacattttaaagggtatcgaggagtcgcctgtaatctcaatatcgtttccatttttcgtcacggtagtttctttttgctcaagtatatgctgattaaatctattggcttgatttggagcgtcatggtctgttcgatccagaacaattgattgcagttcttccctgttaagcgtccagaacggaagataaagtatgtctttacgtaattcagtatccgatggaccagcaatctttaaataggtcgcaaaaccctcttcacctgtagttagtgtatggtactccccatgaacatcaaacacaataatgttgctgaaatctaagttgcttgcttcctccaacaacttagaaacgagccagcttttaccagatcccgtacttccaaggatggctgcatgcttttgaaagaacttatcaccattcaagtttgcgatcgactgcttatctattgcatacttaccaagtgtcagcggggaaattgctttcgaaagctcggtaatcgaattcataaacaacgtcagattttctgagtcaaaactataaactttgtccccggggcttggaaagtcctcaatgcctcgtttaaacttgttcacattcttaccctgaacattcaagagggtaccaataaatactgattccagttgattgacaactgtcagcatgctagtgatcgattcgctttcagctgagatgccatcagtattttgcgcatatgacctgtgaacatccgttactgatcctattgtgaaaatcgagtgattggaagtggcaattgcgattaattctccgatctttgcggagtgtacactcgttaaatcaggcaattcttgaagcgaaactatgactttctcagcattaacactttcaacttctccaataatatcagtttcattaaaatcaatttttttcattttaaccaccctaatcctgacgaaaaacatatttagctaaggcatcaatctcccatattggttctttcaaatccaaatcacagaccagcgcaccttcctgcttccatctaacgtgagacccactctcgtgttgaactatcagcatacaatttggagacttgtcaaacagcaaattaaattgccgatttgactgcatcgttgctattaatttaggcttaattcgattgctttcatggtcgtaatgatcctgaagatctgcatcattatagccatatcccaaaagcagatagccagcagctttatctatagcctgattacacttggcataaaccgtgttgaacggttctcgacgttcatttctccatttgttttttccgggggtaataatgtctggtgttccggtgctggcatgttgaaatagatatgttcctcctccctttttagaaaaccaatcgattgatccgtgaggctttaacaataaaatgtagttattatcttttacagctacaatgctatttcgcttaacgcgtttcaattgttggtgttgttcatcatataggtccggatcaaatttccgaaaatagttgccataaaataaattatcaacattaattccaagagacagacacgtatattcaatcaaacaatcatagttggttgttatgatagttaaaggcgtattatttatgggagtatactgcctcaaaatccggtacaggttaagttgtcgattgttttcaaaaacctgactaaatatctcagagtcctttgcagcgattaatgaatacgtagattgaataatcagattttcaactactggagaaacctctttaactgaaagagcaccttcaaggttcgttcctttttgcagttcgctctttacggtattccagccttcaagatccgacgacttaagtccttgtagattactaagcttctgatctacatcaacaagaagatgctctgccaatttccccattcctggaatcccttcgccagcagagattcctgagccaatcgtaataagcgtctgttcttctccaaattgttgtatatattcgtatactcggtcaataccttctcccacagcaccagcctcattcctcgtatagattagttcaattataatcgctaagcctaaggatagatagccttggctatgttgcttaaaatccaatattttcaattatcatttaatgcctccacaccgacaagcgtcggtaactaacttatcgttctcagtccaacaatgattttgggtgttctaaaagattcgattgtcaaaatgtatcaattaatatattttattttattaatcatgttgatttttgaagggggtctctgtctcacctgagataagtctctcaataaattaattttatattagcacgataaaggttacaaaacattctttaacaacagatccggcaaatctacctctacaaaataaccctctcaaaatgtaccggcaactcatcaactcaaatgaattccagacaaaataaaaaagctgaagcatcaacgattttcttcattgagcttcagctaaattcatttaaattttgtaccggtcattcccactcaatcgttgccggcggcttggaagtaatatcataaaccacccgattaacgttcttaacttcattcacaatccggcttgagatctcctgtaagacatcccagttgatccgggcaaagtcggcggtcatgccgtcaattgatgtgatggcgcggatgccgatggtgtagtcgtaggttcggccatcgcccatgacaccaacggatcggaagcctggtaagacggtaaagtattgccaaatgtctttgttcaagccatgcttagcgatttcttcacggaggatataatcggaatcgcgcacgatttcgagtttatcttcggtaacttcgccgatgacgcggatgccgaggcctgggcctgggaatggttggcgccagacgagggcgtggggcatgccgagtttttcgccgagttcacggacttcatccttgaagagtttgttcagcggttcgattagcttgaacttgaggtcttctggcaggccgccaacgttgtggtgagacttaatggtctgagcggtgtcggtaccggattcaaccacatcggtgtagagcgtgccttgggctaagaaatcgatgccgttgagcttggctgcttcttcattgaaaacttcgatgaagtcgcgaccgatgattttacgtttcttttcaggatcagtaacccctttgaggtcgccgaggaaacgatctttggcgttgaccttgatgatgttcaggccgaacttgcctttgaggctttccatgacttgatcagcttcgcctttacgcaacaagccgtgatcaacaaaaatactggtcagctgggtgccgatggctttgtgcaggagcacgccgactacggatgaatccactccgccggaaagaccgaggagaacgcgcttgtcgccgacttctgcccgaatcttgtcgatttgtttggtgatgaagtcgtccatgctccagttggcttcagccttgcagatgtcgaaggcaaaatggtggaggatttcatggccatattgcgtattttgaacttcagcatggaattggataccgtagaatttacgatcatcgtcatccatggcactgattgggcagttgatgctggttgcagttcgccggaagccttctggtacgcgggtcacgaggtcgccgtggctcatccagacggtttgatcttttggcaaatcgcggaaaagcttggcgctgtcatcggtgacttcaatgtccgctttgccgtattcacggttatcagccggttcaacatccccaccgagccgttgtgccatcagctgcatgccataacagacacccagaatcggaatgccgagcttgaaaagatcctcatcaacacctaacgcgccttcgtcatacacactgttagggccgcctgagaagataatgcctttaggcgcaatcttcttgacttccgctgccgtgatcgtatgaggctttaattcagagtaaatcccaaattcccggattcgccgggtgatcaattgattatactgactgccataatcgaggacgatgatcttgtcgtaatccttgttctggtcatttgccacagtccgccacactcccttgtttgaatgcactaattttacagagttttcacatgtcggtcaatcacgggtgagaagcctctcatctaagcgttgccagcgataggcttcggaaaagccaggcgtgtccgacactgctaaccagttgtttatcaactgacttatcagccatatcttaccattttcgcagcgaaacttggtcaatttcatgtcccgttgttttgtgcaaaataatatcagcacgatttttggtaggcaggatgtactcattcaggttcttgaggttcacatcgcgccaaacttgccgcgccattgcgaaggcatcggctcggtcgccaatcgcgtattgatagtaatagttgttcggatccgtgaaggccgtgtcgagcaggatgccgaaacgctccagataccattgttcaatgaggtcaggattggcatcaacgtaaatcgagaaatcaaagtagtcgctgacgtagattggctgcttgcttggcagctggagcacgttgatcccttcgacaatcagaatatctggtcgatcgatcagttcatattcgcctgggacaatgtcgtaaatctggtggctatactttggtgcacgcaaagcgccgctcgcatttttgacgttgttcatgaaatggattaaaagttccatatcatagctttcagggaagcctttacgatcaagaattccccgacgttctaactcagcattaggatataaaaagccgtctgtcgtcatctgttgcacgcgtttttccggataagcccggctcagcaacagttgcagcaagcgcgcggtggtgcttttaccaactgccaccgatccggcaatgccaatgatgaatggtgtgtgcggatttcgttgcatccctaaaaagcggctcaaggtgaacatatcgccttgataatcctcatagcggatgtgaatcaggtgtcgcaatggtgagtaaatcattttgacatcatcaagactgatttcatcattcaatgatcgcaactgcgccaactcttcatcagtgacattggtgaagttctgggaatggaattgcgaccattctgcacgatcaaatttatagtaattcatttcggattgcataacttaccgtttccttgcgtttaatgttctcattttagcatagaaagccccagttgttcggccaatccttttcttgacaacaaagaaaaaaatcttcacaatcaacctatcaaaacgacgcgatgccagctcgaacactgacggaggtgccagcaatgcttgaactagtaggcgagtttctcctttcctttttcattgaaccgattttagatggcgtaattgccccacttttggcgcccacttttaaacaagacagttccttacgaaacaattcactcagactgggcatcacgctcatccttaatagcgcgattgcaggcggtggcggctggttgttgttcgaatccgcgacggcctcaccggtttctggggtggcgatcatcgtcggactaagcattttctcgcttggcttcggcttaatcgtgcgtgctatcattaaatacggtgcttacatccgcaagttgcgtcatattcggacggccaagcgtgatgccgaaaagccttatcaggaactttaacattgagggagtacgcatttgcctaacaaccaaggaggcacgctgaatgcttaaccaaattggaaaatttattttatcgattttgctggcccttttcctcgtgccaacattccgccgtagtccatcaccgttttggtactgggcatggtatatgttactggtcattttttgtgtcagtggcactggctttggtatctggctgcttgtcctcgcgcggtttcgcaccacggccggcattatcgtctttgttggcatcttattgatagtgttgatgccactcttcttaattcgcgcgtccacccaatttaatcggtatcgccatcgtagtcaaaaataggcaaacaaagagcgctcttcatcgagcgctttttgtctgccttcaattggtgccagtcatcacctagtcgtgcaaggtgaactgtaacttcatttttggcgctgctgccgccaccatttgacctaacaactcattgctgttggccatggcgatcgttgccatctgctcattggcagctgtcagatgatcgccaatatccttggcatctttgacagcttcatcagttgtgagctgcaagtgccggcaagcggcgactgttttttgttcaaaaacatcttcctgatctttaaataaggaaaagtcgtagtcaccaaacgttgctaacaggttgcttagccagtacattttcgtcacatcgaacttgtcgccggtttcgcggtatgctgctggtgtgtcattgacattagcgtaaaacggtacaacggcattaaaggtgttcgggccaaatgccaaccagtgaatgccggcaactgcagctggcacattgttgcgaatctgcaaaatgtgtagttcctgattacggttgatgccgattggccgataaagcttcttctgtgctggcgtgcctgtcgtgccgtaaacatcgtatggcgtattttcatagtgggaactttccacaaacttcacgtcttcgatgctgatttttttgctagtccggcaaatgaatggcagatcctgatcgatcggtgtcgtatcgaattcagggttgaagtacttctgaccgtaccaagtacgtgggttgttgtaacgggtatccttgatcgtagcggagccgaaaatgtggcgcaagttgtacccttcagtatctggattaaggtgataggtttcaatcagatcgcgcagatcggcactactcatcgtgtcatcgctagcaaaatcgaaatcggtgatattgaagcggttcggcgccaccacataggcatcgtcgggaattcggatggctgcccaatgatgaccgccaatactttcaaagtaccaaacctcatctttgtcagcaaatgcgatcccgttgctttcgtatgtgccatattgttcaagcaaactgcccaagcgttgaaccccgtcccgcgcgctatgaatgtatggtagaacgatcgttggcatgtcttcttcgccaatccccgctgccaccagcggatcaacaccaaggacacggctattggttgtaatcgtttcggttgaggtcatggcaatattttcgctattaatccctgctgccgcccagataccgtggccgtcttctgcttccggggtggctgtgtagcccaagggatcggctggcaaatcaatcgcgaacttgctgagcacggattgatagtgacggggctgatcttcaggtttcacgtacacgaacttctgcggatgcaatggtgactcaccgtcttcgtttcgggcaatgattgtggaaccatcaattgaagccttcttgccaacaagcaccgtggtacatgaaccgacatatcgttttgccaaaataatcgtccttctttcaaaatgaatccgcatatttgcagcactgtgcgggagttgatttatggtttactttaccgcgcgaaaacgggtttgccaagcgtgcccgaaaacaagtaacaaaaatagccatccctaaagtttaaccgccttgggatggctatttgtaaattcagagccgctgttgacggcgttgttggttcatagcggctagcgactggaaaacggtagcctttttacagactcatgtatcatgcattttaatggcgcgtctagtcaaactgttctggtctctggactgacgatctttttaaacttttcaaaatccaagctttcaatccaacggtacctcgccgaagctagcattgattttccgatagtcggcgcgtcgttcatcgtaaccggctagcaaacgcttttcaaactcagattctgcttcgaccggcggcagtgggccgtcttctttgtggcgggctacaaaggttgcaaaggcggtgccgacttggaagcgttcgccagtggctagatgttcaccaattaactgaatgaaaacttccagtgaacggtgccccacgccgctgaccatgcacttaatgaccagtgcatcccccattttaaccggtgctgccagatgcaccatgtccaatgagccagtcgctaaaccacggcggccgagtcgttgtgcggcaattgagctgacgtcatcgatccaagtaaagatctgaccgccaaacaatgtctgatgcgcattcagcatacctggaaaaacacgataactagaaacagctaaggtgtcatgcattttgaccatctgtttacccccgctcgtacaagtcagccggtactttgtctaacaacggcgtcacatcaggactagccagcatggttagtcgatgcatggcccgggacgccaccgtgtacaacaactcacgttcatcctcttcatggtaattggccgcattgatttgccaaaggacaacggcatcgaattcgaggcccttagccaaaaagcttggaacaacgatgacgccggctgcgagtcgttgattttcagacttgatcaaagttactttgatgccagccgccttcatttgttcataaatggcttctgcggcttccagcgttttcgcaatgaccgcagttgtctgcttcgcttcattgttaattttcaattgatcctgcaaagccgccatcaacccggcttcatctggacgaacgaccaactttggcaatggtccttggcgattgaacgccacgattttttgaccagatgtgagaatcgctttcgtaaagtcggtgacctgtttggtagaccgataactttgggttaactgcacgacgcgggttttttctggatcaaacagcttgctggtttcgttaatcagcgtccgcgaatcgtcttttgtgaaaatagcctgattgagatcacctagcaacgtaaacttcgcccgcgggaagctgtccttgaggtaggcgagctggtatggtgtgtaatcttgaatttcatcaatgaagacataccgcatctcgcgttcaccatggcgaccagtgatcaaatcatacaagtgcagatatggcgttgcgtctgccattggcagttggcgttccttaaataaggtaataaaatggtcgacttctgcctgccagtcatcagcgctaatgccctcggcctcgaggtcataaatagctggtacttcacgcaagaaactaacatactgtccgcgaatattaaggaagcgatcacggacaatatcttgttgaatttcgttgaagccacgcatcaccagttggcgggcgaagaaccgatattcgtcatcactattcttaaactctttcgggccgtcttgttgcatggagcgaatctcttcaccgcttagattttcaacggcttcttgcgcccactgcgatttcatttcggattcaattttccgattgagcattttgatcagccgttccttggtggcggtcaggcgattgcccatgtgataattttcgttgtaactataaaagatttcatgaatccgccggcgggagaagaatacctcaccacggaagcgaatgtcacggaagcgcaagcctgatttttcaagacttgtcgcatatttcttggctgtctcaaaaaagtctaagctgcctttgacacgtgcaattttcttttgaactggggttagttgttgctcgaactgagagaaaaggttttggacatcaatgtgtggtaaccgtcgcgtgacatattggtaataagtgaattgcaccatgttctgttcgccaagttctggcaaaacattgctgatgtagtcagagaaaagttggttaggactgaacataatcacctgactactactcaggttgccccggtaccgataaagcagataagcgacccgctgcaacacggcactggttttcccggagccagctgcgccttgcacaaacaataagtccgctttggtatcacgtataatctggttctgttcgcgctggatcgtggtcacaatcgtcttcatttgggtgtctgacttttcgcctaacacttccagcagcatctgatcgccgatggtttcggtggtatcgaacatcgtctgaattttgccgtttttaatgacaaattgacgcttcaaagaaaccgtgacctgttgcgggccatcgggcgtttgataggtaaccttgcccaaaccgccatcatagtaaattgagctgatcggcgcgcgccagtcgtagatgagaaacttaccagcttcattggtgaaggaacctaagccgatataaatcgtctccggcttttcccggccttcttggaaatcaatccgcgcaaaatacggattgcccatcaaccgcttaacagtcgcgagttgctgcgcgctttgtttccacgcattggttcgctcatcaagcacgcgttgctgttgctgaattgaggccgcagtttcaatcgtttcagcgtagtcggtgaagttcaaggaaaaatcattgaagaagttgtcactgatgttcttctcttcacactttgtcttggccatctcttttgaaagacggctttcggcaccggagagctccttcatgatgcctgtcaaatgtgtctgctcttttgcttgttcgttctcagccacgacgtcatcccctttaacggttactaaataatcgttataacatcttatcacttatgcgtctttgtagcaaaagagcttgagtagaagagactgtagcgcaatctgattctattttaggcgtcagaacaccgtaagtccgagttggctacgcggcgattcggggtggcgaccgcgaagctagagtggtgggcacgacttcgagccaacgcgcaagcccggcgcgccgtctcgaagctcggccttggtctaagcggagaaaaccgctccgctaagaccaatttcaccactgagcccatcgccgctccgccaactcttgcattctatcctcgaaatggaatcatcttacccgtgataccgccatccaaattgtgggaagcttaaacaaaaatcatggccaccaaccaaacgtaaatcactattctcatagatagtctcatagatagataggtgagatttaaagatcccagtgccaaggcggatcaatcgtaggccagatggggttcagccgtgcaaacaacacagcgaccgggcttggagctgatgttgttaggcgacttcgagaccgcgggctttgcgggctcgaagcgccgtctccgctctagcttcgcgtcgccagccccagctggccggagattgcggagtttggcacagcagtaaactttttaggctgctttattctaactacagtccgggattcttaaaattttccccgcaacaacggcgtccatgcttcaagcacgtaccccactgccaagccaatcgcgacgcctaataatatttgcttgaatggtaagctaatcaaaagacccagcaacacgcatgtaccaacgatgatggagcgtcgattgaagaaacgctggccttgtttttttgatttattattttgtgacatgatatttcctttcttttatccgcacttttcgttaccattgacccatctattatcgctgattggaggacattatggaatccatttcgttattaattgtgctcacggcggcgtttttgacgccgctgctgatggcacattttcatattaatagtatcccgactgctgttgcggaaattttggttggcattgtgctgggcaaaagtgtcttaggctgggtcaggactggtggtgagatgggctcgctgagtgagttgggtgtcaccattctgatttttctttccggcatggaaattgacttctcgctgttcaagccccagcccaaaacaactgatggacccaagcagccaaacccggtcatgctagcaatcacgggattttcgactatcatcgtgcttagtctcggatttagctacttcctgcaactcattcacttctttaactatccgatttttgctacgattttgttcaccaccatcgcgctgggtgtcgtgattgccgcgctgaaggaaaaagagttgctgcgtcagccgattggccaaactattttattaattgccgcccttggtgaagtggtgccgttggtaagtttgacggtttactcagcgttagcaggcaaatcggatcgtaatttgtggctattattattgttgctgcttgccgccttattccttctaagccggtttaagcgcatctacggcttccttgccaccattgataaaagtacgacgcagttagacattcggctggccttctttctggtttttgccttagtcaccgtggcatcacgggtcggcgccgaatcaattctcggtgctttcctagctggcatggtgatgaaactgctcggtccccggcaagaaacgcaggataagttgacctcattaggttatgggttcttcattcctattttcttcattgtcaccggcgctaatcttgatctaaaagcactggttgccgacccaaaaagtctttcattaattccgctagtcctgatcggattctttattgctaagattggcttgatcccagtgctgcgccgtcggtttaagcctcaaaacgccttggctggcggtttcttgctgaccacgaccatcacgctggtcatcccgaccctgacagttggccgcaatctcgatattttatcagaccagcaatccggcgcgttcaccctcgccgctgtcattgcctgtgtcgccggtccaattctcttcaacacctttttccagccggaaccggaacattttaaaaagacaaaagtgaccttcatcggtggcaatctgctgacagtaccgattgcccaacatctcagtcctgatcgctatgaagtaaaactgttgacagataagccagaaaattaccacacgtataattcagaaatcaacattgccttggcagcctataccgaatccgctttgaaagccgctgatgcttatgactgtgacatcatggttcttggcgatttcgatgccgacaccaactacgatctcgcgaccatggcattagccgaaaaagtgccacggatcattgcgcgattcgctccaaaagatgctaccagtgatcgctatgatcgcttgcgggcccaaggtgtcgaagtgtttaacgccttagaggcaaatgttgctttgttgcggagtctcattgaaacgccgtcaaccttgcaaattctggatgacaccgttgctggcatttacgaaatcaccgtgcgcaactcgcgatttgctggccttgaattgaaaaatctgccatttattgatgacattaccgttagtcaaatctatcgcaataaaaagttcgtcgcaccgcatggcgacacccaaattcatctcggcgatcatttaatcttttccggtgacaaacacgtgattcgcgacattcgcgaacaagtcgagaaattgaattaaagctcaccgcatcgcgtggtacaatgagattattctaagaaaaaaaggtgatcaaatgaaacaagggacaacaatcctgaccttagacaatgggtatcatttgtggaccaacacacaaggtgaaggcgatatccatcttctttgcttgcatggcggccctggtggcactcatgagtattgggaaaactttggcgaagagctggccgatcttggcgttcaggtacatatgtacgaccaacttggctcgttttattccgatcagccggattataccgacccggaaatcgctaaaaaatacctgaccactgactactttcttggcgaagtagaagaagttcgccaaaagctgggtctggatcatttttacctcatcggccaaagctggggcggtgccttaacccagctatatgccctgaaatatggtcagcatcttaaaggcgcaattatctcttcaatggtcgacaacatcaacgaatacgttgatcatatcaacctcgtccgtgaagaagctttgccgccgtcagcggttaagtacatgaagaaaattgaaaaagctggtaactgggacgacccgcagtatcagaaatatgtggatgtcctcaatcgcggttatgttgatcgcaaacagccaccagcaatttcacacctgattagcaccatggccacgcctgtctacaatgctttccaaggcgacaatgagtttgttgtgaccggtaagttgaagaactgggatatcagtgatcagattcacaatatcaaggtgccaaccttgctcacattcggcgaacatgaaaccatgccactgaagtcagcccaacgtatggctgaggtcatcccacacgcccgactggtcaccaccccagacggcggccaccatcacatgattgataacgccccagtttacttcaaacatttgaagcaatttatctctgatgtcgaaaatgggacttttaacgactaatatcaccgaacgcgccgcagttagcgacgcgtttttctgacgaaggagtatgaaagcatggcttatacagttgattttaaaacggtcagcaccattggtcttgaaagctcgcctgttgctgcagcattggcaagattgcgcgcaaatgaagcgcgttacatctggaataagtataaggaaccttatatcacttatccggctgccgaaaaacctgacagtctcgcgtgggttaatgaaattctcgccgaacgcgacttgcaaatttccgccaagtctttggaagtcagcgatttgaacttaccggatttgcactgggttgagatttactatcaagacggattagtcatcaacgtgatgtatagcctgtccgaccccaaaaaacgcgcggttggctttaaacttagcgatggcatggcggtgccgactgagcttgaaggcaagtttaaatttgcccggcaaaagtcgaaacttgcgggcaccattcgggggtcttttttcgtcatcaagggcagccattgaaaaaagacaactttttaacttgataagcttacacatacaaaagacggccaaggtgatgttcctcagtaatggaggtatgacatcaccgtggccatttttgcgtataatcgtttaaacaaagactgaaatggccagctgaatatttagaacggtgatcacacccgtcagaaaatagccgacccaccgcacgagttgcgaattaacgtggatacccatcaaatcacgccgattcgtcaaggccaccaacgggaaaagcgtaaatggcaaggcaatgctcaatgacacctgtgcatagacaataacttgctcaaagttgtgttcgctaaaaccgatcatgaagccaatcaccatgatgggaatgagcgtcacaagccgcgtcagcaacctccgctcccacaatggcatgcgaatgttcagataaccttccatcacaatttgtcctgctaaggtgcttgcaatcgagctaatcaagcccgtgataagcaacgcaaatgcgaataatgtactcattaacggactggccagcccgccaacaatcatcggatttttcaacccattataggcaccttgaaaagccgtcacatggcctcccacgccataaaacaacgctgccccaagaatcaatagcaaggcattaatcagaaaagcggcaactagatgcacattggaatcccacttaccaaaccgcagtgcctcggtcacctgtgccggaatatgctcgtcgtatttgcgactctgggctagtgaagagtgcaagtaaatgttatgtggcatgatcgtggcgcccatgatgccgagactgagcagcaacatgccatgattcgtcaggatgtccgtatgtggcacaaagccgccagcaatcccgccaattgatggatcggctcgcgcaacttcaatgccgaaaatgatgccgactgtaagaatcgataccagcacaatcaactcaattcggcgaatgccaaatcgtaagaataataaaacaaccagcacatcagcgatggttaggagcattccccacatcagaggcaggccaaacagcagttttagcgcaatcgccgtccccacaacgccagtcatatccgtggccatcatagctgcctcattgatcaaccataagcagatgcggctccagttcggaataaatgcggcaattgcttgggccagatctaatcgtgcgaccacgccaagtttaatcgccagcgtttgcatgaacatggccaccaaaatcgacatcaagagtaccgatagcaaggcgtagtgataccgactgcccccttcaagtgccgttagccagttacccggatccatataaccaacagcaaccaaggcacccggcccgctgtatgccagaaacttctgaaaaaacgaagattcataaacactcggcacctgcacgctgcggttaatgtcatcaagactgcgtttttcgcgttgcactgttaagcgttcatcaggccttgccatggttcgcctccgccgcaatcttatcctcagccaacttagctaaaaagtcacaaaacggctcgcaaccattcatcggtcggacagtcgcaaagtttttgccgccattagcacgaaatgtttgataattctggacattattttcttccagtgtttccaaacaatcagccacaaaactcggggttgccactaacacattgcgcttacccaaagcagccagttccattaaccgattgcgtaaatatggcttcaaccaaggaaccgggccaaactttgactgataacacatctcaaccttagtctggggcactttcttaagatactgcttcacacctgctgtggtcgtttcacattcctgctgatacggatcaccatgccgcaccatcgctgtcggaatgccatgatagctcagaataacggtatcatacgcccccgcttcataagcatcgtcgatctgttgcgcaagaatcttttgatagtctgaatgatcataaaaacggtcaataaccacggtcttcacgcctgaagccgcgaccttatccaaaatagtcttcgtcgtactttgcgtgtattcaggaaacagcgggatcaccacaatcggcgcatcaccacgcgctgccatcgtctgcagcgtttcgccaatcggatactcgccgccatagttcatcgccatctgcacatcccagtcaggcagccgctcacgaagccgatcccgggtcacctgcgtataggcaatcaatggcgagccagcttgggtccactcatgcttatagaaagttgccgaccgccagctgcgaaagggtaaaataaaaccgcgcaaaatcggttgccacaaggctttaggcattgtgatgacgttctgatcactcagaaactcccgtaaataccgccgtacatcctttgtctccggcgaaactggcgatcccaaattaacaatcaacaacccttttgccatcctgctacctccgcatgtgatccactgaataattaaagaatagcacacgttggtactgattgcggcgttgttcaagatgctctttaagcataaccaccatgcttttctatgctaaactagtcttagcaattaacttccgaggaggcagatgaatacaatgaaaggcatcacagtctatctggtgcgccatggtcagacatggttcaaccattttaataaaatgcagggttggtgtgactcgccattaaccgataatgggattaaagattctactaaaacgggtgtcattctacgcaacgtggccttcacacacgcttattgcagcgacaccatgcgagctactcgcacggccgatctcattctcagcaaaaacgtcactggcaagattccgctaaccgtcacccaatactttcgtgaacaattttatggctattttgagggtgaagattctagcaaaacttggtatgaagtcggcttcccgcatggtgccaagacctatccagaaattttggaaaaatatggggttgacgcctcaaaagacttcatgcacgatgctgatcctttccacgaagccgaagatgcgcgcacttattggacccggctgatgaaaggcttccgccagttgcgggccgaaaaccatgaaggtgataaagtcctgatggtcagccacggcacgaccattcgcagcatcgtcgataagttcggcaaaaatgatgggtatgtggtcaccgattcgcctcgcaacggctccatcagtaaaattcttttaactgatgaaggcattaaagtattgagttataacgagtttgaagcatagtttgtccaaaccgaactttttgccacttttgtattgtcgagcaaataaaaatgccctttcagacaaaaccagtctctaagggcatttttatgttgttcatctgtcaatagatgtctgcacacgacgttttagccggttaactttaagcgtccaaacctgctatttttcaagaaaacaaagatggtaggctcaaacttcttgccgtgccaaactccggtctttaaaatcacaataataatccatgaacaggtaaaagcgaacaacttcccgatattagggaaattgttcgcttttaattgtcagctgagaattatgttccagcctatagtgagacctaaaggatcttttctttaggctttttccgctaagttcttattgatcacaatgctctggtacatccaaactgtcgccagataatagagtgcatacagaacgatgaacaaaccgaatggtaacgcaagatgcccgtatggtgcgcgcaacatggtcttaaaaagctgaaggccaaacaagacgtggataatgccaacgaaacctgggagtaagaacaaggctccgatttcttgccgaattgagcgtcgcaatgcacgcggtcgtgccccgattttctgcaacatcagataacgactcttgtcataattggccccagatagaatcttgaacatcagcgtcgaagctaacatgccgaggaaagcaatgccgaggaagaagcccataaaagcgaggccagagaacatgctgttcactagcgcataaatcataaacttctgatcgccgttactgctccataatcgcggatattgcttgctttgcagctcgacaattttctgaatcgtgtcgtaattttgaccgaaatccttaactttaaacgtggtcaaagtttctgcattcccgagcttcgcgaaggtcgcggcatctgcgactttcatttgtttacctcgattattgccgataaaaataccaaaagaacttgggtaacgttcaatcatctccgcaaagttgtggctcgtgactttaatattcggcgtatcaagtcctccgtcattggctttgatttcaagcggatgagcgtcgagagcttgctggctgatgtaaaccgttttggcatccgatttaatcgtatagtcttgcttagcagtgacatcctgcaaccgactgatttgcgcacgggtcgcagcatttggcgaggcaactgttaaatcgtaggcggtcgcctgactcgccaaatccggaatatcatgcgtaaagccaaggccaacagtaatcgcccctaaagctaaggcaaacagcatggcaaccacggataaaatccgggtatagtcccgaatccggaaactcagctgcgacaaggtaaacgtatgcaactgtttggctgcaaacttgtggtttcgcttcaataagccaatcagcgcgacaaagactgagttaaacaggaaataggttcctagaaggatggtaaccaaggccaatggaatcgccataatcccgattttagcgatggcatacatgctgtagtaaccaaccgcaagcaaaatcagtcccaagacaatctgtaagacgaaaattcctttgcgttgtttgattcgatttggtgtctgcgcttgatgcaacaaccgtagcattggggttttcaatagttttccagcattatagaacgccgacagaatgaataagacaatgaagaagcctaatgtccacaatacggctggcagccaaaacgctgagaagccagttgccggcgcatgtagggtgttaatgagccattgtcccacaaaggttgtgccgaccatcccgaccaaaataccggcaactgttgctaaaagcccaattgccacggtttcaaggaaaatcagttgcgcaatctttcgcccttttgcaccgagcatcataaacatcgcatagtcgcgttggcgcatgctaagtagaaaactattggcatagacgatataaaccaacgtgataatggccaatagcaccgcgccgaagccaaaaataaatggtgtaaagccaatcggcgaatttttctttaaaaagcttgtgtttgtggcaagtgacatgaacatgtagaaaacggcgctggcgataaccagaccggagaataaaaccgcatagtcgcggaagcggttcttcaggccgccgagtgcaagtttcgttaacatagacgacgccccttacttttgaaatgtgccgagtgtgtcaagaatctcctgatagaaggcttcttgactcttatcaccatggaccagctcggaaccgatttgcccatctttaatgaacaaaatacggctggcataactagccgaaaacggatcatgggtgaccaacaagatagagacatcctgttccttattcaactgttccatggtatccaataactcacgggctgacttggaatccaaagcacccgtcggctcatccccgaacaggatatctggcttctgcaccaacgcccgggcagcggcaactcgttgtttttgaccaccagataactccgttggatagtggtcgagtacttcattgatccctaatgtttgggcaatgctatcaacagccgccgcctgcttcttcgcactcacattttgcaacgccagcggtagggcaatattttcgcggccagttaggttctccaacaaattaaaatcttggaaaatgaaaccgatttttttagctcgaaaatctgataaggcatccccttttaattttgtgacgtcagcacctttgatcaaaacggagccagaagtcggtgtatctaacgtactaaggatattaagcaaggtcgttttccctgaacctgatgcgcccatgatgccgacgaattcaccgggttgtacttcgaaactgacacctttcaatgcgggtgtctgtttttccccttttttaccataggttttcgtaacgttgtcaacagttacgacaggttgcttgtccataatagacctccatttgtatctttgtgttttgtttacaaactttatgatagcgggttaggctgcctttttcctgataatggcctaacggatggttgtttgtaacttacggctttgtaagctgctttagtctttctttaccttttgccgcaaaaccgccgcaatccctgatataatcactaatggcttttgaaaatatacatgaaagttgggtcgcagtgggaaaactccgtaataaggcgcctgggatgagtttaaaaaccagtcgtttttaaaccttcagatatttaaggagccttttatatgaatgaattagataaaccacagaaacaatatatcccttgggtagttgtcggcctcatggactttgtcacggtcattgggttcgatgacatcatttataacttccagaatcaaggactggtcgccttcaccagttggatcatcatgactttcttctatgtgattccttacaacctgattgtcgcgcacatgggctcgactttttccgagcatggcggtggcatcaccagctggatgcgtgaaacaaacggcgacactgtcggctactatgcggcttggttctactggattaccggcctgccctacgtcgtcgatgtcgccaactctgtcgtcatctcatttggctggatcgcaaatggcaatggcaacattcaagccaaccttggcaatgcttggtttggaattctgaccgccgtcattttcgtcatcttcatctggcttcagcatttcttcaaaaataaaagtctggaaatcatgtcaacgatcggcggtggcgcgatgtttatcatgaccgttctcttcgtggtgatgacctttgtcggtttgtccaaaggtgcaccaattgccacgcgcccctttgatttcaaagcttttattcccaaagatttcttctcacttagtttcttatcaactttcggcctgttcgtttttgcgatgaacggctccgagcttgcagcgccatacaccaaagacatgcgccatccagcccgcgacttccccaaggcattgaaaatgattgccatcatgaccatgtttctcacattattcggcactttctcgctcggcgtttatttcaacgctcatcacttgccgaatgacttgaaaatgaatggttcctattatgcttttcaggcaatcggtcgccagtttggattaggtaacagcctgatgtatcttttcgctgttgtccaaggcatctacatgttggcccaactagctgttattcttgacgcttcaacccgtgtctttctatctgacgtcgccaaacgctttatgccacggcaattaacgaaaatgaatgaagacggcttgccaatcaacggctattggatgaccacgatcctttgtgctttgatcatggcgttaggtgctttgctaccaaaaatcaacgacatctttaattggttgttgaacctcaatggcattgtcagcccgttgtcaacctgcttccttttctggtcttacaccatggttcgcttacatcaggatcgcttcccgacgccagcctatacttatctaaaaaatcggaaggttggcttactcgttgggatctggatgttgggaattacgttcctgcttggcacgcttggcttcttcccgacagatgcgactgcggagacgttcgctttaatgctggttttaaacattgtcgttccgattggcatggtggcccttggtgttttgatgccatggatcgcccaacgtcaacgaaaagcgagaaacggtctcgcatttggcagaacaacttggctcggcttcaccgtgatcattttgctcggattggtcagtgccgccacatatggcatgcatgtcaacctgctcaaccatctcaatccaatcttgcaatggagcatcatttttgtcgttgatctcgtcatcattggtgtcgttgccaaagtcaccgccaacggccgccgtcaaattagcactgactaaccgtttttaaattgaatcgtcactagctgcgaccgtcaaaatcatacaggcggtcgtctttttatccttaaaattatcaccggccagcatgcgctatcgttcaccgtgataaactagttaataggaggtgccgccatgctcagctatacgattatctacaacccggcgtccgggcattctaaaggaccaactgctgccgaacaactcaaaacgaaactggaagatcgccagcatcaggtcacgatggcgccaaccaaaagtgccgatgacgcgcgcgagttcgcctatcacgcccaagcagacattgtggtggctgtcggtggtgacggcaccatcaatcaagttgtcgctggtctcgcaccgcgcaaaaatccgccactgttggccattttgcctgaaggaaccgttaataatctcgccaaggttttgcatattccgttactgttgccgttagccatcaaaaacattctggaagctgccccacagccactcgacgttgctcaggtcaataatcactacatggtcagcacgttgaccctcggtgttttagcaaatgcggctttatctgtgacccagaaagaaaaacaacacttcggcccgatcatctacctcatgaagggctttaaagttctggctcaacatcaacattggatcctacagttggatagcgccgatggtaagtggcaaaaagacacgcagttcctattaatcacgatgacaaactcagtcggcggcttcaccaacgccgtccctgacgctgcccctgatgatggtcggctgcacgttttcctcgcccccaaactgaccttgtggcgatcactactagcaatcccgtacttcatcaccggcaacttccaaaaactgcccggcatgacctactttgcgaccaaagagttgaccatcaaaactccgaaaaccttacaaagcaggattgacggcgatcctagtaccaaaacgccattgacgctgaaggtgattagcgatcatattcaggtcctggcaccgaatgttgggtagatttgggctaccgtgttacacttggtctaatgaaacgaaaggggtgaatcgccatgcggttacgtcaggcgcaccatgaatgatgatctgctagcaccgatccgcggcgaccaagcccggatcaatgaaaggaatttatgactgaacaattatccaatgaaactcaatcagaaaatgttttaattaccggtatctcgcgtcagcagcccgacttcgattacaccatgaccgaactcggcgaacttgccaaagcggataactacaccgtcgtcggcgaagtccgccaaagtctcgatcgcgccgcagccgccacctattttggcagtggcaaagtcgatgagattcgcgaacttgctgacgtcaaaaacgcaacgactatcatcatcaacgatgaactgtcgccatcacaactccgtaatctcgaaaagcaaaccaaactgcacgtgattgatcgaacccagctgatcctagatatcttcgctgatcgtgcccgtagtaaggcagccaaaacccaagttgaaattgcccaactgcaatacgccttaccgcggctgcatcccagcgccaaccggcttgatcagcaggttggtggtggtgctggttttgccacacgtggttcaggggaaacgcaacttgaacttgatcgacgggttctcaacaagcggatcagtcatctgcgtcgcgaactcaaagacgcgagtgttggtgatcaggtccgccgcgcccggcgcgaaggtaatgacatccccgtcgttgcactagtcggttacaccaacgctggcaaaagcaccacgatgaatggcttactcaatctttttgccgaccgtccggaagacaaacaagtttttgaaaaagacatgctctttgccaccctggacaccagtgtccggcaactcaccttgccagacaatcgcaagttcctgctcagcgacacagtcggcttcgtctcaaaactgccacataatttgattgacagttttaaagccaccctcgctgaagcagccaacgccgatcttttgattcaagtcgtggactactccgacgaaaactatccggaaatgatggccatcactgaaaagacgttgaaagaagttggcatcgaaaatattccgatgattgaagcttacaacaaagccgatttgcgtgaaggcacccgctatcctgaagtcactggccaacgcatcgtgtattccgcccgcgacaaaaactcgttggaagccctgacccgtctgatcaaagccgacatcttcggccaagacgaagaacacacctacctgatcccatttgatcaaggtcaactcgtcagttatctgaatcaggaaactgtcgtcaaggccactgactaccgcgaagatggcacgctcattaccgctgtcgtcaacccagtacaaaaaggtaagttggcccgattcgctgtaaaagaagaagtttaacccccttgcacaaaagaagagcaccaacggcaatctgattgccgttggtgctcttttctttttgtctaggttgctccggttagacacaccactagctgtccggcaaagaaacgcctgtcagggtctttattccaaaacgccaaatttataaccattgtcacgataatactgaatgatccgcggcatcgttttaaccgtcagatccttaccaagggcatcatgcattaagacaactcgcacgttactggccggataaacattcagggaacgtagatggtattgcagcatcgcatcctcagtcttcggctcctgcgccggactaagtgcatcgccgactgccgcatcccaatcaatccaatcgagaccaagccgactaagcgcgacatctgcggcagccaagcccttccagctaaaatgaccacccggatatcgccaaatatgactgcaaaaatccgatcccaaaacctgttggacagcggcttgggcactcttcgcttcattctcgattactgccgtggctcccacccgactaggataaagcaaactataatcgtgcgtcatgctatgtaatccaattgcatgcccagcatcatattccgccttaagaaccagcgctgtctctggactaacctgcttgccaacgacgaaaaaagtcccatgaacgccagcctgactgagaatatccaaaaccttaggcgaattaaccgtattcggaccatcatcgaaggttaaaaataccaccttctctttaattggacttgtatacggtgcatccatctcttgtttgacttgggcaactggataagcatattgattggcctcagcaatatgattttggcccacctgtgccgctttcgactgcgcctcttccctagaagcctccgctgctgcccgtcgccgagatgacacagccgcaacatgccgctttgatgccttcctcgccgcgtgccgccgcgaagaagccacagccgcctcatgctcactcaccgacttcgcgtgcgtcttgcttgctgccatggccgctgcgtgtcggtctgcgtatagtttaactgaaaagatggcgattacgattaggaggatacttaggaaaatgagccaccagtgccagttacgaaacttcctcattctaaaacctcacccatttgtcaattcacttccggaaatgagtgtatcgaaattgggtgggagatgcaaaggagaagttcgacagatcaaattttttaagggtggtagcatcaagtggtatgtaatttcaaaaaattgacaattgccatttcatcaaacgatatccaacaatattgactaattttttataaggaaagaaaaagcttaaaggtcccgcaaaagaagatggagtatgcagtcccctccgttttaccaagacgtcaatttgctggttgacttttacaagaagtcgtctaacatttttaaaggttactatacttttcgttctttattgtatttggcgacttacatttgggttcggaaattttatgggggaaaatatgataaacgagtcacaaaagttcttaaactttctcaaaaaaaagcgaaaggctgtctcattcttatttgcagttacattattactttatctaccaatgctcacaaacttcagctattcgattgattccgaggccgttgtcgacaattctaaagacttactattttcatggctgacaattgaccgctttggactggtagcgctcaaaaaattctttttgttcggccttgaccttaatccatattttattaatacgctgacctacctcttaatggcatttagcgcagtcattcttctatacataatcgatcaactgattcaaacaactccatggattcctttgctcgcggtcaccttatacctcgtttcgccaatccacttcgagcaaaatagttttgtgttacaaagtgttgaagttatgattggttttaacttgatgtttgtcggaatgattgcgttaggtatgccaggaaataaggtttcacccaagcgtctcatttttggtatgctattccttactgcaagcttttcaatatatccttctattgtcattggcgcatcaacattggccatcattattcttcacttacacgaactaaacaaaccatttgcaaccttctccgtctattttagacatcttgttcggtacattgcactaatcttaagcagtttgctgacctatgtggcgctcgaccaaatcatcaaatattttgctcatgcaccaaagaatagctatattcaaacagcatggggacatatggatacttctctgctcatgcaaatcgcattggccaagtttaaacagttttttatttttccaaatcaaccttttgaactctcggttgtaacatatttggcagtagtaacattcgctcttgttttaataatgggattaatccgtaagcagattcgttggacaattttattggacattatcgctgagtacattttggttctcagcttattgatcctacttggcaacatgattggacctattcgttcactgacccctaccgtgccgttagtcatgattgtttatagcctgacagtcatgaccatgatgccaaacaaacgcctactcttggttgtcggcatgagcttctcaatttttgcgcttatgctgagcaagacaacttctgatctagaacaaagtttcatcatcagttatgaaaacgaagtaaagttctcagacaaaattgtcaccagcgttcaggaattaggcattaacaactttgatcagtatagattagtcattgttggagaaaagagattcaattctcctttaactgaaatgggagaaatgattggcaatactcattataactgggatcttgactcgccaacaggaagcaatcgccgcgtgaccaattttctttcatcacaaggttacaaatttgcaactgttagtcctaccgattatcgcaaagcgcaaagaataagtttgaaaatgaaaacattccctgccaagggtggtataaagattttgggtaaaatgatcgtcgtaaacttaaagaatacggatatagttaactgaaacagtgggttaaaaaactcataacagtctttttctcccaaggtctaacttgttgtgaaactttcaataagaaacaaacttattatattatttgaaacgtaagaatggccatgaagttctccttgtgaaagagacctcatggccatttctggtgcttcatttagaactaaaccagttcatactcataatgtctgagccatttacaggtctcctacatttaaacccagcatgacttgtgtgtatattttcggggggcgatcaaattagaatgatatcgatccataataatacgtagcaccaatagcaatcaagttattaatgattgcaaaaatagttaaggcgcagaaactgcatttaacaatctttttcagagatcgtctttcgtcaaagaagaaactaatctcactgtacataatggtaatagcatatatgagtacaaaatctataaaaaagaatattcgtgagcctgaagcgtatatagaaggtgagaatcccacggcaacgctagtcaataatccagagagaaacgccaccgagaggaaagttcctaacttaaggtcctcaaaggagtttatcagaactagtaaaataacaataagcatcaatacataggtgagaaaaggtatgtaactaacgaagtcaaagtaattgacagcatcaactcgttgttgcttagttacggccccgaaaagagccccaaattctggtgcatagatattgacgactggtgcaaaaacagtccttaatgcgataaagcttatgggaaaccatgaagccacatcaatcacgcgagaacgcttcttcgaagaaaacgcgacaataacaagcatcatagagaaaaagagaaagaagatgttattatcggtcaactccgaaaaggtatgattaaatcccattaccagtttatcaaaaggagtcatgcttgcaaaatcgagcattctaaatttggtctcaacaagtacccgctgcttatttcctggagctatcaatgctaaacctatgttggcaaagcaaatcgcatattgggttatcacaaatagaatacctgaaaaagaaattcgtcgttctatgagcatcatgactgaaaaatagctcaaaatacagaggtacattactccataggtctcaaagtttgttgcaaatactaatcctaaaagcataactatgccaattaaaaagctcatcttttcatgatgatatatcttgtaaagtgagatcaaagcaaaggttcctaacgctaatggccaaaaatagttaatgcttgtcgccatccaaccagcgccattcatcattgacaacggcacaaaaaataccaacgacatgatcaaatagttacgtttataattcgttaatttcattaaggaccatgtcagtaacatccacataagaatatcaatcatagcccatataattatatgcatattttgagagatcttcagcaaaactgcttctataagcactcgggatgtccaagtcgtaaatcgtaaatgtaaagtagcgaaaagtgttgttcgatccaaatagtgagaaaatgcaatagctgcatctcctgtatactctcgaataaacagatgttcaaaccctataaccaaaaaggtgatagctaaaaatttatatcgagaatcctcacgaaactttgcaagtatctgtttcatcatttcaaaccaccaatcttgtaaggaattccagtttttaccaatctagttttttgaccatcagcaattagaaagccgagttgatactctttgtgtggcatctcagtcatgtattttgcaggaatataaccgtcaaaaccactattttcgtagttgtatttgcctcgttcttttcgcatcttggcaacatcaacacgctccaccatcttcagaggaaaaacaaggcttttgtcgttcttatcgttatatagcaccaaacttgtcacatacttttgtggttcctcatttttcacataaatccagccagaaacttccgtataacctctattcttcaaaagtaacgattcaatactgaacttcacttgattttttgagagaaccgcgtaacgttccattgatgcagctttaggaaaggcgtagttttggtactgcataaatacgcatattccggcaataattactccacagcaaacaactaaccaagaaaatgcttttcttttcaatccgtcgctcatcttattcctcctgtataccattttaatcgttcagttattggtttataaagttactcgtttatttcaaacatcacttttaagtaaacttaggtagcaaaaatctgacagtcaataattatcagttatcactttacggttcctagactgatgattaaattaataattacaacttgctaagagaaatttacatccagattaccatcgtttaccactgtcaacaattataattcaaaagaaaaaaatctcccctcaaatcagcttcactgacaaaaaagaagggggagatatcatacttctttaaaaacaggaaacaatatcaatcaggattgcttagaaaacctgttgacattgaagccatcaaggctcatcgaatcgccaccgcaaacttcatataactataggcggtattaaacgccgatttgctgatccaataagtcccattttccggatcaacaacatgaacagattgattactataaccatcaacggtgacaacatgggcattgtcaatcccgcgaccccagttatattgatgccactgcggactctgataattcaaagtcacccaagcaacgactgggtttcctgaagcgacctggttaagaattccatctaagccactaccactgatgttagttgcaccgccgaagcgactgacccatggcgtgaaggcacttggaaagatggactgatagacccctgagacaaccgcgtaaggcatcccaccaaaaccttgataaggattaccgttggctgctatcggcattgtttgaaggaaactacggagattatagccagttgcatgtcccttatattgcaaggcttgtagcgcgctggctgcctcacaccccattggcgcaccggctgcttcctgactgatgaacgatacacccaagactttggttgtatcaggagtttgtcctgttaaactgctgccataccaggcaatcccttcgtaactccatcctcgaccctgcagcacagccgcttcatttgcattggtcgtataaagatgtgaaccgctcttcaaggaagggttatatagccgataaactggaacaccttgattaggatcagagtaaaatgcgaccccttcagccgtccatccgcgttgggtgctgagggtgtaatattcgctccagtttctcgtgtaaagatgatcatctagtgctggattatagagtcggtagatattgtcaccactgaccggcgcgtaccagctaatgccttcgtaatttccccagccacgagtgatcagctgatcacgttcggcggggttataagtaaagaaatgttcctgcgttctcggactataaaatcgataaattggcgttgatgcggccgctgataccggcaaccctggcatcaaaaataaaataaagcagattgctgcaaagacaatgccacccagacattttttcataatttgccctccagtgataattgttgttatttgttagtcgaactgacctcaacttgtatgcgattagcaagcgtgaagtaaaaacaactaaaatcattataacttgttttggtgtcgtcatgttagacaacttaaatactcatagaacaagttcgcgattttgaaatacttagctactgtattcgggcttgaaaattcaccaatcaaaaagcagcctctgaataagaagctgctcgctgttttgtgatgaacatttcttgatgattgcccaatcccctgtgccagtctagcaatcatcacacttatcatctgacaagatgtcgtctacttttcaatcacctgcaaaaattccttcaaagcatcctgccaagtctcaatcttgaaacctgtcgccttggtcttactcagatccaggattgaatgccgtggacgccatgccttttgcggatattctgccgaagagaccggctttaccgtcacatctttatcggcaagaatcgcactcgcaaattcataccagttacagctgttgtcattggataaatgataaatcccataggccaacttttgatccactgcgaaggtcatgaattcggctagatttttggtccatgatggtcgaccatattgatcatcaacaaccgtcagctccttatgcgtcttagcgagatccagcatggtataaacaaagttgtgaccatattcgccaaacacccatgaagtgcggataatataatacttcttgaggtatttctgaacctgctgttcgccttcatacttggcccgaccgtactcattacgcggtgccggttgatcatcaacggtgtaaatatcttttttgtcgccatcaaaaacataatccgtgctgatataaactaaagtggcgtcaatggccgctgccgccttggccaaaatacgggtgccgtcaacattgaccttctgattcaacgccttgccttcatcttcagccttgtagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggacttatatttttttagccacggaaatgttcgcgtaggtatgcttcgaatcattgtcagtcaggataggcagatcgcacgtttatctcccttgttaattttaccgcaatttcagggtcgaggttacgcgcagcaaatgctacgtgacattgaaatcttttatccgagtatcacgacatggcatctggatacaattgctgaagagaaaaagttggttcatctatacagaaaaatgggttatgttcaggacaccaccaagataacggccataaaacccgggatgaccatcatttatttctataaaaccattagtaagtgaatatttttctggatttgaagtgtttggacaaaaatttcagcccccgcttaaagcgatatttttaatagccaaccgttcccgaaacactattattttaattaagtcgttttcatcttccgtgcattgccacgtttaaccttgtataatacgattatcgctaaacaagggaaggtcgacacttgaaaatttccattaagaaagtaccggcactgtatgacctcttatatggtgcctttgccttggtaatgctagttgctgccatcatggcgacattgccaaacggcttctcattgacgggtgttggatcaacactgatgcagtgggccaatcatttgtggtggctgacgttgcctgggatcgtcttacatttgctgtcgtattttgcgagtcagaatcaacggctgcttttaataggcaatctgataggcttgtgtgcctttattgccttcattctgattccgaactacagtgtctttgcagtcattggtttggctgttgccatgttcttaattttgtcaggcgccaaacgatctcgtcgtgtccataataattcggaggtgtcgtgatggcctggttaaagcataaaaaagaagaaccgcctgagattggcatcggcgatcatgattttagtcaattcgtgcaggatgctcgccgtgatccgcaacggtttaaggccgtacagtcagttttcagccgcctgaagcgcaagccgcgaaaagatgattcgcggcgacctaagcgacattaaatctggtttggggtggtaatacctattacaaaagtgttggttcagccttgatttgttaaagactgccaacactttttttggtcaataagccgtcaagggattcgatgagatgatatagaaattgtatttaagcaaccatcacattttcgcaaggtatcaataagagaagtgaacgatgtccctcgtggataagttgtcttcttacataccagtgacatacgcattaaataatattagtaataaaattaattattcagttagttcctttttgtttttaaaaatctcatgatatgcaatgctgatggataaagcactagcattgcagaatggctttaacccgcatcaagcttacatttcttacacttttgtcacgcgttaagaaagccgtaaaagccgttgaaagtgttgaatctaggtcacgattttggcatactatttttatcgagaaggagtgaaacaaatatgaaaaaagcattcggcgttgtgttcttattggtcgtcattgtcttgggctttttcggctatcagtattggaacagcacctataatggcgttgaatcctatgcaaaggtgacacaaggaaccaagcatgcgtccaaaaataatgatggctccccttataaagttaatggtaaacagtattactattatgattatgagttcacttgggtgacaaaggatggtcaaaaacgcgaagttggatatgagtctggcgaatctgcaaatccaactgaactacagcctggctcttatgtgaaagcaactgtttccgagaaacgggttatcaaaggcccagaagtcgtgaataaaaatgcgatccctgcctcagtgctttctaagcttgagtaaacgggaactggcaaaaaagaacgaagcaggctcattatgagctgactgcttcgttctttttattttttactaagcttgctccttgagtttgagcgaaccatcctcgacaagctttgtcagaatgcgatagagaagttcctcagagaaatcgcgagattccgacagtaggtaactgtaggtatcggctacaccaggatcaggtacttttgctaaccacgtctgcagtcgtgcattgaccttgtcgtcggtatagagttcagagacgagtgcatctgtctgttggctgattaatgcgcgcaatgccaagttttctgccatgttcagcttcctttctaacttgataccattatacccggcaaagatttttaggcaaagctgtgctgcctctttgatttcgcgcgcagctaggctaagatgttaagcatgatgataccatggttagtaacccagccaacaattcaatctgcgcagcaattgctaggtatgcaactgagtctggctggctgcagtggtttgattgttgagactgaggcgtatttaggtgtagaggataaagccgcgcatgcgtttggcggtcgaaaaacaccgcgtaatcacagtctgtatttaccggcgggcaacgtttatgtttatcaaatgcgccagtactgcttattgaatattgtgacgcgaactgcggaggtgccggagtgtatcttgattcgggcactggagccgcaagctggtatggcgaaaatgcagcaacgtcggcaccaagaaggcgttgggttgaccaatggcccgggcaagctttgtcaggcattggcaattgaccgtgcgcttgacggcagtcgattaaacgctggcggcttgcagctgacggcgacaacatttcagccgcgtcacatcacgataggaccgcgcattggcattccaaacaaagaaccttggacaagcgcacctttgcgtttttccgttcaggggaatccgtttgtatcaggcacagctcggcgagatcaggatttaaaaacgagaggatggcaatcatgagccaaatcaatatgttagatgcaattggtgacaaaatggatgcgctggatttcgatggtgatttaagtctaaactgggataaagatgcccatgtgattgaacttgaaatcacgatgacagtacaaagcgagtctggtatcgaggttgaagatcaatctggtgagaccgttgacaatgggccagttgaatatcaagatgccattttattttatgatgaaacccggctgcacggtgaagactatgcagatgattatttagctgttttcgggtttaatggtaagaagggcattgataaagccacagtggatgctttgtttatctatctgcaggattttttagacgatagcgaaagtgacctcatggattttgtcgacggcacgtctgacgatgatactttcgtcttgaattttgacgatgcggcatttgaacggattctggcggaacagccggaggaggataaccgcgtctttttaccctatcccaagtactagtcagcctgccaaagaagaaagaatattggctgcaaggaccggtcggctgacttttcaagccggtatctggacagtagcagtttttgcatcaaagaacacgtttaaaggaggcaaccatgaatgattggacagcgttaacggtcacaaccaccactgaagccattgaggcggtcagcaatattttaatggaggcaggggcggttgggattcaaatcaaagacgccgctgatttcaaaaaagaaaccgtggatgctcacggtacctggtttgacccgaaaacggtgccgcatttggcctccggagcacaagtgattgggtattttgatccagcaacatcacttgttgaacaacgcgatcatattgcaacgcgggtccgcgggcttgctcaattcggcctggatcccggtgctgcaaccgtcaccttggcagatgtcaggcaggcggattgggcaaatgtctggaaacagtattaccatcccttacgcgtttcgcgatttttgaccatcgtacccaagtgggagcattatacgccgcaacaagcaggcgaattgcagttgacacttgatcccggtatggcctttggcaccggcacacacccgacgacccagctgatgctttcgttattggagtccgtgatccgcggtggtgaaaccatgattgatgtcggcactggctcaggtattttagcgattgcggctgaacggcttggtgtcggtgacattttggcgaccgatgtggacgaaattgccgttagaaatgctgaggctaatatcaagctaaatcctgttagccacattactgtcatcgcgaatgacttgttgaagggcattaccttgtcagccgatttgattgttgccaacattttggccgaagtgctggtgccgctgattccgcaagtgcgaccacgattaaaagctcatgggcacttcttgcttgctggcattattgccaacaaggcgacgttaattattcggactttagaagataatggcttttcaattgctcagcggcgcgaagccggtggttgggtcgcattagacgcagtgattaaagaaacagcgtgaggtggcacggttagcaatcaaagcaatgagcgttcttagccgaaatggccgtgctttgacgattctgaccaaggttctaatgtgcagctttttgcgctagtgcttgcgattcgtttatgaggaggacatcagatgcagcggtattttaccgatcaaaaacttaaaaccggtgacgttgttcagttagatgcgaccattgccaaacatgcgatcaaagtgctgcgtcaggatattggtgatcggttcgaactcgttgaccccatgcaccacgcatatttggcaatcattcagcagtcgtcgccgctacaggtcgcgattgatgaagacataactaaaaaagttgaactgccactggctgtggaagttgtctgtggtgtcagcaaaggggacaaatcagaatggatcgttcaaaaagctactgagctgggtgccgacaaaatcggttttttcaatgcccagtggggaacggcacggtggccggcggaacgggttgttaaaaaaatcgcccgtttacaggaaattgctaaaaatgctgccgaacaaagtcatcgaaaccaggttccagatgtgacgatgtatgctaagctaaatcaggtagggcagactgccgaggcgaaattggtcgcttatgaggaaagtgccaaacaaggtgagcatggtgccttaatctcggcgctatcgcctcggcctgcttcgttgtgtgtggtttttggtccagaaggcggccttgcaccagaagaattatcagttttaacggggcaggggtttattgctgcaggattagggccgcgcattttacgtgcagaaactgcaccgctttacttgcttagtgccgtgtcggttttaacagaattacaagcaacatctatataagtgtcattaaaggagaacattttcatatgagtcgtattctcaattgggtcaaagtgccccgcaacagtgttattagttggagcattctgatcaccttgattttaccgtggctatttccgttatttcatatcagcacagcgattcgtgtcggtgttttgtttattctcatcgatatgttcagtgcttggtggattggtaagatgattcatcggcatcatttggcttggtggtggttattcgttctgccagttttatttgccgccatggtttttttgcgttatcaatggtatggctatttctttgtgccggtctatattttgctcagtctgctcgcaatggcaaaggactagcatttttacatagaatcgttataatttaagggtaatctaagaaaagtgaaccgtcacgcacactgctttttgaaaacggtgtgttgagataaaagcgcgcactgacgcgaaacagcaagcgtagcgaagcggcgataagcgtgttgcctaagattcttttggcaggtgcttatcgcccttctcataatatcagcgtgcgcgtgcctgtgaaggcgtggaattcaggagggaatagaatggccgaagaagttgaactcacccaaccggatgtcatgaagttgtgtaaagcttacatgaaccctgaacacttggcattcgtcgaaaaggcctacaagtttgccgcatatgttcataaggatcaggttcgcaaatctggcgagccgtacattatccatcccattcaggtggcagggattctcgctgaattaaaaatggatccagcaacagtcgcatctggctatttgcatgatgtcgtcgaagataccaatattactttgggcgatattgaagaagtgtttggtcatgatgttgccgtcattgtggatggcgtcaccaagttaagcaaagtgacctatgttgcccataaagatgagctggcagaaaaccatcgaaaaatgttgctggcaatggccaaggatctacgggtcattatggtgaagctggctgatcggctgcacaatatgcggacgctgcaacatttgcggcctgataagcaacgacgaattgccaacgaaacattggagatttacgcacccttggctgatcgtttagggatcagtaccatcaaatgggaactcgaagatctatcgttgcgatatctcaatccgcaacagtactatcgcattgcccacttgatgaatagtaagcggactgaacgtgaagcttatattcaggaagccatcgatgaaatcgaaaaggccttggctgatttacacatcaaatatgagatttacggtcggccaaagcacatctattcaatttacaaaaaaatgcgcgacaagcataagcagttcgatgaactctatgatttgttggccattcgggtgattaccgagacgatcaaagactgttatgcggttcttggcgccattcatactaagtggaagccgatgcctgggcgattcaaggattatattgcgatgcccaaggcaaacttgtatcaaagtattcataccacggtgattggaccgatgggtaagccgcttgaagttcagattcgcaccgaagaaatgcaccatgtggctgaatatggtgttgcggcacattgggcttataaagaaggccagaccagcaaggttgagtacgataagaccggtaagaaactcgacattttccgtgaaattctggagcttcaagatgaaaccagcgatgctgccgattttatggaaagtgtcaaaggcgatatcttcacggatcgggtttacgttttcacgcctaaaggtgacgtctatgagctgcctaaggggagtaatccgttagattttggctaccttgtgcacacagaggttggtaatcacacggtcggcgctaaggtcaatggcaaaatcgtaccgctgaattatgttttgaaaaacggcgacattgtcgagatgttaacggctagtggcagtgcgccaagccgcgactggatcaagctggtcttcacttcacgggctcgcaataaaatcaagcgctattttaaacaggctgataaaagcgagaatgctgaaaaaggccgtgatatgctggaacgtgaacttttggacgaaggttacgtgccaaaagatttcttgaccaaggaaaatatgacaggcttgatgcagcgcctcaattttcaaacggttgatgaattgatgagttcaattggttacggcgaatataccccgaaagtcatcgccaatcgtttgacggagaaattccggcatgacaaggctgaaaaagaccggaaggctaaagaagccgaaattctgtccaagaatcaaaaggttacgacggtttcaagcgacaaacatcagcagccacaaacccattctgaagatggcgttgtcatcgaaggcgtggataacctgttggtgcatcttgcgaagtgttgcatgcctgtccctggtgacgcgatcgttggctatgtcacaaagggtcgcggggtcaccgtgcatcgcgccgattgcccgaatgtgcaaagttccggtgaaatggccggccggttgattgatgtccgctgggagaatgaagaagcccaaaagcagctttttgatactgacttggaaatctacggttataatcgcagcggtttactgagtgatgtgttgcaggttctaaatgcccagaccaaggcgttaaacaacattaacggccgggttaaccatgacaaaatggctgacattcacgtgacagtgggggtacgcaatcttgctcatttggataaattgatggatgcagtcaaaaatgtgccggatatttatgaagtaaagcgcgccaatggctgattttagggctggttgacgataaaaatgctgtttgctcaagacaggtggtcagaaatctgctaccgtattgagtaagcagctttttttgatcatgctaagcaaataaaggggattgaattcatgcgcgcagtggtacaacgaagtcttgaagcaaaagtgacaattgaaggcaatacagtcggcacaattgaccacgggtttgtggttttactcggtgtcggaccaactgatacggatgccgacagtgattatttggccgaaaaaattagcaagctacgggtgttcagtgatccagtcggcaaaatgaacttggctttagctgatgtaggtggccaagtgctatcgatttcgcagttcacgttgtatgctgacactcaccgcggcaatcggccgagttttactggagctgctgatccggcattaggtgatcgtttgtatcaagccttcaatgccaaactcaaagctttaggtgtgcctgttgcaactggtgagttcggtggcgatatgcaggtgagcctgacaaatgacgggccagttacgattttatttgatacggaggcgaaatgatgctagtcaatgccatctgggattttgacgggaccttgtatgattcctacccggggatgatgaaagcgttaggtgctttggtgacagacaacggtggtcactttgatttagccgctttgtatcgaacaaccaaagagacttcaatcaaacaatttttgacgacatttggggcacagatcggccgcagtgtgaccgatttggaggctgattaccaccatcgggctgcggcttatttgcaggatatcaaaccttacccgactgccttagctgttttgcgagcgatcaagtcgcaaggcgggaataatcttttgttgacgcaccgcgaccacagtgcttggaaaatattggccaaggatcatgctgctgatttgtttttgggtggcgtggatgccgatttagatttgccacgcaagccggcaccagattcaattcagtatctgctcaaacgatttcagctaaatccggctgtcacagcgatgattggtgatcgctcattggatgttgacgctggcattaacgctggcgtcaaaacgatctactttaacgttgacggcttgaacgccgcaccgcaagctgattttcaggtggatcatctggaagagatcccgccattattccgcgtttaaaagttattatcgactctaaaaaaggtcctgcattgaagttgtaaactcaatgtcaggaccttttttagttcatcactgatgattgcctgccttaaagtaggcgtttaggccatttacaatatcggtagcaatcttggactgatagctcggatctttgatttgacggaaatctttatcgttgttgatgtaacccatctcgttcagaatagcaggttgtttattatcacgcaggacttcgaaattaccaaaggcgacaccgcggttttccagcggaaggccgctgaaagcactgttgacggacttggccaaggcaaggtcttttttgctgtcgtagtaataggtggtgatcccagatgctgaattcttggatggactggagtcaaaatggaaagagatgaaagcatccgcgtgagcattgttggcagtatttggtcgaggtgctaaatcaacgaaagtatccgttgtacgggtcataatgacattggcaccagccgcgcgtaaagcgttagcaactaaattggccgtcttaagcgtgtatgttttttcatagtcggtgccatcattggcaatcgcaccagtgtcggagccgccgtgacctgggtcaaggacaatcgtagcctctgacagttttgtagcggctttttgcgtttgcccgtcatttggtgcgctgacggtccagctcgcaacgtagccagttttgccatctggtgccgtgaccgcataccaatcatcttgttgcttagagaccgtcagttcggtgcctttgtctagcttttcaaccgaaggcgcattgataccggcggcattgcgaaggttggtcatcgtattggttgttaccttcaacgccggcgcacttttctcgtttgccaacgccgtttgcgcaggctgggctaaattggtggtttggccggttaactgaacgctgctgctggtgatccatgcagccgtggtgttgtacgcaatctgagtccaagcgccttcttgataaacgaccttgacgctgtcgccggcatttagcgaacctagttgttttgcattttgactggcatattcacggacgttaaccggttgattaaccgttgccactttggcctgtgaagttgctgcctcactttgatccaccaaccaagaggcaacccagccgattttattaccagctagtcggacttgataccaggagtttttcgcaccgataatcgacagttcattaccggatttcacttgtcccataattgaatatgccaaaccaggacctaaccgcacgttgacggtatctgccttgacagtcatgtattgtgtgttggccattacactggttgtggcaacaccaacgccgaaaagtagcgccaccagaacgaccagcggccatttttttaattgtccaattttcttcatgagcccaccattttctgaagatagttaatcctattatagcaaatcgcattagaaaaagtggcgtaatcacgtttaagttgcgttaagaactagacaacaagacaattcgcagtaacccttaccagtcggatcggacgcttatgccaaaagaaactgagtgattttttgccgaatcgcatcatgcttggccgggttgtattgatattgtggatcgtgccaatgatccggggtgtataaccaaacaggtttagcaagtcgctccgcggattccgttttgtatcgtggaaacacatgggcatgtaaaaaattatctgtattccctaaaatatcatagttcactcggaccgggtgacaagcggccaaaaccgcatcgcctaactgagccatgctttgtaagaataaagttcttgctggctcttcgagatgattgagatcggtaatattctgttttggaaggagcacacagtaaccgggtaaaaattgaacatcaccaaataccgcaaatccgccgggtagctcagccatgaccattggattggtaccatcaatggctgcttggatacgattatcttgtcacataaagacacttccttgttttagtagagtgggcgcgaaattagtaatagcgtactgctgcggagccgaactggcaaagaattctaatctatacgtttcccagattattcagaatctaatgaatcacaagtccaataaggaattatgtctcattctttttcggtctaaagactgacgccaagtgcaacttatgattgatgttgccataagttattaattttaaactagtttcaggaggtgcatgtctcatgtcattatttttgaaaaacgttggtcaacgctttggggataaacaagcgttgactgggataaccgcgacacttgaagccaatggggtcattggtttgattggaccaaatggtgctggcaagtcgactttactgaaactcttagcaacattggcaaaaccatccagtggcacgattttattggatgatgttgacattgtcaggcaaccgcaaaaaatgcgtcaagttttaggctatctgccacagcaggtgccttatgatgcacatgtgaccgcattggcctatttacgctatattgcggcgcttaagggcattgctcatcgcgaggcggaccggcaaattgtccaaacgttaggactgctgcatttgaatcccagcaattcaaccttgctcggtgattactcaggtgggatgcgtcagcgtgttgggctgactgctagtcttttaggtgatccgcaagtggtgattgttgatgaacccactgttggcctagacccagttgaacgaattgctgtccgcaatttattgagcagtctcgcgcaaacccgaattgtcatcatttcgacccatattattgaagatgttgaggccattgccagtcagttattattgcttaccgatggacaattgcattttcaaggcacaccagcacaatttctcgacaaagcttcggggcacgtttgggaatacacactgccgcgcaatgcgtccttgccgacaagtgagcgaattagtggtatgcaagaaagaagcgatggtattcatattcgcatgattgcagacgaggcgccggtgacgaatgcggtcatggtagcgcctaacttagaagatgcgactctcgatttctttgaaagtcaggcggtgaggaaaggatgatgcgactcattgcggttgattatcgggaacgcacccaacaattctcatttcgtattttggcggtgatagcactttttgctgctgtcattcttgcaccgcggccaaagggcaattttcgggtattagtattggatccacagtattttgcgcaagccaataatcccacttggttaccaatcggtgttgcttgcgtgttgtcattgttctttccacttgtgagccttgtgatcgcgcgccaaggtattcatgctgatcgggaaaatggtgtccttacatatttgttgacgacaaaattacgacggttccgttatttggcgagtcaatttctggttagctgctgcctattgttcaccattttagtcttggtgatgcttggcagcgggctaatgctgttgatccaatatcctggtcaagggttgagcttgagtcaatttttgtcacctttttttagtctggtgcctgggatcttcttgattagcggcttaggggttttgagtgagacattgccgggactgcgaggacaactcggtaccaccgtgttagtgatagcacttctgacgttatatgccatgatgactaccatgacttggtacagccaactttttaacttttcgggtattgcgttcttgatggccatgatccgccagtccgccatttctgccggacatccgcttaacacggtgctgatgctgggcggcaatgatcatttgagtcggacgggcacacatcagctaatttttcagccgctggcgttaacacaaacagaatggttggcaatcggcgggacggtgttgatgagcatcgtgttggtgttactggctgccttttgtctggagcatcggccactacaccaaaaaacgaactcaggcaaatcaaaattaacggttgatttgccaaggccaaaagatgatcggtttcattcggcaaggacggccaattttcgctggcaacaattgcttggccaacaggcacatcgacttttccattctcagaacaagtggtggtggctagtggcgatcggtttatggcttcttgcttgggttgtgccagttggcagcttgcgcgggatgattttgccgattcagtatttgtgggccatgagtttcttcagtcaaattggttggcctgatgatttgaatggtttatcggcatgggaaggtaccgtgaaccatgcgactcgccgcgccatcaacagcactttatggctaagtgttaccttttcgttactacttttgctgccaaccttgctgcggcagggaatcgttgcgtggccgttacttggctgggccatcatgttaccggtggtgagtctcatgttgggtcagttgaccaaatccggccagtggagccaactgctggggactgtcattttgttcctagtcgtttgcggcctgactggaccactaccgctagcgacgagcctagttggtatggtgacaggtgccgtttatagtttgattgctgtgggctgctggattgtgatagaagtacgcgcagagtagcatgaagtattaaaaagtggtgatcgtcggcccggtacagatgattgttgactttgctcggttaaagcgtaataatccatggcaatcattcgacaaggaagggatatgaagcgtatggcagaaacattaggtagcatcttaaaacgagcacgcatggccctcatttgacccagcaagtagtagctgatgatatttgctcgcagcccatgctttcagctatagaaaatggccggtatacacctaatgcggacttactaattgcactttgtcaacggctcggcattgaccttaacagtttgcaattagcagataactacgctgtcgggacggcgacacagtttaatcagacagttgaaaaactatgtaatcagcatcagtacaccgatttgctcaaatttttgaaacaagatgatgtcatcagtgcgattcaatcagatacccagacgcaagcttattattactatttgagtgtcgcaacgtttcaagcatcagattcgccagacctagcgcaaattaagcaaatcctaaaactggcattagcgagcgcgcctgagagccagtcgatcttgacaagactcattcagatcacactagcgctggtttcggcattaggaagacacgctgatcaagctacaaaatggctggcaaaagcaaccgagcaaattgatcaaacaccttttgagccgaacgtgacagtgatttactatctctcggcattgacccagtttaaccttggacaagatgtcaaaagtgcagcatcagctgctcgtggccttgaggtagcagccgcacacgattcgcattatttgttcgctaatgtttactatttgttggccattttagcgcaccgaaatgatcaggctgacaaacaacagctagctgaacagcggtccgttactttttcggagctgtttaaggagcctgtctacaaaccggatcattaaatattagtattcttattttaaaggaaaggtagtcttgcctatcataaagtcattcaaacaaggagagtgactgatatgcaagacttttttacgaatgacttattgattcacgcgaatcagaatgcggtgatggcaattttggctaatcctcgaaaattgattgaatgggatccagaaattcaatcaatcagcgaagataagcatggtcatcgttttatcattttacgaacgaacagcgcgctgaaccctcgagagcaaatgaccattagcgttaaaaagaatactgtgatttatcacagcactggggggcgggtggcttatgatgtgattttttcactgattactgaagaaaacggcacagccgtgacagagcaagttttgcttgattcagcaagtgttaagggcttgccggtgaaattgttagcacccattgctaaacatgcttttatgatcaacctgacaaacttagcgacttttgttgagcgttgggctttgatggaagacggtgaggcaaaatgaaggtcattcaacaggttagttttgctggcattgatgcaatacgtgatgttgaaattcccgatcctaagctatcaccaatgacggcactcgttgaaacagcttatgtgccagtcttaccgtgggatgtgatgactgaaaaaggcgatttacagaacatgcggcccgttcagctgccgctagtgattggttacggtttttcgggggttgtctcaaaagtcggtgcattacgttcatcgaatttgattggacagcgggtgattggcgctaatcctgctggcgcaatgcaggaacggatagcctcaaatctgccacctctactgtttaaagtacccgacaacgttcggttgcgtgatgcagcaacacttataggtggtgctgacgcagctttgatggctgtcaatacgatgcaagtcagttcgggagacactgtgctagtgacaggagcttctggcggcgtagggacatatttgattcaacttttgaaaatggtcggtgcacatgttgaggcactggcttcaccaccaaactttgattttctgaaaaagctcggcgttgatgacctagttgattactcggctgatgtcactacgcagttagcaaatctgccacatgctaataaggtgatcgacacagtgggacgactcgatttactcgaggcaatcattgcggccacccggcattttgatctgctgtcgctttcaacaacgacatttcctgaacatacccaagatcagacatttcagtttgcaaatggctcaattgggttaaacgggtataaaaggttgcttaactggctcagcgatgggacacttcaggcgcacgtccagacaatcttacctgtcgagcagatcaaacaagcgcagcatcaactagttgaagaatattcccatggacgcattttgatcaaattttaaatcaaaaagtcacccttaaaggtataaacctgagagtgattttggtgaaatcagattaaccgtaccgtcgagtcaaaatattgctccataaaatgaatgcgcgcggcaatttcagctgccgagaaagtttcgttttcagtggtggcgacccacttttcttcgttatcatccgctcggtgaacaacagcaatcaacttgccttcaaacgattgcaagggttcattaatcaggtcggagacaatgtagacatcttgcttttcgccgtcgccaccggtaaccgtaggcacatagccgtaattaatcggataaggcgcatgcgacttgtctgaaaaaccgatggggcgatcaactttaacaaaaactgatttacttgccattgatataacgctccttgcctatgcttgaacatgactaacatcttttttcctcagtattatacaatatccacaagcaacagatttgttgaaaatgaaccgtgaaaatcttgccaaacgcgttgacaaaactttcagcaaaccgtatgctttaagcaataactaagacctgtgacgaagtaggatagatcactttaagcgacccggagatggtgaaagccgggaacgatcgaaaagacacttctgaggtgaacaagttccggaacgccaccgttatggcaaagaaaaaaacaaggtggtaccgtgtccgcacccttcgagcaatcgaggggtgtatttttttagagcgcaaaaggacgcgcttagaaaccggagtgtaagtggccttgagcagtagtgacaaaagtgcaggtcactactgctcaaggtccttacacgcaggtttctgcgtccttttgtgcgtttcggaaccagcacacttccccaactaaatcacagtgcttaaaccacaggaggcaatccatgaattatcaacgcccaaaaggcacagccgacatattaccaggccaaagcgaacgctggcagcaagttgaagccgtagctcgcaaaatttttgcacaataccagtatcatgaaatccgcacacccatttttgaaaatgtggatgtattctcgcgtagcgcgggggacactagtgatattgttactaaggaaatgtatacctttaaagacaaaggtgaccggatgatggctttacgccctgaagggactgctggcgtcgttcgtgcctatgtagaaaataaactgtatggtcctgaacatgctaagccttataaggtttactatttgggtccgatgtttcgatatgaacggcctcagagtggtcggcaacgccaatttcatcaaatcggggttgaggcatttggcagtgattcaccggtgttggatgccgagacgttggctttggcaaaacagttgctggaggccttaggcgccaagcatcttaaatttgtgatcaattcgttgggagatccagcaacccgcaaagccttccacgcagcgctggttgactatttaacacctttcaaagatcagctttctgaagactccaaggttcgtttggttaaaaacccgttgcggatccttgatagcaaagacaagcatgatcaggaaattgtggccaatgccccatctattttggattatttgacaccggaggcacagcaacattttgatcgggtgaaaaccttattgcagggattggggattccgtttgaagtggatgccacgatggtgcgcggcttggactattataatcacaccatttttgaagtcatgtccgatgataaggtgtttggtggcggctatacaacgattttagctggtggtcgatacaatggcttagtcgaagaactgggcggtccggagatacctgggatcggatttgccatgggtgttgagcgcctgatgttgctaatgcaaggcgaattgccaacggcgcagccagatgcgtacattgtgaccattgaccaaggtgccgatcaagaggccctgcaaatgctgaccgccattcgtcaacaaggcttcaccggcgagatggattatatgggacgcaaacctaaaggacagtttaaggctgccaacaaagcaaatgccaagcttgttttgacgattggtgaaagcgaacgcgctgcaggcactgttcaaatcaaaaatatggccacaggcgatcagcaagcattcccccaagctgatgtgctggccgactttggcaaaatctatacgcaagtaatggaggcaaaataaaatgagtaaacgaacctgttatgccggtgatgtgaccgccgagtatgttgatcaagaagtgacactaaaaggctgggtacaaaaacgtcgcagtctgggtagtttgattttcattgacttgcgtgaccgtgaaggcattgtgcaattagtcttctctgaagaatttgacaaggatgctttagctgtggcgaattcggtacgctctgagtacgtcatcgaagtgcaaggtgtggtaaaaaagcgtaagccgcaagctgtcaataaagatatgaaaaccggggacgtggaagttgaagttcataccatcacaattttgaacaaagctaaaacgccaccattttatattgaggacggggtggccgtcactgaggaaaccaagttaaaataccgataccttgatttgcgccggccggaaatgcagaagaatatttttacgcgcgcacatatcatgcgcagcgtgcatcattttttggacgacaacgggttcattgacgttgaaacaccgacattgaccgccagcacgccagaaggtgcccgggactatttggtgccgtcacgtgtttatcctggcagcttctacgcactaccccagtcaccgcaattgttcaaacagctgctgatgggtgctgggttcgatcggtattatcaaattgcgcgttgcttccgtgatgaagacttgcgtggtgatcgtcaaccagaatttacccagattgaccttgaaaccagctttctaactgctgaagagattcaggacatcacagaaggcttgattgccaaagtgatgcatgatgtgaaaggcattgatgtcaagttgccatttgaccgaattacttggcaagatgcgatggataaatacggttctgataagccggatctgcgctttgacatgcagattcaggatgtgtctgaactcgtcaaagattctgatttcaaagtctttgccggcgctgttcaaaatggcggccaagtgcgggctattgttttaccaggcggcgctgacaagtattctcggaaaatgattgatgcccagcaagactacatcaagcgttttggtgccaaaggtttggcttggctcaaagtcacgtcagacggtatcagcggcccgattgccaaattctttggcgatggtgctgatctcgtgaaagctgttggcgctaacgccggtgatctggtgttgtttgttgctgacaaggccaaggtggtcgcagatgcattaggctatttacggacccattttggccacgatctcggtttgattgacgaacaagcatttcgcttttgctgggtcgttgattggccgctgtttgaatatgatgaaggcatccagcgttgggtaccggcgcaccatccgttcacaatgccaaatgaagaagacgttcatttgcttgacactgatccgcatgccgcacatgctcaaagttacgacatcgtgctcaacggttacgaattaggtggcggttccattcgtattcataaccgcgagattcaggaaaaaatgctcaaggcgctcgggttcaccccagaacgagcccaaaagagttttggcttcttgctaaatgccttagactacgggttcccgccgcatggtggtctagctattggactcgatcggtttgtcatgctgctaacaggccgcgataacattcgcgatgtgattgctttcccgaagaacagcaaggctagtgaaccgatgaccagtgcgccatatcccgttgctgatgcacaattaaaagatctcggtatcgaagttcgggccgatgttgatcctgaaaaggaacatgaaggcgacgaaaaccttactgagtaaacgttactttaaaaaatgccagccacaattaagttgctgacaattaaaacacctcccgctataatgaagacagcgggaggtgttttaattgtcagatcaatttgaaaaggaaagcaaaaaggacttgaaaaagcgcttgtcaccagaggcttatgcggtgacacaggaagcagcgacagagcggccgtttactggcgagtacgacgacttttatcaagatggcatctatgtcgacattgttagtggtgaaccgttattctcatcgcaggacaagtacgatgccggctgcggctggccgtcattcaccaagccaatcagcaaactggctgagcaccgcgaccaaagttttggcatggaacgtgttgaagtgcgcagcccatctgccgagtcgcatttaggccacgtcttcacagacggtccagctgcaaaaggcgggttgcgctattgcatcaactcagctgcgttgcggtttattccagtggccgacttagaaaaagaaggttacggggattatcggcaactctttaagtctgttcattaaaatgttttaaaaagaccatggtagcaatacaggaccgcccttgttatacttgatgcgcgacttattacgggtgacagggagcggtttttgtatggaagagattgataagctgattagacgacaccaaaattggtcacggctatcagcggcttttttctatagtatttgtgtggcagtggcgctgaatatgttctgggaaccaggtggggtttttgccagcggggtcactggactagcgcagttattggcaacaatcgtgcgaaagtggtttaatttttcgattgcattgcctttcgtatcgttatcaacaacagatcttttttcaaccgggacgctgcttttcttcctgaacgtaccgttgtttgtgttagcatggaaagccattggccatcggttcacttttttcacgttcttggcggtcattttttcgaccattatgattcgggtgctcggtgtgctgacaccgcttactaaagacccgattgtctgcgggatcttcggagcggtcgttaacggtctcggaacggggttcgccttgcggaataatatttcaaccggtgggattgatatcctcggcattgttttgcgaaaacgcacaggccgaacggttgggacaatcaatatcatgttcaatattttgattatcttcttcgccggatttgtcaatgactggccgcatgcgctgtattctgctttggcgatctttatcaatggccgggtcatggattcgctttatacgcggcagcaacgacttcaagttatgattgtcacggcccggccgcgacaggtcgtgaatgagattcagaattcaatgcggcgtggcatcacaattgttcacgatgcagaaggtgcctttcatcacgaggaaaagacgattctgttcaccatcatttcgcgggcagaaatgtatgatttagaacaagccatgcgccacagtgatccttatgcattcgtctcgatcacggattcggtcaaaattctgggtcatttttatgagccgaaaacggattaagaccatcagatttagcccggagcgattccgggctttttcattggcaagccgtgcctatcggaatcgttcaacgtatccgacatcggcaggtcaccttgtcaaaatcaaaaacgatcaattaattaggagggaaacatgttaataggagctaacgtcagtatgaaagggtcaaaaatgttgcttggtgccgttgaagaagccgccagttatatggctaacacgcttcaattctatacgggggcaccgcaaaacacgcggcgcaaaccaactagcgaaatgatgattcctgaagggctagcagcgatgacggaagacggcattagtcatactgtgattcatgccccgtatatcgttaatctcggcaacaccaagaaaccggaaaactttacatttgcggtgcagttcatgcgagaagaagtcgctcgagcagatgctcttcatgcctataccatgccttttcatcccggtgcgcatgtcggcgctggtccggaagcagcgattcagcaaattatcaaagggcttaatgagatcattgatcctaatcaaaaagtgaccattgccttggaaacaatggctggcaaaggcacggagatcgggcgctcttttgatgaattagctgccattattgatggtgtgacacataacgaaaagcttcgggtaacctttgatacctgtcataccaatgatgctggctatgatatcaaaaacgactttgacggtgttctcaacgcgtttgatcacatcattggccttgatcgactcagtgtgattcatgtgaatgactcgaaaaatccgcagggcagtcataaagatcggcatgccaacattggctttggcacgatcgggtttgacgccttaaacaagatcgctcatcaccctgccttggccgaattacccaagatactcgaaaccccgtatgttggtcctgacaaaaaacatcaggtaccgccatacggggcagagatcaaatggctaaaaacaggggactttcagcccgatgagttacgccacttgatggtttaatgggtttcagtattatcaaattcatcaagacccatgtgttccaaaataagcgttgctgtttcttcaatcgatcggtgggcggtgttgatcaccatgcagccgatttttttgtacagatcttccgcaaacttgagttcttgattgacttgatcgcgtgctgaataagcggtgtcgggattcaagccataggcaatcattcgctggcgccggaattccatcaaaacagaggcatccgtggttaaaccaacaatcttcttcgggtcaactgaccagatctcttcaggaatatgggcgttaggtaccagcggcaagttggccactttaaggttgcgattagcgagaaacaatgacaatggtgttttactcgttcgcgaaacgccaagcaaaacgatatctgcctcgagaaagcctttcgggtctttgccgtcatcatacagcaccgcgaattccatagctgagatgcggtcaaaataccgttcattaagatcatgaacagcgccgggaacgtgatttggttcctcatgcgtaattgacttaatcccgcttaaaattggcgacatcacatcaatggcaatcacgccttgatctttggcataatgcgttgcaagttgagcaaagcctgatgtcacgaaggtcatgattgccaaggcattttccttcttggcctcatcaagcgcgctgtaaatcttttcttccgtatgaataaatgggaaccggacataatgtgcctcaaagttgggaaactgtgccgcgacagcttgcgccaaccgcaagccagtttcgccaaccgagtccgacatgatatataaatttaattcttgcgtcatactgccacctcattacttagataacgctatcatagcatatttaccaactaaacaggagcggttagccgacgaccaatggtgacaagcgtgtctagaccagttagctatttaaggtcgaccatttgctgatgctagggattttacgccaaaaacaactaaaaaacttaacagaacagggcaagtttattcaaaaatgtgaaatcgcttattgacgcgtggttgctagttttgtatactaataaacgaactattggctatgatatccgtcagtggttacacaagtgtcggagggagggatatcacatggctaagacagttgttaagaaaaacgaatctctcgatgacgctcttcggcgcttcaagcgtactgtatccaagtcgggtacactcgctgaataccgcaagcgtgagttctacgagaagcctagcgtacgccgcaagctgaagtcagaagctgcacgtaagcgtaagaagttttaattaaaggacttggtgaatagtggctttaatggatgagcttaacgctcagatgaaacaaagcatgttagccaaggacaaagtgacgttgagcgtcgtccggatgttgaagacggctttggtcaatgagaagattaaactcggccacgacctttctgaagaggaagaaaagagcgttcttgcgactgaacttaaacagcgcaaggaaagcgtttctgaatttacaaaaggcggtcgtgatgatctcgttcaacaaaccgaagctgaaatcaaggtcgtcgaacgttttttaccagcccagttaaacaaagcccaagtcggtgacatcgttgatgcaactatcaaggaagttggcgccaagggtaagcaagacttcggcaaagtgatgaagacgttgatgccaaaagtcaaaggccaagcagatggcagtcttgtcagcagcgtggtcaaagaaaaacttagttaacgacaaagccggtgcaatagccggcttttttatatgggttttgcgggtgaatggcgtgcgtggtgatcagataagagtgctgattttgctgacgaatgggtttccgttaaatatcgtctaactttggtcagacgattgcttcacgctttgcttggaaacgcgcgagcaggcgcagaaacctgcatataaggatcttgagactaaatgaccaaagaccggtcatttagtctcaaggccacttatgctccggtttctaaccgcgcctgctcgcgctcttaaaatatgctaaactgagagcatcattgcttaataaatttgttagggggccaatatttggcacaagaaacctcggagaaaattttccgtcttagtaatcctgacatggcgattaaccttgtcgggatcaatgacgctaatttgacattgattgaagaaggattgaatgtgcagatctcgccttttggggatgagttgcggattcatggtgatactgaagcggtcagcttgacattacagttacttgaggcggctagtaagttattagctcaaggcattaaattgtcaccgcaggacatcgctagcgccgttgcgatggccaagcgtgggacgcttgagtattttgctgatatgtacagtgaaaccttgttgcgcgatgccaaaggtcagccaattcgggtcaaaaactttgggcagcgccagtacgttgatgccattaagcataacgatatcacgtttggcattgggccagcaggcactgggaagacattcttggccgttgtcatggctgtcgccgcgatgaaggcaggccaagttgagcggatcattttgactagaccggcagttgaagccggtgagagtctgggtttcttgccaggcgacctcaaggaaaaagttgatccctatttgcgtccggtatatgacgccctttacgctgttttggggaaagaacacacagatcggctcatggatcgcggtgtgattgaaattgccccgttagcttatatgcgtggccgaacgttggataatgcgtttgccatccttgatgaggcgcaaaataccacccaagcacaaatgaaaatgttcctgacccgcttaggttttggctcaaagatgatcgtcaatggggacatcactcaaattgatttgccgaacaacgccaaaagcggactgcttcaggccgagcaattactcaaaggtatcagtcacattgcctttacccaattttcggcacaggacgttgtgcggcatccggttgttgcaaagattattgaggcttatggtcgacacgacctgctgttgcagaagaagacgaaggagtaagggatggacttagaattattcgatgacgatcaactgctggatgacaagcaccatgatctcatcaaaaaactagtcgctttttgcggcaaacagcttaagttgcctgaaaatacagaaatgtcgatcaccttggttggggatgatgagattgagcgcatcaatcgcgagtatcgtgaaaccgaccgggtcacggatgttatcagttttgcgattgaagagggcgaagacgatttgccgctgctacctggcatggcaaagaacatcggtgatcttttcattgatccactgaccgttcgccgccatgccgaggattatgggcacagctttgagcgcgagctgggttacaccgtcgtccacggtttcttgcatcttaatggctacgaccacattaagccagaagatgaagccgtcatgatcccgcttcaaaagaaaatcctcgcagcttatggccttaccagataaacaagttggcaagaataaacatttcatccaaagtgcccgtcacgcgctcgatgggctgaaggtgttttttgtcgacgaaaataattttaagcgcgaatttctgagtgcaactctggtcattgttgccggcgttgtcttacaagtttccgctttttcatggttcgtgttagttctggcaatcttgttggtgtttcttggcgagttgttgaacacgatcgttgaaaatgttgttgattttattgttggcgatcaatatgacgcgcgcgcgaagaagattaaggacatgagtgccggcgcggtgctcatcgtgtcgttgattgccgtcgtcgccggtatttatgtctttgggccaccacttttggccctttttaggagttggtaagttgtcagttttgcgtacagctgctttagcggctcgagaaaatgcctatgttccgtattctcattttgctgtcggcgcggctgtccgtgtcggtgatcgcattttttcaggggcaaatgtcgaaaatgctagttacggtcttagtaactgtgctgaacgcagtgctatttttgcggcagtcagcgcgggctattcgaagctggatgaattgctggtgattgcagataccaagggaccagtggccccttgtggcgcttgccgccaagtcattagcgaattctttggccctaatgctgtcatcacgcttgccaacgttgccggacagtcagttcaaacgacgccacaggctttactgccaggtgcgttttcgaaaggagatcttaacgcttgagtgaacatcattctggttttgttgcgattatcggtcggcccaacgtcggcaagtcaacgtttatgaaccgtattttaggtgaaaaaatcgccattatgtcgccaaaggctcagacgacccgtaacaaaataaacggtatctacacgactcctgacgcgcagatcgtatttgtcgacacaccaggtattcataagccgaaaaatgagctggatacctatatggataaagcggcattgtcaactttgaatcaagttgatgccatcttgttcatggtcgaagcggatgaggaaaaaggccctggtgatggctatatcatgcgccaactggcggaagtgaaaaagccggtttatttgatcattaataaaattgatctagtaaaacctgacgatttattgccgttgattgaaagctaccagcatgactatgcgtttgcccaagtttttccgattagtgcaacgatgggaaacaatgtcgacgagctattgacggcattgaccgatgcattgccagtcggtccgcaatactaccccgaagatcagctcaccgatcatcctgagtattttgttgtcggtgaacttatccgcgaaaaaattctcgaattaactcgcgatgaagtgccgcacgctgttgccgttcaagttgagcgcatgaaagatcgggaaggcggtaaattgcagatcgaggcgtatattatcgttgaacgcgatagtcaaaaaggcatcattattggccgcggtgggcagatgcttaagcagatcggcattcgcgcccgacgtgacatcgaaaacctgttgggcgacaaggtgaacctgaagttatgggttcgcgtccagaaaaattggcgtgataataatgcttatctgaagtcgttagggtacaacacgaaggatcttcgataatggttaggcagactgaaacatttgagggactggttatgtcccgccagaactatcgcgaatctgatatgcttgtcaaaattttgaccgatcgattcggcaaaaaaatgtttcttttgaaccgggcccgtaagcccggttttactttaggtgctggtattttaccgtttactcacgctgattatattggtgaagttcgtgaatccggtctatcttatttgtctgccatcaaaaatgcgactcaatatcggcaaatttctgatgacatcaccttaaatgcttatgcagcctatatttttggattaatcgatcttgcttttccagatgggcggccagtcggattctggtttaaccaaatcaaacaagccttgtatctcattgattctggcctcgatccacagattatcgccaacgtgattgaagtccagatgcttaaagaatatggcgttgagcctaactggcgcggttgtgtgattgacggtcgcgccgatttgccgcttgatttttccgaaagttatggcggtttgctgtgccaaaatcactgggataaagatccgcatcgacttcatgctagtccgcgggcgattttttacctgcgacgctttagcacgcttgatctcaacaaagtggagcgcatcaacgtcaaacctgataccaaagcagaattacgacgaattttggatgttatctacactgatatggtcggtgtgaccccgaaagccaaacgttttttggatcagatgcatcaatggcaggatcgcctgcctgatgactcggaatgatggctgatatcagtggcataattatttactatcaacatatttttgactggataactctccgaaacaaacactgaattaatttaattatcgtaatatgtcgcttttagatggaataacgatacttatttattccatatttcttaatttcttatagaaactattaactatcttcgccggctatggtatattcaactcgtaaacagttgactagatcatagcattttttggtttgttgagaggagcgggcgtcatggcaagaaccttaccgaaagctgtgaaagtatgggtagcagcgaatttattggcaattgaatttgataatgggcaaacacggtatatgcgatcacattttattgatcaatatatctctgcttggtcattaccaaaaggcaagaaaagacgtagactattgatagttgacccaacatgggcttggtttggtgccaatccagtcattgccgctgatggtagcttgacaatctttgaaaccgatcggtacacgccagaagaactttggggcaatagcaagtcgcagatttatgaagtttctggggtgcattaattagcaatcttctgataaaggaagccaacgggaattggcttccttttttggacaaagacaaatgcacgatcacttgttggtctacggtggtatactatcatgtagtaagcgtttttttaatgcaataaatggtcgttgggttttgcattacgtaaagaagggtgcgttatgtcagaaataacaccaaaagccgtcaaagtctggctggccgccaatatattggccattgagtttgataacggccagactcgttatatgcgttcacatttcatcaaagactacctggatgcttggtccccgacgcgaggcaaaggcaagcgcgtcaatttgataattgccccaacatgggaatggtttggggcaaatccgcaaattgccgaagacggcaccttgacactcttcgacaaggacacctatacacctgaagaattgtggaagaatagcaaggagcggatcgatgaagtttctggcacttaaggaacttttgtaaatgattgtttgttggtttaaccaatagcccacgattatcagtatttcaatctgaaaatagaaagcagagagttggcggagcggcgatgggctcagtcgtgcccaccactctagctgcgcggtcgccaccccgaatcgccgcggagctaactcggagtatcggggactgcccaccgagaatagaacgagaaatggcaatgtctgcagttgcttcaaaaacgtgttcgcaggcgcagctcgcctgctcacactctgcttgacaggttttttcgcgatgcaatactaataaggaaattgaatcggtgatgagaaaaagggtcgcaacgaaaccttttgaagcgagtcggggaaagtgtaagcctgataacggttgttgtgattggcgttttcgaaccaaatgatgaagccgcaggtagttttttctatctgaagtagggtggaaccgcgcatctagttatttatctatgttttcattgttgaatttactggcttagggtcctgaggggtgtttcaaatagtcgaaaaagtagcttgtttcatggctgttttcaacattttatttagcatctagataacatgagatcacatataatttgggaaaataaaataacaccagcaggcatgctagccttacctaatgtggtagggctatttttgtgccatggataattgccagaaagaaattgctggtggtcaatagtgagagctatactgttgttgatctatttattcatcaaatcttatggagggtacaaatgttaaagaaaatggtaatcttcggtttgcttgcgcttactatggcgggatgtgggtcaccatccgcgactgacaagcccgagtcaactagctccgttgagattgctagcaagtactatcatcagctagataaaaaggagcagtcaatggtgttctttacttttaaagctgttgcagatgactcccaagacggcggaaagtacatcgttgatatgaaggtcagaaatggcactaaaagccagctcaagtttgaccttagtaagtttattttaagcacaaataatactgggacacccatcaaatcagtgaagcatggtgatcttactattgcaccaatgcgaacgaagacagttacagggttgtttgattcagcgactgcggccaactttaatggtgttggcgagttttgctacttaagccgagatttcttattggcttatagctatggggcggataagactgctggtgctacaacagataaccttaaggtggcctcactgatcgtccaaaacaaggctacaactcagaaaccatctgaatctgccgtcaacacacaaagtcaagctgctacaagtgcacccgacagcgaaactagtcaacagacaagccaagcttccacacaaccgactactcagcaatctcaggcaagcagtgaatcagtgcgcattgttaatagtgctgagcaagccatgcaaatagccgcaccttttctcaacacaacagttaacgctcttagggcaacacctgtagacgatggatggcaggttggacccaaaatgacatatgcagatgtaattgtccattacaatggccgggtattttcaccagcgaaccctgcaacgggccaaccggatcactggttaaactgagattagtaaaaaggtcgcatctttttgggagttcttaataatgagagaacgtaacaggcaggtaccacagcgtaaatctagaaacaagtttttattcattattggtatagctgtaattatggggttgctttgggtaaaaagtgctggagacaatccatcatatgttgtccctggcaagatatttgaagttcaatctgctggtggagttggaactgcaaatcacatgtctattggctacatagcatttggctcgcggcaagacaattttgggtgtctttatatacttgcatctaggaaagacgaagaaaaaatgaatgatagcggggaactgtctgaaaagctgcatgtagcaggagtctggacaaatcgtgataatggtagcattatagaatgcccctatggattgcaactagcgcaagctatggatgatccggatgcgttttatccagagctttcaatgtccgtatacaaagtatctgggatattcaagaaaacactagaagtcaagcgtaagttcacttcgtttcttcaacctgataaggaatcatcagacaatgtgaaactcgtagaagtcggaacaatcaaagaaaacaaaaaataaaactttaaaaaacagtatcttcatccattaggcaacacttccttttgtgccttgctactaatctaacaaccagctacctaagtgctgcacacgtcctatttgtttctcatttgccatctaaggcgttctcctagttgcctggtgtgatggtgtgattgtgcctgattgggtaaagatacgtcaggtgcttctaaagtgtgtctcacagcagctaagtagaattaaaggagctttaaaaggggtgcatcatgtgaccatggtgtgcttattcatttccatttgttattagtcaattcattgctgtacccatagaagactcatattggctctctaagctattttatcatctcgggcgtgtgtaatcatacccattcgtccataaggcgttatatggtattacatgagcatcataagattgtccacctgttccacctgattgggaagtgggcaccattgtgatttgaaccagacactataggatacccatagaaggcttacattggctctctaagacaagttggcatcgatgcattttgtgcatcatgcatctaaaacggaatagacggggcataatttgtgttttaaagaggagacagtaaagggcacaatgctcaaatgttcaaaagtcgtggtcaatcttctaacccttatttccgttttgaaattgctataaactgctataaacatgggtacacacttgtaaaaactgatgaatagagtaagcacgtgtaacccttttccattttgaaggacccataatcctggtagacactttttcaatgggtctacactttctggtgttgagaaataatcaacactgaccgtgtaggccctttttggataacgcaaaaagacaccctatctgagatcgttcaattaaggttataatggccatgggacctgtccttctctctagatggtatgttatgcaaacaccattttagcaagaacggacaggtcttttttcacattttctgggtggtaactttaattatgcaatctaggattccgactgtttatattgccggaccgttgttttccaaacttgcgcatcgctttgtgccagatgcttttgaaaggcgcggtaatttgaaagcattggggccgcaaaaaacctttaaattggaggaaacaccaagttttggcatctccgttctcacatcacttttcccagtgattttgatggcgattgccacggtttatgaattggtatttcatggtggcaaacttccaaagacaccaaatggtcttgataacgttatcgcattcattggttcaccaagtatcgccatgctgatttcattgttgttcgctatgtgggcaatgggctatgcgcgcaagctgccagccaaagccattatgacaaccctcgaggacgctgtgaaatcaattgcgatgttactactcgtcattggtggcggcggtgccttcaaacaagtcctgattgatggtggcgtcggcgactcagtaaaaaatttgttcgttggctcaggcatttcaccacttatcttgggttggctgattgcggttgtcttacgaattgcactgggatccgcgactgttgcggccatgacggcctctggactggttctgccactcatgcaaagtgctggcatccaaccagctttgatggtactggcaattggtgcgggttcattagctgccagtcacgttaatgacgccggtttctggatgtttcgtgagtactttgacttgaccattaaacagaccttgttgacgtggacattgttagaaaccattatttcagttgttggacttggtggggtgctgttgttgagtttggtggtttaagagtagctgaggaaacttaggacattcaatctaagcaaaatgatcttagagaggagcttatctttaagatcattttttctattcaaaaaacaaacggcatagtgatcgcttaaattttgtttaactaaggaactggatcgcttcatttacacaaaaatggttaaagaaaagggcaaatcatgataacatgatgacgtttatgtgaatttacttgggcttaggacaaggctagcacgtggtaaagcttgaaaatcgggcttgcgattgataccattgacgaagctagtttgtccttacatactatggaagcgaacggagtcaagatgaaaaaaatggaaatcagtaagtttgaacgatactttctttatatactgttctttgaattgtttgctgggggtggtggtcgtctgcttgcagttgggccactttcgattcggcaaattttatttgctggattgattattatatttgctatcagatttgtggtgagtccagatactaggcgtgagatttggcaatacttccgccaccccaatacggctgtgttttggttatcgttgctgatgacagcatggatattcgtatctagtttcattgggattatacatgggcatggagccggaccagttgcaactgatttcttccgggtcatttatgtcattttaattattccatttatttattatgttggagagcatcgtttttcagttaatgatttagttcggtgcttatttgtcgccgccggtgtcgtagcaatactgacagttttcattagtttgacgggcaagtttattgatgacgcaactttccacgacttttatgaatggattaatgttctcatgccaggcgatcttttcttcaggccttcacgaggggtcttctacaagtcagattttctggtcatgtttgctgttattatcggcttgattaaacttgctgagaaaaagatcagtttgggcgaaggtattgtcctaatattgggttcattatctatcattctatcggagactcgtggcctttatctgggaattttggtcgggatcggcacctacattgcagtgaaagtcgtcatctatttctggggtgatcgatattccttaaacttgaacagagcaatgaatatacgacgagcgcttgttttattggttactgtagctctatgcggctttttttacaccaatgcaacgattgcacgatttagtaagccttcaccctctgatatcagacaggaggatcgcctgaaaaagcaagatcgaaatatttctggcgacgacatcagtctgagctcacgatttgtcttattatcggatgcaatggacattgttaaaagcgaatctgcagttggagttgttgtaggtaatggctatggaacaacaattggcaataccaagattggtattgaaatgagctttgtggacattcttgttgaacaaggtgccatgggacttgttctttggctagcgtttgcacttttacccctttactatttcttcagaagtttccttttgagcagacaactggctgatatttacattggcctattgggtagttcgctatccatgattttggtaacgaacattaaccctttcttgaacagtcccattggattaggcttcttgttgccggtcattgtgattgcgtacaaagcatttataagcgccaagacgaaaaaccaacccgctattaaaattagttaaggcaaatacactattttaaggtacctgtagacttatcggagggaaagtatgaaccattctggtcattgctttttgattgttttgtacaaccagaagctgagtacaagcccggcctatcaaagcttaaagccacaattgctgaccggtgacaacctaattgtctatgataattcgccggtgtcaatgttggatgttaaggcggaaaattttgtttattttcatgatgtcactaacaccgggctggcaactgcgtataactttgcagttcaaaagtgtcgtgaaaccggtcatcaatggttaacaattttcgatcaagacacccgtattccaactggctttcaccacgacgttactgaggcaattacttcatcgaatgccatcaccgtgctggtaccacaggtcacattggaagatggtacaagcctatcaccgttttggattgaggatgctttgtttgtccattaccctgccaaggatcagaagacgttagcggcgatcaattctggtatgacgctcaatttagcgactttttcgactgatgaagagctttttgacgataggtaccctttggattttttggattatgttttttttaagcgacttcaagctgaaaataagcgtgtgtcacagctacccattacgttaattcagtccttgtcattgagtgacttccgtacgatgagtcaaaaacgctttgagagtttccaatttgccgaatcgagatttgtgactgagttttatcctcaactgattaatcagtaccatttacgcgtcatgctcaggctcgctaagcaactgttgaaaagagttcaatggcccaagctgaaagtgatgcttcaagtagtcggaggaaaaacatcatgatgatttcagtttgcatggcaacatacaatggagcccggtttgttggtgcccagctcaaatcaatccttgatcagcttgggtctaatgacgaggtgattgtggttgatgatcactcgactgatgagactgtcgctgtcatcgatcaatttaaagattcacgcattaagttgatcgaaaacacgactaatcacggcccaatttatggctttatgaccgcgttgaattatgctaaaggtgattatctttttttatctgaccaagatgatgtttggtttcccaacaaggttactcgcgtcatgacagcttttgagaaggaaaaggcagtcgttgttgtccatgacggtatcgtcactgatcagtcgcttagtcgggttgacgattcttggaatcatttcagtcatagagtaccgagtcagtccatgattaaaacactaatcaagaatggatacaccggtgctatgatggcctttagtcgcgaacttttgccactcgttcttccttttcccaagcaggtgccaatgcacgactggtggattgctttggtagccatgaaacaccacatgaagattgtcgttttgccagataaattgatgtattaccggcgtcatgccggtaatgtgacgggtagccatcgcaaactgcatgaaatgatggcgtttcgtttcaatatgttacgactttttattcgcgcttaatgattgatggctagtgcaaatcggaggatcacttatggtcaaagtttcaatcattattcctgcttacaatgctgctgccactctaaatcgcgctgttcagtctgtccttaaacaaaccttgaacgattttgaaatattaatcgtcaataatggatcgacggatcagacagcagcagttatgtcacaccttatccaagctgaccctcggatacacattctgcaaagtatgaaagggcgcagccgcgctcgtaatcaaggactgacaaaggctcaaggtacttttatccagtttctggacgcggatgacgaacttgctgtcaataagctggaagtgggcagcagttatttgacgaatcatccaaacagtagcgcatacatcacggcggctaaatatcaaaatgataagcgtggcgatgagagcattcgccagattccgctaacatccgcagcacctttattaagggcaaattatttgccaatgagtgcaccgcttgtgaggaaaagtgtgctcataaagccctttagagaagatcttgaatataatgaggactggttattttgggctgaaaacctgtacaaaaaagagatagctgttagctcgacagtcggcacaacgatccatattacgtctgctaatactatgactcagtttgatcgaatgcaaatgtacgagtgttatgtgcggggaattttaaaagaagaattttcggcacgcggccctcgctactgggcgcgggatatgcgctatgcactcaattatctacttagcgcgtcggatgcaacgagcgaggacctgaagctatctaagacaatggcttggccaatccggtttagccgtctgttattagctgtgccaccgttgcgagcggttattacaaaaaaacgtaatgccgtgaaagcgcgtagtcaatatggataaaatgcaagagcagttgaggtactgggaacactaatcggtggtggaaaatttggagggaaaaacttgataccaaaaattattcattatgtttggattggcggtgcgaagcccgattcggtgcaaaaaaacattgataattggaagaaagtattagcggggtatacacttcaagagtggaacgaacataattgggatatctcgaagaaccagttcgcgaagtatttctacgataaaaagcaatttgcattcgttggagatgccatccgagttgatgtgttaaaccgaattggtggaatctatttagatacagatgttgaagtttataagccttttgattctttgctaaaggaacaactagtttttggccgaatttacaataatgcgataggaacagctaccattttggctgaaaagaatactcgaatgatgaacgatttgtcgaatatgtataaagcatttgatttgacacaattagaggataataccatcgacaaagttaataatggcatttttacaagataccttcttgataaacatgtcggcttttcttttggcaataccaaacaacgattgaaaaatggcgcgctcatcttacccaagcaatattttgaagtgccagcaatgtggtttgaaaccggcacatttgccacgcatcacgtggcgggcagttggcaagataaaaagcaggagagtaacaacgagtcaaaagggcttaagtctggggtaaaaggcttaattcgttcagcttttccggttgctattgctcgatacgagaatcttaagggcggccaaagtaatagtatcgcaaaagaatttggacctaaagcgcctcagtgatgtaagcgccctaacctatacattaggaccgagtcttgcaaaaacactgctttggcagcacgaaacagctaattaaaaacctatctcgttgatatttgaggcttttacaattactggattctaaacgtatgatggtcgtgttaaactaacatcatcgaaagtttgacgaggctttatggggaaatagtcaaacggtgtgtgtgttcaagttactgaattctaactaggaggagttgtagaaaatgaaattgagtaaacatttcaagttaatcatgacgggggctttttctttggcctcagtcggcttgtttgcaccgattgtattggggcaagggcaacgagtctacgcaggtacgcccagcaccgttagtactgtggttaacggttctgatgaacaagactttcatctcaccaatcagcattcgaatcttgataccgataatcacgttctgggcggtggtcaggcgggacctgctttgcgcacaaagcgaagtattatgagcaatggtttacaagcgaatagcattcaaacatattcacaaactgttatgagtttcacaattggagattcacgagtgccgagagtcgataccgtcgatgtggcctcttatcaaaatgggatgacccaagctaattacaattccctcagagcttcgggagttaaagcggttattgtgaagtcttctgaaggatcaacttaccggaatccatatgcggcaaaacaacttgctcaagcgaaggctgctggactcaaaacggcagtatatcactacgttcattttgcaaatcaatctgatgccattgctgaagctaattactttgcgaacactttggacagtcttggtttcagcaaaaccagtccagtggttgctgatattgaggatagtgatgttggcggtgatgtcgcagccaatgtcaacgctttttggaacgtactgagtacccgtggttatgttaatcatattgtctatacagggctttattactcatattccaaagcagcaatttcaacagttggtaatgagcgtgcctgggtcgctcagtatccatatgttccaagtgtggacaatcttctgaataccggctatggtgcatggcaattttcatctatggcaggtattcccaactataatggtcgcgtggatgtctctattgattatcagggcatttttacgagtgagttttcttttgatcacattactgatagtcactcacttagcggtgtgaaacagattgatgagaccaatcgtgcagatggcatctattccgcaccatttaatacggttgccggagcgaccaccgaaaatcatgatggcgtcaactacaacggcgacatggtgcagttgattcaacaagcaacgacgaaaagaagcacgtatgttcaggtaaaggcgtcaaatggacagatcttttggattgatcaggctgcccttaaagatcccaaatcggatccgattttagccaaaaccactgaaaattattttgcatccattaatcagacaaatcgcgcggatggtatttattctggtgggccttacaggacaacaccttcagcatatgtggctaactcggatgcaccaaagtataaggaccagttggtgcatgtgttggctacggagcgaactggttggtcgacttttgctgaagttcaatttagcaatggctcgatctattggatcgacacacaggcattgaagcgaagcggttttacgtctattattgcttcacagacaatcagttatgagggcattattgatgaaaccgggcgaaacgatggtgtgtatcacgacggtccttatcaaacaagtgcggccacatttttgatgaattacgatgggccaaagtacaataatcgttctgtgactgttttgaaaactgcgaaaacggcctggtcaacgtacgctaatgtgaagcttgacgatggcactactttctggattgataccgcggccatcaagaaggttgtcctttacccgactctgtcgcaagaaactgttgattacaacgcagtcattgatgagacaaatcgtaaagacggcgtctatttaaccggtccatatagaagtaatgtcagtgaatacagtgaaaatagtaatggcccgaaatataacggtaaggctgttcacgtaacggcgcaagcgacgaataagtggtcaacttatgttctggttacaacagctgacggtactcgtttttggattgacaaggcggcaataaagcccattagtctttatccgatcctttcgtcttccgaccagtcgtatactgcgactattaatcaatcaactcggtctgatggtatctatgcaagtggcccctattctacctcactagccacttatggtattaattacgatgccaagaagtataacggtcagacggttcaggttctcaaagaagcacggacgagctggtcaacatacgttcttgtcaaaacggctagtggcgcacagttttggatcgataagcttggcattcagtcgtcatattccccaacgctgtctcaaagcaatgtcaattatgatgtcttaattgatgagaatggtcgtgcagatggtatttactatgctggaccatataattcaaatgcagcaacatccgttcaaaatagtattggtccgaaatataatgggcaggctggacatgcttctgttgaagcaaccaataagtggtcaacttacgtgaaggtgacgctgacagatggcacgagtttctggattgataaggctgctatcaagtctctgccaactgatccagtgctgagtagacgctcagtgcattacactgctacgattaaccaaaacaatcgagcagatggcgtctatacgacaggcccatatcgaacttcttatcagacatatacgattaattacgatgccaagaagtatgatgggcaacaaggaactgttatgcaggaagtacagacatcttggtcaacttacgttcagattaagctgggttctggcgcaaccatttggctggacaaagccggtgtccgtgcatcgtaatgttggatagaaaattaaagcacaggagctgtatttcttgagcagttttggatatcgtgatcatgtcagatcacgatattttttcggctaaaattcgggaaatgctaagaaatctttaactgttcagggtaggcgatatctgattcgatatctggtaatattagtaggtgttgattagttaacaaccgagcgctatcgttccatctcgacagcgcgcaaatgcaagttttggagatttttatgaaagtaatcaagaactttttttggaatgcgggttatcaggtcttcgtcctgattgtgccgctggtaactgtaccttatattaatcgagtactaggaccgacaggcgttgggataaatgcgttcactaactcaattgtccaatactttattctctttggtagtctgggtattaacctttatgggaatcgtggcacagcttatcgaagagatgatcgaaaagcgctgaccacctatttttgggaagtcaccatacttcgatttgtgacgattggtatagctgtgcttgcgtatctcatgtttatatttgccgttgatgagtatcgtgttttttatcttgctcaaggcgttatgcttttgggaacagcgtttgatatttcgtggtttttccaaggattagaaaactttcgggtaacggtggttcgtaatgtgttggtgcggatcgcttcccttattctgattttcctgttagtgcataaagcagatgatactgcattgtatattctgatcatgtctggctcacagatgttggggaatctaacattctggccctcattacgcgcaaatctgacgcattttccgaaactgtcaagcctgaacatctggcagcatattaaaccggcgttccttctattgattccgcaactggcgattcagatttatgttcaactgaataaaacgatgcttggaattttacagggtgttacggcatctggtttttacgaaagttcggacaaaatcattaaaatgttattggctcttgtgacagcaaccggcaccgtcttattgccacatgtggcccattattttgcccaaggtgatcacgatgccgtcaaacgctcattagaaacatcgatgcacgtgattttggttattgcttttcctttagcctttgggattgcggcggtttccacaacgtttacttattatttttttagcacaaagtttatgcccgtggcacccttgatggcagctgaagcgattgtcgtcattccgatttcgattgcgagtgccattggtgtgcaatatttgctgccaactaaccaagttaagtcatatactgtctcagttattttgggatccatcgttaatattgtagtgaatgtgcctcttattctgtggttaggaacaatgggcgctgtgattggcactatcctttccgaatcagtcgtgacgatttatcaggtctatgctattaaaaatcagcttgatctcagagggttgtttagtgaatcatggaagtattgcctcagcgcggtcgtgatgtttggtgttgtaaaaggtcttgagattgcctggtccaccagcttgatcggcctagttgttgaagttttgattggtatggtggtgtactttgtggtgctgttggggttacgaccgcacattatcattgggtatgttcgcccatatgtcgatcagatgcgtcggcgtcttcgttaaactgaattagattcattaaggggagttatatgatgaagattgggttgatccttaactatcgaaattatcgacagaccatcgcatgttgccgcaacttaatcaaggctggactggatcgcattgtcgtagttgataatggttcgccaaatgaatcattggctaagattaaatcatctttaggaaatgatgcaaaagttagcattctaggtaccaaagccaacttggggtatgcgcgaggaaataactttggacttcaagcaattgaaaaaaagtttgggctagcggacgatcacctcttgtatattgttaatccggatagtgtgcctgatgcaactgtgattaagcagatttcggcgttttgctggtctcatcccgatgcaggtaccatgacggtgatccaagagggtaatcctaaaatggcttggcataatctgaccaaaacacgagcaatgctttataactcaagaatcttttctaagcttgcttatcgacttggccatcatgaagaagttgtgccttatcatgtcgcaggacaaaggacagcaagcattaaagtcgatgtgaattctggggcattctttgcaatacgtcaaacggttatggcaaaggttggttattttgatactgcgaccttcctttattatgaagaacaagcattatccttcaaattgcaagctcaaggatttcagaattacttattgacaacatcaacttatcgccatgaagggcagggatctacccacttagccacgcgtgctatgttggggtattatcaacaaagccgccgatatttactgaaacaatatttgcatgcaggcccattagcgttgagattttatgattggacgattaagcttgaagatatcttggctggcgacagatcaaaaacgtaaactttgaaatgcgtgagctgtagttaagagtgatgcttacgtaatgtgcttgatgttcgttggattttgactagcaatatttattgaatgacgaaaggaacagatatggacattcaggaccagcttaagcaattcaagggcaaacgagtacttttgcttgctccgcagttttttcactatattgacgaaattcgtgatgccatgaaagctgcagaaattgattgtgatttccttgatgagcgcccactgccgggttttacaggaaaagcaatcgcacgttatttgccaatgattaatgagcggcaggttgccaagaatgttgatgatcaattgacagccaagagttatgattatctcttagtgattaaaggcgaatccttgagcaccaaactcctggcagactttaaacaggaaaacccaaatgcaaaactagtgctatttttgtgggattcggtggcaaattccaagcatgcggaagcgttttttgaccagttcgatatggtttacacatttgacgcaaacgatgccgcaacttataaaattgaatttttgccactttttgtagggtcacagtttgatcctcgtctgattgatcaagatcagcagcaggatattgatcttgcttttattggtaccgtgcattccaatcggagtgagttattgaatttagttgaaaagcttgcagctagtgcacatttatctttttatgatttccgatatgttcaaagcaagcttgtatatgctgtcagatatttacaagatcgtgctttcagaaaatcgccagccggtaccgtccattttaataagatttctgctgaagcaatgctgaaaactttacggcgaaccagaacaattgttgatgtcacccatccaaagcaaaccggactaacaggacgcgtgattgaaggcttatcaatgggtcgaaaagtactcacaacaaatagtaaggtcttagattacgactttatcaacaaggaaaatgttcaaatatttgacgagaagctcacaaatttagatgaagattttatcatgaaaccatatgtgggggatccattaatggtttataaaaacttttcagtctataaatggctggagacggtactgaccgggactgcttatgtaccggttgaccatcgatcggttgttgaaaaggattagtcgcttagaaatggagatcgtttacacatgtacgaaccaactaaaaaacgccgcgttgccgaagacgtggccaaggttttccctaaagaagtcaccaatcagatttttgatgtgatcgctgtgatgaataaggctaagcaaattgtgacagcaccggtcgccattgcattttcggatgattataccgatgatgaaatgtatgccatgatcattcaaggcaatcttgcaccagcacaagagtttccgcttacctatgctggcgaaaagccatttttgggtcatgggtatatccttgtggtcaaagataagccgaaaacaattcggctggatttcagtacggctaatccgtttaaggcagaagaatccaaataaaactggccttttcatgaaaagttcgatacaatagtaaaccgtaatcgttaccgtttactattgggaggcagctatgagcgaaccgattttgaccgtaaatcatctcagttttggttttcgggatcaacagctttatcaggatctgagttttcagttgaatgtgggctcaatgacaagtcttgtcggtccaaacggggtcggcaaaacaaccttaattcggttactaatggcgcaactaaaaccgcaagccggaacgattcgctttcggcaacagccaccggttcgattgggttatgtgccccagttccggaatgttgatacggaatttccgttgtcgatccgcagtttcattcaactccggcagttggatcatctctttttctggcatacgggtaaggagaaggctgccttggatgccgtgattaaagcgactcaccttggtaaaattgctgatacgcggcttggaatggcgagtggcggcgaaaaacaaaaggcttatctggcacaagctcttttagatgatcctaactttctgattctggatgaatcaacggccagcttagatgtcaacacgaagcaggagttgatggatctggtgcaggagttgaatcaaacgcggcaattaacggtgctatttgtgacgcatgatctgagcttagccaaaaagtacacccaacaatacttactactgaccgggtcaagttatgagatgaagccaacagcgcaaatggatttgaaagcaatgccagaagaattacgcaatgatgccgagaatcgtggggtgatcgcatgaatttatttgcttatgcattcatgcaaaatgcattcatggcaagtacgtttattgccattaccacaggcattgtcggtgtgttcgtcgttgcgcggaacatgtcgttcttagcccacacactttctgaagtagggtttgcaggcgctgcgtttgcggtgtttgctggcatcagaccgttagacgggatgttgttgttcacagcgatcagtagtatcagtgttggccgtatgtccgttcaagcatcgcggcgagaagcctcaattagcgcggtttctagtttgtttattggtctggggattttgtttttgtcactttccagcgccaatgccagttatgcaactaccattttgtttgggagcatcatcggaatctcccgcgccgatgtctggcaactggtagcattggccgccggcgtactaataacgttgtattttggctatcggcgactcgcgtttgattcgttcgatccagttggttcagcggcacagggattgaaaagtaaatatatttccatttactttctgcttatccttgctgtttcggtttcgattggagcacaaattgtcggaagtttgttagtctttatcttactgaccttaccgccaaatgtcgctaagtatctgggtcgaactttaccgcagatgattgtgatttccgtcattaccgctttaatcggggtttggagcggcttgtatttaggctttttgacgaactggccggtgacgtttttcatcgctgccattgaatttcttttttatttcttggcattgtggtaccatcaccgaacaaactaagcaattgaaaagggactcgcaacacaaaccgtattgagtagcggttgtgttgtgagtcctttttgacttagttagtgttgatggcgatatttgtgcagaaattcagcaacttcctgttggtaatcgtggcgctgttcgaattgtttgaggtaagcagcattgtgagtgctggtggcgccagtgtggcgtaacttcgtgtaaacctcaggataaggtaactgctgttgcttggctagtgataactctgcggacacgtcgtaaggcacctgccgcagatcaagatcggtgatggcaccatcattgagttgcagcaatgcatagtcggcgtaagtggttgtttgcaggtgtggccggggtgaataggcttggccaatagaacctggattgaggatgacttgaccgttactggtgtagcgcagtagctgttggtgggtatgcccataaacagctagatcaatttgcgaatcgggggcaatttggtcaaagttgagttgtggttgatcaggatataaggcatgtccatgatttttgtcaggaaggttatgtgctagactgacgatcaaaccatcttgctcgaaaacttcatgcagcggccaatttcgaattgttgccagattttcagccgtgaggtgcggccacagataggcaaccagtcgactaaagtaaacatctgttggctgtgacagatcaactggtccatccagtacccagaataaatcgtcatcccagttgcctttaacgatatgtgtgggtttgagtccgtgcagcgtcgcccataacttatcagaacctggaccgggtaaaaacagatcgcctagaaaccagtattcatccgcctgatgcgccttcgcatcctgaatgaccgctgaaaaggccgtcatattgccgtgaatatccgataaaatggcgattgtcgtcatgcttgatcccacctgtcgttcatcgtaatcaacccttgcgttccgaggttgcccttaccagtattaaccatttgtccatacagctgtttggccaattgcgtggctggcagttgtaagtgcatgttatcggcttcatccaaagcaatgcgcagatcttttagaaagtgttttgcaaagaatcccggcgtatagtcgccttgcaggatacgtggtccgtagttgctgagactccagttggcacccgcaccaccgccaaccactttaagcgtttcgtcaagatccaggccagcagccttagcatagacaagcatttcggtaagaccggtcatagtgccagcgatcatgatttgattggccattttggcatgttgccctgagccggccgggccaaaataattgactgaggcggcgatgggcgcgaaaagttgctgcaatcgcgacaacaaagtcttgtcaccaccgaccatgatggttagcgtgccatttttggcgccgatatcaccaccagaaaccggcgcatcaacggcttgcaggcctttctcggcagccttagcagcaattttcttcgccagagtgggggtactggttgtcatgtcaatgagcagtgccccttttcttgccccagctaaaatgccatcgctaccaaaataaatggtttcgacgtcttgtggaaatccgaccattgagagaacaatgtcgcactgcgcagcgacagcgtgcggcgattcagcccaagtagctccagcctcaatgactggctgtgcatgggccttcgttcggttaaagacgaccacttcttggccattctttaaaaagttcttgataataccggtgcccatcacaccggtgccaataaacccaagtttcacactgctcatcctttctgcaaaatttcttctaattcagcgagtcgttgttcaaatagtgagaaggcggcttctaaataatctggtttggtcatatcaacgccggccgctttcattgtatcaattgcatacttggaactgccagatttcaagtagccgatatagcgggaaaccgcctctggttcgccaccgctgatgccagcggccaaagtcgaggcagcggcaaaaccagttgcgtactggtaaacataataattgtaatagaaatgtggaatacgagcccattcaaaggcgatttcaggatcacgtgcaacatctggtccgtaataacgggcattcagatccgcataataggaggacatgctggtagccgtcaatggttcaccatgctggtcttgttgatgaatccaatgttcaaagtcagcaaattgagcctgacggaagaccgttcctttgaagccgtctagatagtaattcaaaatgtacgcccgaactttaggatcattggtgttttttaggaagtagtccgtcaataaattttcattggttgttgaggcaatttctgcgacgaagattgggtagtcgccataaacgtaaggctggtgatgacgagtataccagctgtgcacactgtgaccagtttcgtgaaccaaagtgtacaattcatcaacggcatcgtgccagttcagtaaaatgaacggattggtgtcatacgcaccaccggaataagcgccggaccgtttgcccttattttcgacgacatcaatgtaacgattattaaagatttcccgcatatgatctaaataatcatttcccagcggagccaatgcctttaaggcttcgtcttttgcctgatcgagggtgaaactcaatggcggacgtccggtcagcggtgtgtagatatcatacatatgcagttgatcgacattcagaatctttttacgtaaggcaatatagcgatgtagtaatggcaagtgagcgttgacttgatcaagcagtgttgtgtagacactttcggggatgtggttacttgccattgcagcagcgcgagcatcgggataatgatgcgctaaagcattgaagttatgagctttgatctggccacttaatgtttgagcaaaggtattcttaagactttcatatgcccgcagcaaagcctcaaacgcgtctttacgcagcttgcgatttgttgaccgaatgagttggccatacaaaccattgctgagttgcacggtctcaccgtcttcatttgcaacaaagccaaattgcaggtcggagttgttcaacacattaaaggttgcatgactggcattcagcgcatccccagcactagcaattaatgactcagccgctgtggtcaggacgtgttggcgattcacagtgatggcatcaataaagtgaccatagggtttgaggctttcggtatcgcgccaagcggtcaactgatcggctggaatcgccagaatttccggatccatgaacgctaattggctggcaagatcagcggccagactttctgctttggcattcatggcttgatacgctgcattgccagtgtcttgatcacttttcaagctggaatagacataaaccttttcaaagcgtctgaacaccgcgagaacggctttgatacctgcgacaagtgcttcaggcgacttgcccaatgtacccttaagtgctgccgcttcctttgcttgctgacgaacggcttcaaagtcaacttgccaagccttgtcatctggataaatggtcgtgagatcccatgtcaattcagtagggacttctgcgcgtgccggtaaatgttgcatctaatcagctccaatttctaatatttctttaatgttaccatattgaggcgacatttgaggtaaatcccttttttcttcataattatctgctaaactactctggaaactaaaagtggagtgaagctcgaatggacaagcaacaaaactcagatcaacaaacattaaaacgcaaaccaaaacgacgtcatccgattttacgtaccctaacagtcattttgcttgtcgcccttttcttggctggcggatatgccgcccgattttattcacaagccaaaaaggcggttgcgaaaacatatgatccagttagtactaaggcggtcagttcagatctcgatggcaaaaaaccgatcagtattcttctactaggaaccgataccggtgcctttggtcggaaagataccggtcgatctgacactatgatgctggtcacgatcaatcctaaagagaagaaaacaacgatgaccagtattcctcgtgacacgttggcggaaatggtgggcacaggaaatgattcacctacctacgaaaaaattaactctgcctatgcatatggaaaatctagcgcagctattaaaaccgtcgagaagttattaaatgtcccgattgattattatgtgacggttaatatggagggcctacagaagattgttgacgctgttggcggtgtcgatgtcaatgttccatttacttggacagatgccaataccggtggacagacattcaaaaaaggtaaagctcatcttaatggggaactggccttagcatatgctcgaatgcgtgatgaagatcctgaaggcgactatgggcggcagaaacgccaacaagaagtcatcaatcagattgttaaacaccttatgtcggtcaaatcgttgacaaattaccaaaaggtcatggattccttatcatctagcatgcggaccaacctaacatttgatgatatgatggcaattgcgcaaaattatcgcgcttcagcaactaccattgatcgtcaacagcttaaagggattggcgtttatattgatgaggctgcttatcaggtgatgacaaccgaaacgcttcaaaagatgtccaatgagctgcgtgggcagttagggcttgaaagcaagacgctaagtaattttaatactcagcaaaatgaaattaacaatgcgaatggatttgattggacagcgaacaatccggtctacactgtgtcgctcgatggtgcgacaaccggaccgtgatcaaaaaaacagcagcactctggcttcattgccaaggctgctgtttttttgtgagcgcgagtaggagcgctcaggcttctgcgactgggggcgcgtcatggtgaagcgctatactgaatattttttgcctgatgagaaatcaagacgtttttaatctggatcaggcagatccggtgccaatttgtgaccgctaagtttagcggcgatgaacccggtaagaaagccgatgagcagaaatggcacaaaatccatcccgatgccgaaccaaggaatataggttgtagcgaattgttgaatgctactgaaaatcggtagttgtgctagcccagctggtaaggcatggatggcatctaaaagcgcagggatcatcgtgaaggcaaccgtagttttatagattcgggtatttttcccaatccaaggatgcatgaggccgagcatgattaaggcaattgccagcggatagagcagcattaaaattggcgttgaataagcaatgatctgatccaacccgaaattggcaatcaggaaagcaccaattgtcgtcattggcaggaaaaagtgataaccaagttttggaaaacgatgaccgagatcttgcgagaaggatgtcacaagaccgattgcggtggttaagcaggcaagcagcgtcatcgcgcctaacaaggccgtgccaatcaaaccggtataatgtgtcatgatctggttaaacgccgtcccaccgtttgctgtgagcttagagaagccaagactgattgctcctagcaagatcaggagcatgtagatcaaagcttccaagcccattgccaaggagcctactttcgcaacagccttggcgcgagtggatgcctggtgcaagcccatgagtttcaaggctgtgatgatcgtcacaccaaagcctaacccggccagtgcgtccattgtgttgtacccttgcaaaaagccgttaatcaagttgctactcatgagcttagggctgctggtaaaacttatcgcacgaatatcacctttgatgaccagtgcccaaaagaagattactgctagcaaaatcaacaacagcggattcagcagcttgccaatataagtcgtaattttactttcgttgcgagcaagcaagaaggttgttaaaaagaaaataaacgagaaaatcaaaaggccgatttgttgttgaccttttcctaagaacggcgcaatgccaattgagtatgtgacagtagcggtacgcggggacgcgatcagcaggcctagactcgcatgagtggccagcagaaagaacaatgcgaagctatgtcccgccggtcgagcaagatcgtacatactactcgcacgggttagactgatcgccatgattgacagcagcggcaacaacacagcagatagcaaaaagccaattgccgctggtagccaagctgaaccggccagttgacccatgtggatcggaaaaatcagattgccagcgccaaaaaacataccgaacaaaagtgaccctaatgtcaaatactggcgctttgtgagtgtgggttgtggtgacattgatatccctccatttaatcaaaacgattgccgacagcgtcttgactgtaagaaggttttcaaaggagttggctaattaaccaaaagaaaagcccttaacagtcgagactgttaagggcgcgaatcacgctgtaccaccttaatttaccgctacgtcaccgtaagcggccttactgtgtacggccagttgcctggcgatacacgattgctataatgggcgcaatcccaaccgaagcttccaaagtcacctcggcaactcgtagactactttcccaaagctaccagaggtctcttcccaccaaccgagactcgctgacaccgacaactcaggtactcttctactcatcgtttttagttgtttgttgaattgttgtttattttacgaaaaaaacgacagatgtcaactaaaaagttcagagcgcaaacaggcgcgtttagaaaccggagcataagcggcctcaagcctaaatggccgggccttggccatttagacttgggggtccttatgagcaggtttctgcgcctgtttgcgcgtttcgaaagtagagcataagcggccccaagcctaaatggccgggctttggcatttaggcttggggtccttatgagcaggtttctgcgcctgtttgcgcgtttcgaaacctccgagatcaagtagtcccttagtagtcaacacggttctaagcaaaatttgcgcaaacaaaaaccctccgcactgatgcgaagggttaaagcaatctattaacctacgacttcaaccgtcgcagtcaaaactccagctgaaggaatctgtgaattcggcattgcaacatccaattgattagggttaccagctgcaaaactaccagtatcattaacagtccgataccaaactgtgccatcagataatgtaatcttcagacgggtacctttcgggaatacggagaggttagcagcaacgccgccgtaacccaaaccagacccaagcacggacggatcatagaaacttaacttgaaagtacctttgttggtggttgtttctgtcgaagctgttgtagcagcgcttgatgaagcagaagcggctgaagcagcagatgctgccgcagcattttgagctgcttgttgtgcttcctgttgtgctttttcagcagccgcctgttcagcagccgcttgttctgctgccgcctgttcagcagctgcttgttcttcggcagctttagcagcggcagctttttgatcagcaatctgatgtgctgcttcggcaatatcattcgtgccgactgtgaaggtgatttcttttttaggattgatcagtgaatgtgcattcgcctgttcaactttagcctcattgcttaacacaattgactttgcgtttacgtgactactatcgttatctgcatcggcgtgatcggcaatcgcttcgaccttttgtgaatggttacttgccatccctaataatggtgcgacactgagtaacgcgatgatagataatttaatttgcttagtaaagataaatattcactcctaatattttgaatagtcgtcgttttgttcccccgagaacacaagacgaagtatataggggtggtatgtcagtaaaataccaacatcattacaaatatactcaattcagtaatattgttacgttcgtgtaacaaacggaatgttaaaatttttcgtaacaatcagtgaacttttctcgaaaaagtgggttgagaccttgaagttactatgatattggccaattttctaccacaatttgtgaattttttggaaatttatgggagcctaaactttaactctgatcgttcatgatacaattcaatgactggcctaaacggtgcttttgagaatcaggtataatgaagctgaactgtcaaggaggccgaattcgtggcaatgtatcgggaaaaacgttttgaagagataaaaaaactgttggcagcacgcagcgagttgagtatcgaggatattatgaaggcggttggtgtttcacgagataccgtacgccgagatattgttgcgcttgatgcgcaaggcgttgcgagacgaactcgtggcgggttggtgtctcttagctttggtcacacgattcccagctactctgcgcggctgaaacgattttcaactcagaaaacaaagatggctaagtcagcattgacgttaatcaaacctggcggcgtttatttcattgatgattcgacaaccttattaaaattgtcgcagtccattcgacaaccggtgacagtttacacgcacagtttagacaatgcgatcgcactttcagttgaagaacgtgttaatttacatctttttggtggcaaactggatcatcacgcccggttcttctttgaaccaacgatgcttgaaacacttcgccgaatcgcctttgatgcggcatttatcggtgcaacggctattgccgaagatggggtttacttttcttatatggaagatgctcaggtgaagcaggcggcggcgttatcagcacgccgggtggtcgtggtttctgaaaccgaaaagtttcagattgaagcaccttatcgcgggctggaactcggccagattaccacacttattacggataaaaaattatcgcagacgcacaagcaatggtttgccccacagacacagtttctgctcggcgactaacaactgcttgactaaaaaaggattgatacctattcaacagctaataaatgatccggggattcgcacgagtgaggaggtgcgttcatggtaaagccactcgtcaccatcattgtgccggtttataatcttgaagcctatgtggctcacggcttgaaaagcttaattgaacaaacttattctcatttgcaaatcattgtgatcgatgatgcctcaaaagatcattctccgcagatcattgcgcatttcgcagaactggattcgcgtattcaaccgattctgaagcaggtgaatcatggggtttcggctgcacgcaatagcggcttggccctagccaaaggcgatttagttgcttttatggatggcgatgactggtacgagccggactttattgctcacgccgttgacatgatggcgcgtggctgggatctcattgcgatgccgttttatcgggatgatcctgacccgcgaccggtgcatgaggctttacgcaagcctaagcagctcacgcgggaaggcctaattcggcaaatgcttcatccaattggttatattcgcggttatttatggaataaagtttttcgacgtgatgtcatcgagcaagtcaggctacgttttgatgaaagcatgacaattatggaagatgaactgttcacggcgacttacgtgatggccactcaccggtttctttacaccgggcatccagcttatcatcatgttgttcgtcgagactcagcgacccaatcgttggggatcatcggtgcggttccgcagcagctatatgcactttggcggattcatcaagttttacgagtcgcacgacgaacagaaaaggtcactaagaaagaggcaattaagattgaacattgatcattggaggcgcgggcgttgacagaacatttaatgacttatcgtcagcttaagcaaaaagcaaaagggcaattaaaagaaggcacgaatcggcgcgatttgatgctggcttatttgttaccgagtttaattcaggcagctgtcgctatcatcacgtacttgatggtcttcgccttaattcaaaaattcggcattgaaaaagctttgactgatccagatggattccagaattatctgcaaagtggcaatcgtaccggaagtatgaatacgattcaaagcctggtcaatacgatgctgattcaaggggtcaattttggcgtgctagatcttgtacgccgtaaagagcgagttcaaccactgcatgcgctgctaggcctatttaacggtcagtggttctggggtgccatctcattatggatctttatgtatttcttgacgttgatggggctgtcatttttcttgattcctggaatactacttgcattgggctggcgtcaggccttttgggtctttaaagatggtcatgaaaccaatcagcgcttttcctcgatatcggcgttgatcggttcttggcgactgatgcgcggcttcaaaggcgatttgctcggcctgtatgtttccatgatcggttggtatcttctggaaaacatcacgttccatttatttgactgggcgatcaatccatacttgcaattggttcacgctaactattatgaaaatcggcgcgcctacaagatcgcggctcaagcggctcaatcatgactaaagctgaattgttgtcgccagctgcgagacggggtatactgaccgcgatctcaacaaagtgaattgtatatcggtattagcattttgaaggtgaggcaaaagacgatggaaactgaagcctatatgacacttgccgaagtgaaagctcggcaagccgccttaaaagataaagtaccgctagatcaggctattgctgaaaatattcaaaactgggctcagtggttgcttgatgaaggtttcgagggcagttacttcacggctaagattgacggtgatactatcaacattaccgatttagatggccacccagccgccagcatcagcaccgatgcgccaagttacgtcgaagcatttaaagacagtgatcgcatgacgatgatggccattcaaaccaaactacgcaggttgatcgatcggcaggttttaaagtcgcagtgagcgcgagccagcgcgtttagaaaccggagcctaaatggccggttaggttcgaggttcttatgtgtaggtttctgcgacggcgagcgcgttatagaaagcaagccaaccatcaagaagcaagcctaaaagcgaaaacgaccgcagatcaatcaagctcgtttaggctcggtcacttatgtatgagctccggtagtgacaaccaaacaacgtttcactcaaaagcaccgccagtcgctaaccattaaaaggttaacgactggcggtgcttttgagtgctttgtcagactagtaaagtttcatctgattcaatggccaatagcgccaaacaacaactgattgaatctttgacttatcaacaaatccaaaatcgcggctgtcatgggatactagccgattatcacccatcacgaagtacttgccggctggtaccttagcggatttcgttgaggaaagggttttgatgttgaagtcattggtgaatttaatcgttgaagcatcaagtccctgctgactggcccatttattaatctcgtcggtggcaaactttttgttcaagtatggttcggcaatcttcttgccgttcactgacaattgattatcttttgaactaacggtgtcacctggcatgccaatgacacgtttaatatagagagaaccaggccgatcaggggcattaataaccacgatatcgtttcgcttaggctttttgacgcggatagaatacaaacgatcgccgttttccaaagtcggttgcatcgaagttccttgcaccacatctttgctcaacacatagcgcatcagtagttgactggcaaagaagataacggcaaaaaggacaaggaattcgagcaccgtttttaaggtgggatgactgttatttttcacaatgacaccttccggaacagaataacttcagtctaccacaagccgaacgctcgcgactaggaagatcaccggtcaatttaatcgtattttgggaaaaagccgctattttcggcttgccggcataaatcgacaatttgcgcatattcggctaacatcaggcaccaacgatgcggcaaacttgtatacccgtaggtaagtccagctaaaccgccaacaagcgcgccagttgtatcggtagcgccaccttggttcacggtttgtaagacggcatcgtgatagtccggtttactttgcagtgccttaagtgtacgtgctaataaactgatcggatcggtagcactcccatcaggccacttatcatctgccaaggctgcttgaaaagcttcaaaaattggctggtaaggctgcgtggttccaaaataactacctgctttgttgataccagtggcaatggcactcgataaatctggcgtcgtgccaagtaattcaacggcaatttgcatgtaaatgccagcagcaaccaagttttcagcgtcttggttagtaatatgaacaaaagtttcaagcaccttaacaccttcagctttttgaaaaagactcgtgtcaaaagtttgataggcgaaaaaggcgaatggcaagattcgaatgagtgctccgggttctttggcggcggcaactgattggccagttttaagtgctgtttcaatgcttggccagatatccggactgcgtttgccataaggagcatacttacccgcggtgaaccaagcttggtaagccttgattaaggcttgttcatcaaaaccgtgctgcaaggcatctaatccggctaacgcgagtccagtttcgtcagagtaggtgccagcaggttggctaaacgtaccataacccttcatggtggtcaccggtgctgcggttaattcagccgcattttgtctcttaactggcaatcccaacgcatcaccgatcgcaaaaccaacggtgccgtgaatcaagcgtgattccatgatacccatttaggttccccctctataatatatgtcgtgtcgtgattttgacattttctcaggtcatccgaggcacacttaaccttgtcaaagggcagaccacatataaattctttgatattactatggagctattatttcgctagaacgcataaaattgcaaaaaatttgctccgttgtaaaaataaccatgctgtgatagcctagcaagcagtgactattttcagaaagagcgtgaataagggagctagagccagtgtcatcattgtgtcaattggcattgaggccacccgcatgcaaactgtcacagcttgcgaagtggtttcagcaaacgctctaagcaaccaatcagctgtcgttttttatacgttttagtataggaggaatcatgagtgttcttaccgtaaccggcctgtcacagcgctttttagacaaagtgttgtaccaagatgccagttttcaagtaaatatcgaagaccaccttggcgtgatcgggcaaaatggggtcggcaagagtaccctcattaagattctgacaggggcactgacgcctgatgcaggtaaaatcgtctggcagaagcacttacatgttggctatttggatcagtatgcgaatcttgtacccggccaaacagttattgaatttttgcagaccgcgtttagtgatctctaccgtaaagaagcaaaaatgaatcagatttatgccgattatgctaatcatcccgatgacgatttactggccaaagcaggggagctgcaacaagagcttgaagcgggcgatttttatgatctggaaacaacgattcaaactgttgctgaaggccttgggattacagcaatggggatggatcatcctgttgaagcattgtctggcggccagcgatcgaagctaattttggcaaaattgttacttgaaaagccggatatgttgctcctggacgaaccgacaaactatcttgatgtgtcgcatattgcctggctaacggactggctccaaaattttgagggcgcgtttatcgtgatctcacatgattttgattttctagaaaatgtaaccaatgctgtcttagatattgagttcgggcaaatcacaaaatacaccggaacgttaaaacaagccatgcgccaaaaagaggccgatcatgagacttatttgaaggcttttgccaagcagcaagagacgattaagaaaactgaggcgtttattcggaagtttaaggcaggcacgcgcgccacgatggctaaaagccgtgaaaagcagctggcgcgaatggacaaattgacgcctcctgggacgcgatccaaggcgcatttggcgtttccgtatgcgcctgttaatcgacaaatcttggtggacgttaacgatttggttgtcggctatgacaagccattattacaaccaatgaacttttcggttgcaaaagatcagatcattgctttcgaaggcttcaatggtgtcggaaaatcgacgttgttaaaaacattgctcggccttttaccggcgatcagtggcaacgttgaaatagccgacaatgttgtttttggctactatgaacaagagttgcactgggatcaacctaaacaaagcccagtgcagtatttggagcaacggttcccagcgctcacgcagaaaaccgttcgacaggtcttatcacgcactgcactgaccagtgaagaggcgaacaatcctctgacgatgttgtcagggggcgaacaggctaaggtcaagttggctgacctaatgctccaaacgactaatattctagtgatggacgagccgacgaatcatttggacgacgacaccaaaaacgctttgcgtgaaggcttgcaacaatatcctggcgcagttttactagtttcccatgaagctggcttctatgatagttcctgggttgacacagttgtgaacgttgaacagttgcaagttaaagcttaacgtttcgaaaaaatcgacgggcatgaccatcaacggggcacgaccatcaatgatgtttatgctgttatctataaaaagacttgctgctgtatgaacgtccatactggcagcaagtcttttttagtcgaaattcggataattcggtttgtgtttcgagcgtactgaatgggtggtgattaaacatgccagaccagttgggtataagtataagtcaagcgatcagtcacctgaacgtgcgtattctcatggccggtgatggtcttggcaaggctggcagcagttttaagaccaattggtgtcgccagatccggtaacaagtcgcttaaagttgtttgctcttcaatttcgtatgtcaaagaatgactttgaaaaggtatccgttgggctgtcagccaaactttgaagcttatcatgcgggcggggtccgcctgataaactggtggtagctgcaatcctaaaagcgaggccgcttgttcaagcaaagcgtcagactgtgcagtttgaaagttaagcaccacggtttggctagcccagttcatcagcatttttaggtcttgaggtttaagtgtcggcaactggctgacaaacaacatatcggcattaagcggcttgtgtaatttgcgccagtcagccacgataaattgagctttagtatcggcttgttgatgcatgcgctcttttgcaaaggcgagcatggcagacgaccaatcaatgagcgtcagttcctgaacccatggcatcatttgaacagcgtagcggccagttccggcagctaagtcgactgccgaatgcgcaggcagcaattgcgttgaacgcagccatgcgatgacatcgtgtgcgataggcaaacgcgacgcctgctctgccgcggcataatcaggcgcaaatgcgttccaaaaagcttgatcctctgtcatagtgcgtgcttttcctttcttgaaaaactttttttaaaaaagtggttgacttgagtgagtaaactgcgtagtatagtacgagttgtcagtcataaaaacagtttaaaccgcacagcgatttaaaaaaagatgttgacaacgagttgccaatttgatattcttagtaagttgtcgcttggcgacaaagtggccctttgaaaactgaacaaagtttcgtttaaatgtgcagggtccttggtacttcggtaccgaggcaagaagtaacatttgcgaagtcaattcgctagaacaacaaatcgagctattcgaacagctcatatttatatgagagtttggaacacagaagttaagcttcttcacgccgagagtagttggtgggaaactgcctgcgagggtaggaagctgccacgctaagttaggatctggtcattgaccggatctttttttataccttgataagtaagtggcagtcgtgctaaattgcaagagcaagcatggaaggggatcacatcatggcaattgaggcaacgaaagataacttgaaggcattgacagctgaaggcacggttgtcgttgatttttgggcaccgtggtgcggcccttgtaaagtgcttgatccgatgttaacggccctagagcaagaactgccagcgcttaaggtggttcgttataatgttgaaaaagagcatacgttgccgagcactatgggcattatgtcagtacccaccttagtcatttatcagcaaggagaggcgcgcgaaaaagtgacaggtgtttaccctaaagacaaacttaaacggtattttgaacagaaacttgaggcgtaggtatgacacattcagttgagcgtcaggatacagcaatccaaaatcaagtattggcaacatgcttgcttgctggacgcattatgattgaaggcggttcggaaatgtatcgtgttgaagatacgatgcgacgaattgctgtgaatgccggtgagccacaaacgttggtgtttacgacgccaaccggtatatttgctagcatcgaaaatcagccgtatattcaggagcggccgattagcaaacgatcgattgatatggaaaaagtgacgcgcgtgaatcaactctctcgttcgtttgcggctgatcagattgatctagatgaattgcacgcggcattgatcaaactggatcagaacaccccttttttcccgatttggttgcaggtggtgagcgcggcagttgtcagcatgacactcatggtgttatttgctcaacagtatgactggcttgatatgcctttggcagctgcggtcggtgcattgggctttctagttgatatcaaagtgaatgcagtgaccaacattcggtttattagtgaattactgggcgcattggtcgttggcttaactgcgtggcttggggtcaggttaggcctaggacacaacctggactttattattattggagcgattatgccgcttgtaccgggggtagcgattaccaattcgattcgcgatatgctggcgggacatttgctgtccggtatggcccgcgggatggaagccattttgagcgcttgtgctatcggtgttggtattgctatgatcttccggttcttctaaaaacataaaggaggcggcatcttgcagtggtggtttgctttattagttcaacttttgttcagttatttggcaacggtcgcttttgctatcattatcaacgtgccgcgcaaggcgttaaatttggctggttgggccgggatgatgggctggttggcctactggttgttgatggaagtcggtagtggccggatgatggccaatttagtcggagcttttgtcattggcttgtgtggtatcttttttgcgcgctataagaaaatgccggtcatcattttcaacatcccaggatttgtacctttggtgccaggcgctgttgcttaccaagcagtacgagcaactgtcttaggcgatctggacggggccttgcagtatgtcagtcgggtggtcatgatcgctggtgccattgctgtcggttttatgttggcgcagctgttatcagaagtgttgtataaacgagctgttttaaaacccaaaaagtgatataatcatgttatgcgatgagtcgagtaagcacgcaacttgtgctgaaagctgcagctgactggttaaaagccacccgccggatttgtggggtcagcgatctcaaggttgtggagccagcgagatcctatccaagtcaacttgggtactgcagaaaaaggacgtttttgcctttaagggtaagaacgtccttttttatgtgcgatttaactagactgactacaaagacaaactctttttgctctaataactttattagaatagagggttgacttagacatgcatttcctctaagaaagttattgccaggcgtctggttgtcatcaaaataaacattcagcaaattaccaataaaaatttctgagaaaataagttgactttccttggtaatcatattaagattttaaccaaccattaatcttaactaggagggcgtattgatgtcattgatgtgtatgcaaagaaaaacaaatcgtaactgtcattacgctcttttagccttgttgttgatgccagggacccgaccgaattgatcgtttaagatcaacgtgttgagccccgttttcgcattggcgatggggcgtacgattagcacccattcgtctgaatgggtgcttttttctgttaagaatcaatgagatatagtcataagcaatataatgagggggaaccaagatgaagaagcaaattgtcaaagcaattatgagcgctggcgtcatcgcagcttcgatgctggcattggcaggctgtgcgacaaagagtgccacgagcaaaggaaatacggcaggtaacacgattaaaatcggcgtgaacatggagttgtctggcgcggttgctggttacggcgaacagcagaaacaaggcattgaattggccgtgaaacagattaacgctgcaggtggtattaaggtcggaaatactaagaaaaaataacggcggtctatcgtgacaacaaatcgtcaacgagcggcgcggcttcagtagctgcacagctggcgaatactgacaaagtggttgcgatcgttggaccggcgacaaccaatgacggaacagcctctattccaaacgtgaccaaggcggccgtaccaatggtgagtcccagtgctacggatccaaactttacacttcagaaaaatggcagcgtgcaaccctacgttttccgtgcttgcttcaataacgattttcaaggagaccatgcggcgatatttgccaacgataccttgaaggccaaaaacgtggcgattattgctgacaactcgactgattacggaaccgggttggctaaggcattcaagaagaagtttaaaggtaatattgtgacgactcagtattatcaatcaggtgataaagatttcaatgctatgctgacaacgatcaaaagcaagaaaattgatgccatctatgcgccgggctattattcagaattaggcctcgtcatcaagcaagcgcggcagtcaggcatcaaggtaccgtttattggtgcagatggcatggccgatcctaagttggcacaaatcgccggcgctgcgaatgcaactgatatttattacaccacgccattttcgacgctgagtgctaacagcagcaagctggtgaagaactttatgaccagctttaagaagcagtatcaaacagaagcaccaacgttctcagcacttgcctatgattcggtttacatgatcaagcaagcgattgaagatcagaaggctgccgattcagccagcattgccaagggcttggccaagatcaaacaaatgcctgctgtgacaggcaccacgaccattgatagtcaccataatcctgagaagccgctggcggttgagcaaatgacacaaggcaaaatcgccaaagtctataccgttaagtaaatgactgcggaagctttttatgaggagatcatattttgcaaaccttgatgcaacaaatcattaatggactctcacttggcagtatttacgctttactcgcgctaggttataccatggtttatgggatcatcaagctgattaactttgcccagggtgatatctatatgctcggcgcgttttggggctattatgcgattaattacctgcacttcagttttgttccagcattgttgtcggcgatggtgatggctgcgctctcaggcgtcttgattgaatacttggcgtatcgtccgttgcggaattcaccgcgaattgcggcgttaatcactgccattggcgtttcctttttcctagaaaatggcatgtcgtttctattcggtgctaatgcctggaactttccacaggtcatcactactaaaacctaccagatactaggggtcgatgtttcaaatgtgcaactgcttattttgttcacctccttggtactgatggtgatgctgcagttcattatcaagcaaacaacgatgggcaaggcggtgcgggcggtggcagttgatccagaagccgctcaactggtggggatcaatcccgatcacgtcatttccttcaccttcgcattaggatcagcactggctggtgcagcgggtgtcatgatcggcttgtattacaattcgattgatccactaatgggaatggtgccgggaatcaaggcgtttgtcgccgcggttgttggtgggatcggatcggtcccaggagcggctgtagggggcttcttgattggcttgctagaaactggtgttcaggctgtgggcttatcggcctacaaagatgcggcggtttaccttgttttgattatcatgctggtcgtgttacctgctggattattcggcaaacgtcaacgggagaaggtgtgagcctatgtttaaaaatatgcgcagtaagctcatttggctcgcgacgatgattgctggctttgtcttgatcgacattggtgaattaaccggcgtcattaacgggtttatcgaaaatgcgctggtcacaattggcattaacattattttggcagtcggtttgaatcttattatcggattttccggtcagttttcgcttggtcatgctggcttcatggcgattggcgcttatgccacggcgatcatcacacaaaacatctcaacgccgcttgggttttaccttgctatgctggtcggcatgatcgttgcgatcattgccgctttgattgtcggaatccccacgttgcggctgcgaggtgactatttagcgattgccacgatgggcgccgccgagattatccgagtcattattaataatttgaaaatcaccaatggccctgctggtatgtttaatattccgcctttggcttcgtggccaacggtctatatcttaatgtgtgtcactactgtgatcgttgtgaacttcattcacagtcgggcgggccgcggggtgatggccattcgtgatgatgacattgccgctgagtcgattggcatcaatccgaccaaatggaaactggcagctttcgtgctcggcgctgccacggcagccattggcggttcactccatgcgagttacttgcaaacgattgctcccggagattttggcatcatgaattcgattgctttgctgattatcgtcgttttaggcggggtcggtagtatcactggcacttttgtcgcggcggttgtgttgggcatcatcgatacagtgctgcagaactttggcactttgcgaatggttatctatgcgctggcactcattttgctaatggttttcaaaccagctggcttattaggccattatgagttgtcgttcaagcgcaagcgccagattcggaaaggagcagcatcatgacgcaacaattggtaattgatcacgtcagtaaagtttttggcggtttaaaagccgtcgcggatgtcacgatgacgatcgaacaagggacactgattgccttgatcgggccaaatggcgctgggaaaacaacattgttcaatatgttgactggcgaatctgggccgtcgtctggcacgattaccttgtatacggctgatggaccagttgatattacgaaaaagaaagcctatcaggtggcgaagctcggtgttgctcgaacttttcaaaatattcgcttgtttggcgccatgacagtcaaagaaaatgttttagtggccaggacacatctttatcgtgaaagtttcattggcacgatgctgcggttgccgcagttttatcaacaggaggcagccgtagcaactgcagccgacgaattgttagatttttttgagcttgctgatgtggccgatgaaccgactgctagtttgccatatggtacgcaacggcgggtggagatagtgcgggcagtggccacgaagccgcaactgctgtttctggatgaaccagttgccgggatgaatccagaagaaacggcagatctggggcgtttgattactcggattcgtgagcattttggcatcacggtggttttgattgaacatgacatgtcgctggtgatgaaattggctgagtcaatttatgtactcgaccatggcgccatgattgcttctggaacccctaatgagattcaaactaacgcgcaggtcattagtgcttatctgggaggtgaaaaccatgcttgaggttaaacatctcgttgtgaactatggtggcattcaagctgtcaaagacgtcagctttagcgttcaaacaggtgagattgtcgccttgattggcgcaaatgggtgcatttggactgaaggataagcaagctgctggcgaacaaataacgatggtctatgatcgttttccggtgttgaaggagcggcaacatcaagatgccgcaacactttccggtggtgaacagcagatgttagccatggggcgagctttgatggcaaagcccaaattgctgttactcgatgagccttcgatgggcttggcgccgattttcattcaagagatttttgacattatcacgaaaatcaacgcgcagggaacaacagtgttgctgattgagcaaaatgcacgccaagcgttggccatcgccgatcgcggttacgttttggccagcggcacggtcaagctgaccgggacaggcgaagagctgcttgccgatccggctgtgcaggcaacttatctggggatgcaagtgccttagataaattagtagttaaaaaggtgccaaaaaggctaaggtaaaaattcctgccgtgccaaactccgcaatctccggccagctggggctggaacgctgtgacggcgcttcgagcccaaagaccggtctcgaagtcgcctaacaacatcagcgacaaagcccagtcgctgtgttgtttgcacggctgagccccatctggcctacgattgctccgccttggcactgggatctttaaatgttctcaggttatctatgactaagaagagaacggtttttgcgcacatgcgggaaaccgttttttgttgccggctgtgagctgcttcaatgatcttttggttagaagagtcacaaaacaaaagattctggaaagaatcgttttagtaaaaaagcgttgcgctttgtaaaagataagcgtagcattttgctcgaacaaacgttcttgaaaggaagctaatgtctttgaaaacagcactcttctttatgatggatcagtatgcggattgggaaggtagttatttggctagtcagctcaatcaaagcaaacagtggtcggttaaaacagggtcggtggctgaaacggtctcatcgttgggtggtttccaaactcaaattgattatcaaattgacaatcaattaccccagattgacttgctggtacttataggcggcaacgcgtggtcaacggaaaatgagaatcttagagcgctagttgctagtcgattaaaacataatcaaccggttgccgcgatttgtggtgctgtcgattatttggccagaaatgggttgttgactggatatcgacatacaggaaacgcacaatatctttggcgtcaagacaaagaatatgtcaatggtcaagattttgttgcaacccaagtagtgacggactgtaatcttgtgactgcgaacggcactgctgctttggcttttacaaatcaggtattaaaaatgatcgcgttcttgccaagtgcggaagtggataaggcaactgatttgtatcagttgggtttttatcagtattgtaaacagtagggcaatcctttcttttaaaggatgagttcatctgttgcgattaaaaaaagggatgaaacatttggatcgcctatatcaatgtgaactgacaaatttctgccttattcggtatcagcatcaattgctgatgatggcaaagaatgattctgagttcgagccatcgttgacttttcccggtggccatgtcgagcctgacgaatcgttgacggcttctgttgtgcgtgaggtgaaagaagaaaccagcttggatgtcaatgatccgcaactttgcagtatcgttaactttgtcacaggacccaaaacgcgtgagttcatctttgcgtatgccacaactgtgtcacaaaaaatgacgacccaaccgcaagtaggtaccaaagatgaaggcaggactttctggatagacattgatcaaatcaaaccgagtcaactgaatacggttgtcgcagatgtgttgcaagactatcgcagtggtattgtcagagaacatgattatccacttgagaaataaaacggcccacgtcattttgaaaaatggaggcttttatgaatctgaaggaccatcagaaatggttaattgatttttatcagcaacgccattggtatcaatattcaccgttcattcggcttaattttctcactgaggaaactggcgaattgtcgcgcgccattcgggcaatcgaaattggtcgtgaccatccaggcgaaaaacaagcaggcacatctgctctaagggctaacctgaccgaggaattagcggatgtcttggatcaggttctgattatcagcgctaagttcggtatcgatccggagacgttgcttgcccaaagtgaacataagttgcaggcgcggtttaaggatgaacttaaacatcggtcatgacttgggtcgaggtcgtattaatccaaacaggttgaaacattattcacagttatcgaaaaaaggtgaggttacgtcataattctcatccaacaattaaaaaggaacacttttccaataagcggaaaagtgttcctttttgccttctcatggattatttattgcgattttaaagatcgcagtgccaaggtggagcaatcgtaggccagatagggctcagccgtggaaacaacacagcgaactaatcttagattgtttctggagctgatgttgttaggggacttcgagaccgcgggttttgcgggcttgaagcgccgtctccgcactagcttcgcgtcgcaatccccatctggctggagattgcgaagtttggcacggcaagaaagtttcagccttaaggattctgtccggtatcgcctggtgcttgtccgacgcctcgaccactaccgccttgccctggccgaatgccctgttggttcggtgtagcgaccatgtattgactgatcaagttcacaatctgtcgattttgcggtagtgagctgtgacccgcttcgtcgccggaaacggtgatctgggtgtagtgcgcgacctggttttggaaaatatatttaccagcttccacactttcgattgggacggtgccatcgccgtccagattttcggtaccagcaattgagtagacagtcaagctgctaggcaacttgttgcggctagtaatgagatcgttcagcatttgtgttcgattgtcaggattgctttcttcaaggttgtacggcgttccaatggtcatgaggcgtgtcatccgcacatcagaatcgctgtaatacttttcgagaaaaagggtgaagatcaagccgccattactgtgaccaataccacgaaaacgattgaaattataggttttcgccaattgcttaaaggcaatgttgaaccacgccgcctgtttcttgatgttgttataaccgtctttattgttttcgaatgcgacaacgatgtacggctcggtatcacgtgctgcgattttgccactgtaagttagtgtaccattcgttttgaccgtaattttcagcaaactatggcccgttgtttgggcgtttagctgggtgatcaaggtgttgaaccgatcttctgttgctgaactcccaggaatcaaaataatcggttgcatacgggagttgtgaacaacgcgagcagatttaacgttttgttccatccagctggtagcggggagcatgatagccgttaccgccaagacactgaccagtaacaacagccattttcgccagtgtttaatcatgatgaccaccgacctttgctgattcaagattgattgtttctgctagtcgcacaaatgggatatagataagaaccgagattgctaagcagaggatagccacgagaagcgatacccaattaccattggtgcctaggaaggctgccaacggtccgggcgttgtcgttggaatcgtataaactgacggtggcataagacgcaagcggatagctgcccatgcaatcgtcatattgactagcggtgcaatcaagaacggcacaagtaaaatagggtttaacatgactggccagccaatcatgatcggtgagctgatattgaccaagctcggcaaaagcgacatgccagctattcggcgtaatggccgggttttggcaacccaaagtgtcgcaatgatgagggctaaggtcatcccaacgccaccgaaactcgcgaagggatggtaaatggtgccaatggtgatcgggttgggcacattgaacaaattgttgtgctcaagcgcataattcaaattgacagtgctggtcgtgctaccggcttgcactgttaacggattaatcggaccttcaataccagcccaccacatgagggcattaatggtggtgaccaaggccaatcgaatcgacacgtgactgaggctggaggcaggtatctgaaatggaatgtagaaaagcccgatgaaaccttctgtcgagatgcggctgaggctgtaattgatcgccacactgatcactaggatcacgacagtaagccaggtgccacgcagcccacggtcaaccaaggcagcgattgtataccgatgcgttggttcttcgaggtccgcacgtgtgaagcggaagagccaaccgataagcaagccgaaaaagatagcaataaacaaaccacgataaccaaaattattcatttggaaaggtgattggccattgcgtcgtgaatccaaattaagaatcataaatgccccgacactcgttaaggctgccaaagaatcatctttgccataagatcgggcaataaatttggcaacgaaaaacgccgccataaccgccatcagatcgagagtcactgtttggatcgacatcaaaatggtgcggatctggttatagtaaggaatgacggtgtcaagatgataaatgactgcaaaaaagccatttcgtgaaaacacactctgcgtcaacatttgagcccaagcaccgaccagaataaacgggaaaatgacggcaagggtttgttggagcgcgcgataaatgcgggtgtgtcgcaaccgaacgctattgttaacgagcacgggcagcaatctctgcatcagattgctcatggctgccatctccctttccaattttttaatggcgcattatcaatgctattctaacaaatattaatatcgccgagtagttttcgtattgaaaagaaagttaaaacaatgatgagacgccttatgaaaggtcgagttttacgatttctgctttcgataggcctccatcttggcgtggaaagtcgcttccgtcacgccataggccgcaaatgttaccgcattagcgccagcttcgatcgtggcagtgatctgctcatcggttttaccgccagaagcaataatcgggaaattcgggtgcttgctgtcaatggccgcacgaacttcggccacaagattggcggtttctttgccaccagcaatgttaaaggccgcgacaccggcatcaattcgggcgttaagatcatccatatgacggacaatggtatagatcgttggaacgtccaccacacgattgacattgatgagcgtttcaatcggagttggcgcatttaacacaacggcctgagcaccgctttcttccgcaaaagcgccaatggttgcggctcgcaagcccttggttagcccgccgccgatgccagccagaatcggcacgttagccaccgttgctacagcttggagaatgcgcgtattaggtgtccacggatagacagccagaatcgcatcagcatcgcaattcgcgatcacagcgacgtccatggtatagatgatactgcgaatttttttaccaaaaagcgtaatgccactggccgctttaatcgctgaaggtgcttgaacaatatcagtgcggagcttagaagttaaattcgggggcatgttcgtcatggaagtacctcactttcaagaaacaatttgattaactttattataatggatgagattaggtgaaggcgagaaggacacctttatgactgtttcgccataggtcggatgtcccgaagccttcgagtttgctttaatcaactgccttgccaaaacgcatttgcaagccacaacttggcttaacggtacgcgtactcatgatctattcaaccctttctatgcacgattaaccataccatggtattcttaaggcaatctgatgaatgcgtcatttggtaaccgtattcatcttctgcagataagataagctttttggctgcgatcagaaggctatttatgacggaggcgtaaaaatggcaaaaccattggcaaagtacatcgatcatactttattgaaaccggatgcaacacaggatcaaattgatgaagtattggcacaagcaaaacagtacggttttgcatcagtttgtattaatccctattgggtttttcgggcggcggctagtttgcgcgacacggatgtgaacgtctgcacggttatcggctttcctctcggggcaaacaccacccagacgaaggttttcgagactggacaggcaattgacgaaggtgctcaggaaatcgatatggtcctgaatattggcgaattgaaggcagggcatgacgatcatgttcgtgctgacattcaggcagttgctgatatgacccatgctaaaggtggtttgctaaaagtgatcatcgaagcggttttgctcacggatgatgaaaaagtcacggcttgcaagttagcagctgcggcgggcgctgattatgtgaaaacatctactggatttgcagcaggcggcgcgacggtgcacgatgtcgctttgatgcgcaaaacagttggcgataaactaggggttaaggcagcgggcggcattcacacttatgctgaagctaaggcattgattgatgctggcgctgatcgtcttggtgccagtgcagggattcaaattttgaaggaagcaggcgaagcataagatggcatttgatcgcattatcacgattgtgttggattcaatcggtattggtgaagcacctgacgccgctaagtatgatgacaccggcgctgacacacttggtcatattggtgcctattttgatggtaaactggctttgccaaatttgcaggccattgggttgggtaatattgctcgaccaacaccaattgctggcgtgacggcgttaggtagtcccagcggctattttggcaaaatggccgaaatttctgcaggtaaagatagtatggatggtcattgggaaatgatgggtttgcctgtgacggaacctttaggctattttcccaaaggttttccggctgagttgattaaacaaattgaggagttttccggccgtaaagttgttttgaacaaaccttattctggcacagaagcgatcaaggactatggtgagcaacagctgaaaactggcgatctgatcgtgtatacctcaggtgattcggtgcttcaaattgcggcgcaaacggatgtcattccacttgaagaactttatcgcatttgccgttacgttcgcagcatcacaattgacgcaccatatcgcattggtcgggtgattgcacggccatatgtcgggacagaccccactacgttcacgcggaccagtgaccgtcatgattacacacttaagccagataagccgacagatcttgatcgccttcaaggtgctggcattgcgacttatggcattgggaaaattaacgatattttctctggccaagggctagatgacggtgttcataccactagtaatgttgatggcatggaaaaaacaattgaagcagtcaaatcggaccgccgcggatttattttcaccaatttagtggactttgatgcgatgtatggccatcgccgtaacgcgcaaggcgacggggatgctttgatgactttcgatcgacaattgggcgacttaatgacagtgctacggcatcaggatctattgatgatcacggcggaccacggaaatgacccaaccttccgcggaacagaccacacccgcgagtatgttccgttgctagcctacagcaagcaattgccgggtaatggcgatttaggtattcgttcgccattttcagatcttggtgccacgattttagataattttggtgtcacaggtaatcaagttggccagtcgttcttaaagctgcttaaataaacccacattttgaaggagaatcattgtcatgagcacacatattgatgccccaaaaggagccattgccgacgtcgtcttattgccaggtgatccattgcgagcacagtacatcgcggaaaactttctggacaatgcccaacgttacaacacggtgcggaatgcatttggattcaccggcacgtttgaaggccggcgcgtgtcggttcaagcgaccgggatgggcattccttcgatctcaatttatgttaatgaattgattcaagactatggggttaaaacgctcattcgcgttggcacagctggcggcatgggcgaaaatgtcaaagttcgcgatgttgtgctggcccaaggatcttcgactgatagcagcattatcttgaatacgtttggcgcggggctttattttgccccactagccgacttcaaccttcttcgtgaggcggcaaacttggcagatactagcgcaattcgctatcatgttggtaacgtgcttggcgaggatcgcttttataacgatgagatggatcgtcaaaaactcattgattatgaagtgctggcgactgagatggaaacgccggcactttatctacttgcggctaagtaccatgtgcacgcgttatcgatcctcacggtttcaaatcacttggttacaggtgaagaaacctcagcccaagagcgacagaccagctttaatgacatgatcggtctggcactcggtgttgccaaaacagttcctgatcgttagataacgcatgaaatctagttataccaaggctttggcgccgtgaattttacagttgaaatatttttttaatgtgcgtaccagtaggaaacgtgttattctgtatatggtttcttaagaaatggtaaacgcaagtaaaacgcaatttttgaaaaaattcagttttggattggaggagtacatacatgatagatgcaaagaaagtattgtcagttacggcaggattcgttggtgctgccggtttggcaactttagctaccggcgctaatactgtttccgcttcaacggggacagtcaattacaaatcgggtgcgaccaccgtatggaatagtccatcatggcatcaagtaaaacgctatgtgacttttggtgacaaagtacaagttctaggtcaaaaagttgaccgaaacggtgctacttggtataaagtcggcgacaatcagtggatccctggcatttatttgaattttgacggcaagactgtcaccgttcaagcaccagaacaaactgccagtcaggcaccggttagccaagcgccagctagccaagcacctgcaagtcaggcacctgcgagtcaagcagccgcacagcctgatacccagacagcaaacattcagttatatgttaaaaacattggttctgcagtcacagtttgggcaacaccagcgtacagtcaggcaactggccagtatctggaaggcaaccagacgttgacggcggttgcccagttgcaagccaatggcgaaacatggtatcggttagcaaatggcggttacgtgccagaacgttttgctagcacaacacctgcaccagcaccgcagtcatctgctgcaacgagtgttgcggcaccgactgcgcctgtatctgatgcaacggcttcgaacgcagctgcttcaaatgccgccgcttcggatgctgctgtctccagtgctgcagcgtctagtgccgcggcttcattagctgccgcttcagaagctgctgcggttgcgaatgcttctagcgctgctgcatcttctgctgccgctgtagcgagtgctgccgcagaatccagtgctgccgctgtagcgagtgctgccgcagaatccagtgctgctgcagaatctagtgctgctgcatcaagggctgctgctgattctagcgctgcagctgtgcagactacgacgcctgagtccagtgctgcgcctgcaacgacacaggttgatgcaactcaggaacagcaacagcaggcagaaccaagcaatacggtcaatgccgaggaaacgacaaataacgcgacgcctgcaccaacgccgacgcctgcaccaaccccagccccagctcctgttacgccgtcacgtcaggcaaaaattcaggcggttatctcaattgctgaacagcaaattgggaaaccttatgtatggggtggcaagggtcctaacagctttgactgctcaggcttgatgtattatgcctttttgaacggcgccggtgttaacatcggtggttggacagtgccacaagaatcttctggtcagcaagtctcactgagtgcacttcagcctggtgatttgctcttctggggcggacatggtagctcttaccacgtagcgctctacattggtggcggtacaatgattcaggcaccacaaccaggtgaaaatgtgaagtatacggcattagcttacttcatgcctgattttgctgttcgtccttcactataaggataactaatggctaaaattaaattggaacattctcgcgagagggtgttcctttttttgctttttttcattctggggcaaaaaatatcctgcattcacgggatatccagtacgattcaacgattgatagctatcctaatcatcatagtccggacttttgatcagttcagatggagcagtctttgtaggggatttaaagatgtattttgcaatggatggcgaaatgttcttggctaaggcctgtccccaattttgtgagatctccagtaacgcaacatcatgtggttgagtcgagatcaatgacagaaaatgtccggttcactagcgattttgtccaagctgttggtatgtaaagctataaattgttgccgagctttttcggcacttccttagattgatctgctgtttgaatatttggtccctagatagacttgcaggcttggtagctatcctatagacaatatacgatgggcggccgcttttttgttgctttaaattttaacgttgataattgctgctttttcgtcgctagcagtgtcaaaaaagccaaataacgacgaaaaaagcggattttgctacgtttattttttaacggtattgaacgacatctctctaagcaagtgagatacctttagatgcgtcagcttttttggagtggggggataactgaggacaaatagaaagctgaaaagcacaaacagtgcactcaataagtgtgcactgcgttttggtctggtgagcatcatgcaagcttttgtagctttagctcaatgattacttaacccattttgcgattgactgacctacttggtaccctgcatcaaagataccggtgaagatacctttcatgatgacctcgactgacaaatcgccgccaacaaccgacacttgttctgtgtaggtaagttcaggaaattgattcaaagctttttgattcattgtggcttcctccatttatcgtgtctatttcaaatgactagctatagagctacctttttgataacccacatgaaattaagtttgcaagacccccgtgccaaactgccaaagcatcaagatcaaaagacgggcaataatggccaaagggagcttctttgcgagaacgcgaagtacgaattgctttggcacgttcaccacttatttatacagttgcaggtttcttttcttgcgtcatgccatccgtaaagccagagaagacaccggacagaaatacagtgaggcttccaatgatgacgccggtagcgacaacaccgatgccgccttgactttctgctaattctgaatcatcgatgcacgaaaagtttttaagcactaagttattttccaacataagtttcagctcctagtattttttgaatgtttcggcttactagaaccacggcgattgtccataatgcccagcagtgcggaaaccattgctgaggtagcatcggcaattgccatgtagtgtcaccccttcgtttgggatagtacaagaacacatatgaaaaagtgtgcttagtatgtcacggttgaaggggtcaaaaatgatttctctttcctctccttcccgctaattgccgtagatctgagacaaaactatctaggtgctagcgaccctgtacataatatacaagtattaggcgatttataggcagcagagaaattaacgttgcgttattcgggcttttcgtggcttatttagccataagtttcaaaatgcgacgaaaaaagacgattttgcaacgtttattttttgctgttgattaatatgtttgaaaatagacattaacggtaggattaaaaattactcaagattaaaaacaactttagccacattcagtgattaaaatcgaaaaaaatcatcagtttctgaatcgtgattgcggctcagatagcacttgttggccggcagtttcaaggctattttgtttggctgcttcaagctcaattttcgtgggcaaatagtttcatgcgcttgatcagacgcgaaagtgactgggtgacccgtgcattggaaaagtcagggaaaaattttcagacgtcaagcaaaaacgaatgacctcctctccttatacaggggaaatcattcgctttttggtttttatcgggtaatgactgggatttatgagtggcgcacggcaaggaacttttttgcccttgcgctttttcccgggttattcggaacctaacaaatcataaattccaagaagaaattgttgctcttagataatcgtttgcaattcagctgaattaagccaccggtgttttttccatttcctgagctttggcaacggctgccatggcgacggcgttgacccagttgattggctggtcaaagtttggctggaagagcatgtcgaccatggccaatgtttcgatcgtcatgtgtgtttgaatcgctaaggagatgacattggcactttggctgatgtcatgcttggaaaagaaggccccgcctttgacttcgtgcgttttaggatcccaagtcaagctgcaaagaaccggcgtggtggtcagcataaaatcaggtcggtaatcctgctcaatggtcacgctggcaacctcaatgccacgggctttggcgccttcagtggtcatgccagaagcagcaatggcgtgttcgaaaagttcaaccgctgagcttgattgggtaccgagatacttttcggttggtttttcaatatttttgccgactaaaataccttgacggacggcattggttgctaacggaatgtagtcatttttgccagtcgggttgtaatgcacggtagcagtgtcgccggctgcaaaaatagcaggatcgctagtttgcatataggcgtcggtgatcacggcaccatttggcaaggtctccaaatggtctttcagcagttccgtgtttggtcggaaaccggtacacaaaacggcgatatctgctgtatagctgcctttgtcagttgtaacggtcatctcaccatcagtgccttgggtgaaaccggtgaccatctcacccagtgctaaattgacgccatgatccgtataaagtttttctactcgatctgtaatgttagcgtcaaagtttttcgccaacacacgtggtaagccatcgatcaaagtaacttgtttgtcagttagtgcatactgttcggcaagctcggcgccaatatagccggcaccgatcacgatcgcacttttaatggtcggagcaagcgcctttaaagccttggcatcatgccaatttttgcaaagatgaacatccgtgtcgtgaatgcccggaatgtttgggacgatcggcgtcgaaccagttgtgtaaaccaatttgtcatatgtatcagtggtcacgttgccggttttgagatccttgacttcaaccgttttcgctacaggatcaatcgccaaaacgtcatgctccatttgcatgttagcacccagcgcagccaatgcttcaggactggaataaaacattttttcggggtcactgacatgatcaccaacccacaaagcgatgccgcatgatagaaatgacagattatgattacgttcgtacacggtgacgtcataataaggatgctctgtcagaatttgctgtgtcgcgaatgtaccggcatgggtcgcaccaataacaagaattttcattagttaaacactccttcacaaattgataaccttttcacaaagaaagtgtaacataattggttgtctatgactagattgtccacggctaaaattgtgaaatatttattaagaaacgctttcaaaaatattgcaaaaacgctagcaaaaaatcgattgccagctttgcgacaatcgatttttcgttaacgttgagttgatgtttgtaaccagcgtccgataagttcgagatgatgcataagctgatatttacgaactacaccaaggccaggaaaatgatggcgattggccgcatccatgaaggcgacagtcccagttgtttgggcatcgagatgaaacggcagccaagctgcgagttgggccaagacttcaaaaaacttagcttgcggattagcaaaatcatcattattgaccgacacaaaatgatgtaatcgtaacgtgccatcttcggcggggtaaacaagatggattgcgatggcacgttgcggataaccatgctcgaaataagcgctagtcgcgagcggtagtcagcgaagccaataccaggcagcgatggtggcgcgtattgatagaattcgtcttgcaagatgccataatcatccgtgtatggataaacggtgaaatggtcattgagatagacggcatgtggtaaggccaattggcgaactcgtgcctcgtccggcactagggctacttggcgctttggcaggagtttcgcttgggcagctgttgttgcgatcaccaaggcagctggctgtgcatcaaaaatccgagcgggttgcacggtatgactcaaaacagcaagatggcgcggtgccgctaacaactgatagttgccaacttgcggattttgaatcacatagccgggatgtgctgcatgggccattgcgctcgttgctttcgtgacgcccgcgatatctttaaccggttcgatgataggcgttacagtgttgggcaattggtggtcggcaaccagctgcgtcactgcagccaagtcgtataatttgccacgaataatcggaaaatagttcattttgaggtgtccattttgacggtagcgagttcagcattcaacgcgtcaatctcttcttgtaaggcattgatcgtggtattgtcgagctccgaaacaaactgatcataaagattcttgtcaggatgataaatatcgtaatcggctgagcgttttttcagttcagtaaatagatcggcttctgagaattggccaaggcccttggcaacttgtttggccttgactacttcgcgattgaggctggcgatgaaatggtcggtcaaagtggcttcagggacttgcagttcttgacgtcgagctggtttggcgatcgtcaaagtaccgggtgttaccacaggaacagcgctggctgcgattgcggctttagagaagggatggtaggtaaaaacaccaatcccatgtggaatttcactagccaccgccgtgtacagtcgttgtggcaagacaaaatagttgtaatgaccgataaagctgagtttggcgctactatggaagtcggctttggtgactttgagctcaaaacaacgccaaatggtcgcgtcttgctgcttttggcgaaccagggtatcgacaattccgcgatcgtctggcatcgtcacttcttcaaccacggtggccccttgttcttgccagtaggcataaagcgttttttctaaatcaagcgtgagctgtgttttcatgatgggcctcccagaaatgcgtcaagagttgagctaattgcgttgggttgtagctgacttgggcgtgggtccagtgatctggaaaaaggcgggcataacgtggggtaataaaccgttcgtcaatcagcagaatgaccccgacgtccttggtaccgcggatgacgcggccacctgcttgtaacacgttattgaaacccggcagctgataggcatatgcgaatccttgaccgttcgcccgatcaaaataggcccgcagttgatcggtttcagcattgatacctggcaaccccacggagataattgcaacgccaatcagtcgatttcccttgagatcaatgccttcagcaaagatcccgccaagcacggcaaacccgataatcggttcactgccagtttgaaaatgatctagaaatgtttgccgatccgcttcagtcatggcattttcttgagcgcaaacctttagatcgggattcgccgcagtgaaggcttcataggccgttttcaagtaggcataggatggaaaaaagaagagataattgccgcttttggtgcgaactaatgttgtcaggctcgcaatcaactgcggcaaatcctgcgtgcgtcgtcgataagtcgtattgacactagcgtcaacaataactgcttgtttggcgggatcaaatggggagggcagcgtataggcgagactgttgtcgatcccgccaagcaacttttgaaaatatgccatcggtgataaggtcgccgaaaataagacggcaccacgcccttttttcaaggcttcgtccacaaattgcgatggatcgagacacagttctttaaccataatctggccgttttctttagtgacttcggttttgaatgtcgcgtcatagaagtcgccaattcgcagatattgattggctagaaaaaataccggcaaaacgagatcgacagcaggttgcaacgcgggggttggcggttcgctgagccaatcgtgaacgacttcggtgaagcgaaaaagaactgcggtgaggtcatcaagcggatcatcttgaaagatggtcggttgtgaggtcaacaaggttgaagtcgttgcatcaagggtattcaaaatacgtgtcatggcgcggcgaacttttgtcaacggggcacctttataaggggttagcgctttttttaactggacgaaatcttgatctgtgatggcagcggtgtacatgtcccgcgcgcgactgactaagttgtgcgcttcatcgatcaggaagaaattgctgtcatctttttcgctaaaaaagcgttgcaaaaaaaccagcggatcaaagagataattgtaatcacagatgatgacgtcgcaaaataggctggcatccagtgaaaattcaaatggatcgagcctatgtttgcgagcataagtctcgatgacgggacgcgtcagttgatcctcgtgttccagtagatcgtgtaaggctggttttaggcgatcatagtaacctaacatgtaaggattcttgctggggtcatcaggttcgtcagcaaatgtgatggtgtctttagccgttaaagtgatacttttggcggttaaacctgcttgcgccatcaaggccatcgcctgttcagccacgcgtcgagtgctttgcttggcagttaggtaaaaggctcgttggatcaagcccgtgcccatcgcttttaaggttgggaaaagtgcagagatggttttaccagtgccggtgggagcttgcacaaacaaacgtgcttggctatagatcgccttatacacagcggcggctagctcatgttgaccagctcggaattgcggaaatggaaaatcaagctggtcgatggatgtgttgcgtcgtttgatgatatcactacgtagtttgagccagtcgcgaaattcttcaagtaaatcagtgaaatcatcagccaactcggcggcacttttgacttcactgaaacggctgactgtgtcggtgctggtctggacataaaccagcgtgattgttgcttgatccaaatgccgttgttcacaaagtagatggccataaatacgtgcttgcgcccaatagcggtcttttgtattttgtgtggcctcttcccatgggcgcgcactggttttgatttcctcaactgtgaggccggggtcatctgtccagacaccatccgctcggccttcgagctgatagtcttcatcgttcacggtgacggcggttttgaggtaaacttccctttcgtaatcggactcacggtgagcagcttgaagtttacgatgaatttggctaccaatgatggcggtgttatttgaattgctggtgattggattgaggtcgccggtgcgaacggttaactcaacgaactcacgaataccaatgcgattgtttgccatcactgcgcccccccttgcttgtcatggttagttattagtatagaacatacattctctatggggaagactggtgagtcagggtcatgcgccgtcacgctctagttccgcgttgcaagcctcatccggccggagattgcggagtttggcacggcaattttagcgtaacttttgaaaagtaaaaataccgggtgtttctttgcttttataaatataagaggcataataagggtgtcaagacatgacaaatacggcggcttgcaaacactgtcgatcggtaagccgcgacactgaatgagggacatagaaatgaaaaagactagtttttggcggctattaggcttaatgggtgctgttttgttgttactgacagcctgtggcaagcaggggacggctacgaaatcgtcttcaagtgcgccagtgaaaatcacctactggcatcggatgacggggacttatgataaatcgttgaacaagctcatcaccaagttcaaccagagccaaaagaagtataaaattgtcgcaacttcgcagggatcatacaacgcgttgcaacagaaaattatggcagccggcaaatcaaaaacgttgccgaccatggcgcagtcaccgtatacgaacattggcgactacgtgaagaacaagttgttattgccatttgatccagaaatgttaaatggcgcggataagttgagcaatgctgatttaaaagatatttatccaagctttttgtctgcaggtaaatatgagggcaagtactacggattgccattctcagtctcgacttcggtgttgttttataacaagaagttgatgtcccagtacaatatcagcataccgaaaacatgggctgattttgcagccgatcaggagaaactcaagggaactgatgtcaacgcgattgagttagatcaaagttatgatgttgcgcttgaggggatggcatatggtgctggcagtcaactaattacaccgaaactgaaggctaatttgaatgcaccgaagacattggcagctgtgaatcaaattctggatctgcgcaagagcggtgcgttgaaaactgctggcgaagatcaatacttcagtgtgccatttgcaaatggaaaagcggtctttgggattggttcttcggcaaccgtgccggttcttatccaacaggccccaaaggatcttgactggggtactgctgtgattccgacatacgaaggcaaacgcagcaatccactgaacggaaattacaatgttttgtttaaaggggcctctaaagcgcaacaagcaggcgcttgggcgttccagaaattcttgctgaagtctgaaaatgcatcacagtgggcgatggattctggctatgtgccggtgacaaaaacggcatctaacagcacgacatttaagaattatctacaaaagaacgacaagtataaagccgcggtctctgcagtttcacagagttttgcctcaactgtctttaccggttacaccgattatcgtaacgatttgatgagcactgtcgacagcacgctgaccaagaatgtcagcggcgaaacagcgtttaacaatttgcaaaagcagactgaaactattttaaaagaaaataaataactttatttaaaaaaagactagaaggcgagcgttgcttgccttgatggtcttttttagtttgcgtctgcttgctgtggtgggctatgatggtctgagcagttctaagcttttaaggagactgatatggaaatcaatgtacacaagtttcaggaagccattttagatggcagcttcgagcataccgagaatcatctgaccgctgcagcgttcaaaaaggacggcatcgaggcgggcttgacgaaggtgtttgcagacgtccgcaaggccatcgacaagcagcaactgattcaggccgacctcgtcatcgattttcctgagccgaccatcatcacagttgaaactggcatcatcaatctgccgtttgcgaatgtcaataaagtcacgaactttcttgaggcagacgagattgtgccggttcgggtctatttagtggtggcatcaccatttgtgaacgtgtcgggtttgagaatcgatgaaattgcaacggcagcggattatctcacaggctttgagacgctcaataagcaaatgaccgcttccgttcatgagaaacttgaccatattcaagaagaaatggcgaagcccaaagaaaccgcaaaaccggtgccagctaataagcaaaaaacaccagccaaaaagaccacgcgccggacggcaacgaagcgaacaacgacgcgcaaaacaaccaagaaaacaacgacagcggcgaaaacatcagcggccaagccagcggcagctaagaagccagcagccaagataacgaagcggacgaccaaaaaagcggcgcccaaaaccactcggcgaacaactaagaaataagctgctagtcgcatgctgaaaagagtcattccatttgggatggctctttttacataccaacaagaccatctagaccctttaaagcgaggggataaccatttgaaagcaaacatacgatgaataatattaacgaaatatgagaataacgtgtgagatatgaaaatcattttgaattgaaagcgattccagcatattcttaacttgttggtggaataggccaatcttgttgcagaaaccatccacaaaaggaggttgaagttttgaagaagcacgggtttcgattttggttactggcgattgttggactgctgggtatggtgttgagtctgagtcagccgcccaagcaggtagctgctgctgataacaccttgaaaagcgttttttcgattgatgcgggacgaaagtatttttccgcggatcagttgaaaacgatcattgatcgggcacatacagacggttacaccgatgtgcaggttttattgggcaacgatgcattgcgattgctacttgatgacatgagcgtgacgatcaatggcaaaacatatggcagtgatgtcgtgaaacaggccatacaggctggtaacaaagcgtactacgatgatccaaacgggaatgcgttgacgcaagccgacatggatgcggtcttgaaatatgcagcggcacgggatatcaatatcattccggttatcaatagtcccggccatatggatgccattttgacggcgatggcgcaactaggcattaagaatcctgcctttaatgggtctaaacggactgtcgatcttaacaatgacactgccattgccttcacaaaagcactattgcagaagtatgtgatgtatttcaagggtcatgctacgaccttcaactttggcagtgacgagtatgcaaatgatgtcgatactggtggctgggccaagttgcaacaaagtggcacctacaaaaagtttgtggcatacgtcaacgacttagcggcgatggccaaaaatgccggcctgaagccgatggttttcaatgacgggatttattatgacaataacaccagtttcgggacttttgacaaggatttgatcgtctcttattggacagctggctggggcgggtatgatgtcgcaaagccagaatttttgaccgataagggtttgaaaatcatgaataccaatgacggttggtattgggttttaggtcgcgtggacggcgatctctatagttacaaaacggcgctagctagtttagcaagtaaaaaattcactgatgtaccaggcgcttcgagtgccgtgccgattattggcagtgtgcaggcggtttgggcggatgatccgagtgcgcagttagacatgccggcgctgttgaagttgatggatcaattttcgacagcctatgcaccttacttagttcgcccagccgattacagtaaagttgatgccgctatcgctgccgtgccacggcaacttaatcagtacaccgaagcatcagttgctaaacttgatgcagcgttaaatgctgttgtccgcggtaaaaaggcaaccgatcaggcattggttgacggctatgcccagaccattactgtcgccatcaaggcactgcaattgcggccggccgattacacaaaggttgatgccgccattgcagctgcaaagaaacttgaccggtcacactatcaagaccttagtgccgttgatgcggcgcttgctgctgttaatcgtaatctcaacatcacccagcaagcccaagttgataccatggctgccaagattacagctgccatcgctgcgttggttctgaagccggtgccgcaacccgatccaaggcagcagcaagtgccaacaaaaaccattgtgaatccagaccggtacttaccaaaaacggcagaagcttccgggtgggaattgatgctagctgggcttgccacgatttttggtgtcattagcattgttttcttttggcggcaacatcgcatggccatctaattcctgacaataactgaaaatacggcccgctacgcatcttttgcgcaacgggccgttatggtgttgtgcgccaacaccatttcatagtgtcacgcaaggatttgatgaaattgtgatgtcattgagatgattttggctgttttgacaactacctcgtcagcattcacccgcaaaatactcggctagtaaggtttcgtcttgttatttagtttaattgagccgcaagtttacaaaataaaggtcagcggtctagataggtactgtataatgaacttgaaaacgacgaaaaagcagcgcaaaggcaaattggttagaaaacggcgtattagcggacatgaatgagatgatggggtgttcatcatggggttcagaggtttaacatgcggatttctgatctgaagcgcttgtttaaaaaaggagtgggcattttgacagaaccattatttttaaaaccatacttcaatcctaagatatggggcggccgcaaactcgaaactgagtacggctttgacattccagacggtaaaatcggtgaggcttggatcatctcaggtcatccgcatggtccggcgaccattgaaaacggtccattgaagggtaaaacccttcgcgaggcgtggcatgaagatcccgcttattttggtccacaacatagtcaggagttcccattgctcgtgaagattctcgatgctgaagctagtttaagttttcaggttcaccctgacgatgcttatgctgcggcccacgaagcaaaaggcgaactcggtaagactgaatgctggtacatcctgaaggcagatccaggggcttatttgatctatgggcatcacgccaaaacgcatgaacagctcaaagaaatgatcgaagccggcgattgggagcacttgttgcggaaatatccagtcaagactggcgactttgtgtatgttccaagcggcacgatacatgctttaaacaaaggcatcgtggcattggaaacccaacaaagttccgatacgacttatcggctttacgactatgatcggaaagatgatcaaggtcacaagcgtgagttgcatattaagcaaagccttgatgtgacgaccgttcctttccatgacccgaagctcgatatcaccaaagaacaagtgacaggcgggcaaatcaccacgtttgttaaaccgccgctgtcaccgcattttgccgtttatcgccttgatgttgatggcaccatgacgttcacccaacaagcaccttataccaatgtaacagtgcttgacggtgacgggaccttttctgcagacgggaaggattacccgatcaaaacaggcgatagtttcttgattcccaaccagatcaagacttgggcattcacgggcaaattggcaatcgtcacttctactccaggggtagacgcataaggttgcggatcatcaggtgcccaacatattcataacctagattgcaataataaagttaccacgtagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccagacctagaccttcagagcgaccaggaaattgagacttacattgaacaactgaataatcgaccacgcaaggtcttagactggaagacgccatcagaagtcttcatgggtaaaaagttgcacttgagttgacaattcgtcggttcaaacgagcgtcttggtcgcgattattccgccaaaccgtcgtgaatcttatctaggttccatttcatcatgctgtagtacgtatcgcctttggtgccttttgctgccaaagagtcagtaaagattttggcgtgaatcgataggccggtttctttagcaactttgttcatggacttcggtgaaacagaactttcgacaaacaaatgcttaacatcggaggctcgaattttcgctaaaaccgtctgcatctgctcaggcgtaccttgggcttcggtgttaatttcccagatgtaggccggtgtgacgtgataagccttagagaaatacttgaaggcgccttctgatgtaacgagcaaccgctggcgttccggaatatcaaggaactgagattgggcggtttgatgcagtttttgcagcttagcaacgtattgatctgcattcatctggtaataattggcattcttggcatctttttgcttcaacaccttggtgatggttttcacgtattgaatcccgttggccagatcaagccaagcgtgcgggtcttgttccttcgtattggtcgtcaggtacatcggattgaccccgtcactggcagcaaaaacgtctttgttaaaagctttatgcgatgtttgaactaactttttgaaccaaccatttccgccagtttcaaggttgaggccattgtggaagacaacatcggcttcactagtggcagcaacgtcggtcggtcgcggttcatattcgtgcgggtcggtgccgcgcttgacgatactatagagttcaatgcgatcaccgccgacattgtgcaccatgtcttcaagaatcgagttggtggtgacgacacgtaattgttggttagtacttgctgaatctttctgagtcgtactgcggttgtttacaaaccagaaaacccctgcaaccatggttaaaacagcaacaacactgattagaatctttttcatcgaacagcctcctcggcagtgtgggtagcagcagcggttttcttttctcgttgttttttactgaaactgaagaacgcctgcttcggtgagaagacgaaggaaatggcgaacaggaccgcagctacgagcacaatggccggcccggatgcccagttaaaggtgaaactgaagtaaagtccggtgatggccgagaaaacgcctacgctagcggacgtgatcagcatcgtttctaaccgatccgtccacaagaaggcagttgctgctggcgtaatcagcatcgccacaactagaatgatcccaactgtctgcagggctgaaacggtgacaagcgtcaacaccagcatcaaagcatagtgaatcatggtggtattcaagccatacgttttcgcaaacgtattatcaaacgaggtgatcagcagttccttatagaacagaaccacgaacaggatcacaattcccaacacgacagcggtggtgacaatgtcgctgtcgctgacggctaaaatgttaccgaacagaatatggtgcaagttggtcgcactttcagccattgaaatcagaatgaaacccaaggcatagaaagcactgaaaacaaccccgatagacgtgtcggttttgattttactgttggctgccacaaacccgatcagcaaagccgcaataattccgaaaaccgatgccccgatcatgacgttaataccgagcatataagcaacggctaccccgggcaggaccgcatgggaaatcgcatcccccatcagcgacatgccgcgtaaaatgatgaaacttccgatcaagcctgacatgataccaaccatgatggcggtgatcaacgcactttgcaggaaatcatattttcccaaagcggtaaagaattccattattgatgtcatacgcgcgcaccctcctttgccgtaaacaagacggacgacaggtcggctgaaaatgcccgttcgatattttgggcggtgtaaacttccttgaccggtccttccgcaacaatgccgtggttcatgaccacaagttcgtcaaaatattttgaaactttattcagatcatgatggaccacaatcagcgttttaccggcatcgcgccactgattcaaaatcgtcatgatctcttgttcacttttcatgtcgatccccacaaacggttcgtccatgatgataatttctgcatgttgcacaatcgcccgcgcaacgaaaacgcgttgcaattgaccacctgataactggctgatctgacgtttcttaaaatcctcaagaccgacttgggtcagggcgtcaagcgccgcctgtcgttcctttttgccaggacttttcagtaagcccaatcggccatatgtcccagtcagcacaagatcttgaaccttgatcggaaacgtcagatcaagatctttacgttgttcgacataagcgattgactgctgtacctctttgagtgtccggccggaaaagtcgaccgttcctgattgtaccttgatcaatcccaaaatagctttgatcaaggtcgatttacctgctccgttaggcccaatgattccggtgatcttacctgcgttaaaatgaacggcaacatcagcaaacaccggtgtgtcagcgtaggcaacggtcaggtccttaactgttaacataagagcctccaatttttagggtgacctaattcgctttcatcttaagcttacagaaaatttcaaatgctatcaagtgttttttaaggcgagcttaaaaaagctaaagaacatgaaccagtgactatcacgaatctaatgcttaaatggcttacttctcgacaactgccgtagataaaagtatgtaatcgcattcattcataagcgctgaacatcatcaaaaaagagaaccatgatcgagataaatgctcgctcatggccctctggttatcgcctagttattttaagctttctgggtgacgctgtaaataaatgacatgtgtgttggtaaattcttcaacaccgtgaataccatcggcgcctccgacaccagattgtttccaaccagcatggaagccttggatgccttcaaagttgaatcggttaatgtaggtctcgccaaactcaatctcgttagcaacatacgaagcggtttccagatcacgcgtataaacggagctggtcaggccatataccgtgtcattcgccatttcgattgcttctggaatgctcttgaatgtcaaaatcggtaacaccggtccgaagatctcattttgcacaatctctgaatcctgcgcgacattggtaatcacagttggttcgtagaagaaaccaccgtcaatgtcagctgggtgaccacctgtttgaatctggccgcctgcttcaaccgcccgctgaaccaaaccgtccactttatcaagggcgccttgattgatcaacggacccatttcggcatctggatcagtgttcggattaccgactttcaccgccgccatcttggccgtcattttcttaataaactcatccgcaacatcttcttgcacataaatccgttcagcgttgttacaaatttgcccattgttatcaattcgcgagtcaaaaatggcctgcacagctaaatcgatatcagcatccttagcaacaattgccggtgccttcccaccaagttccaatgacatctttgccacatgattcgccgcagctgccatgaccttcttaccggacgcggtggacccagtcaggctgataatgccgactttggggttcttcgccaaatcatccccaatgatggacccgcgaccactcacaaagttggctacccctgccggcaaaccgacttcatcaaccagttttgcaaatgccaacgccagtcctggggtgtccgaacttggtttgatcacgatggtattgccggttaccaaagctggccccattttccgagcaatcaggaagaacgggaagttccaagcaataataccaaccgcaacaccgattggctgacgggcaatgataatattttcgttttcattgtcagattgcatcacatcgccggaataaacgcgtgcggcgttggccatatagtcaaaataatccgccgaaaactcaatttcggttttcgctaaggcatgaatttttccttgctccaacatcagaatcttcaccagttcatcttcatgctcacgcactaaagtagcaagcttgcgcaagtacgcaccacgcgttggagcaggcacgcgccgccaagcattcttagccgcccaagcagcatccacggctgcgcgggcttcctcaattgtcgctgccggtgctgtccacaatttcttgcctgtggaaggatcgatcacagtttcaacatcgcctgatgccgaatccatgaacttgccattgatatacatctgatagtgcgttgactgcaattcagccattgtgtttttcctccttgcaaacgtcttttctgtccgacgaacataagcaaagccactttgctcacgttatgtaagcgctaacttcatacatcttaagtataacgtcatcttcaggcaaaagacatgataattgcttgtgagttagcaaacatgaggaaataaaaaacacaaaacgaattcatcgccggtggcttcaggtttcaccaactggctttccgcaccccaggaatttgacctttatgggcgagttcacggaaattaagccgggacatgccaaacttccgcatataagcatgcggtcgcccatccaaaacgtcacgatgatgtaaacgaactgggcttgaatcacgtgggagtttgcttagaccaatatagtcacctttcgcttttaatgcagcgcgttttaccgcgtattgttgaacaagtttttcttgtcgttttgcttttgcaattttagatttttttgccaaaagaatgcctctttccttcactgatggtctttaatctcccgcaaacgagtcactcaaagtattcaaatgaccaccaattattgatacattaccgatttttctgttgcttacgcttagcatcgtgcaaaacttttaacgcccgttttcgggtcttaatgttgggactcttcatacgccgccgtgcactggcaagatctgtcttttccaaaaatgatcacctctttttaattcgtaatcattactatttaagcaacggcagtaaccgtatcacgactgcgatttatctgtcaattagaatttaagaacgacacttttctcaatttttttgaaaattttccttgccagaccgctcactttgctttatggtttaaatcgtaattattacgttttggaaggaagcgggaatttatgatgaagcgattacttgcaggtatcagtgtcgcattgctggcaatttttgcagtcgcatgcggtagtaatggtgccgcaaagcaatccagctcgaatggcagcaagattcaagttgttgccagtcttgatttttatggtgaggttgccaaagctgtgggtggtaacaaggtgtcggtgcagtcgattatcaacaatccggcggttgatccccatgactatgagcctactaccaaagttgggaaatcagttgcgtctgccgatcttgttgtcgccagtggcattggttacgacggctggatggataaggtcgtgaagtcggcggacaaatccaaaaattacttacgtgtcgctgacgatttgatgaataaaaaggaaggcgacaacgaacatatctggtacgatccgcgaaccatgccaaaactggccaataccttagctgataagtttgccaagaaagatccagctgacaaagcgaccttcaaggcgaatgcaaagaaatacatcgcttccctggacaatctcaatactttgatcaacaagttgaagtcgaaagtaaatggccaactcgttgatgtctccgaacctgtctttggctacgcgctcgattatctgggctacaaagtcaatgacgatcacttctcgaagtcaaccgaagacggcacagactacagcgcaaaagatatccatggtatcgaaaccgatattaaggaaaagaaaattgccttctttgtcaataacatccaagcaagctcaaagactgtcaatcaactcgtcaaattagctgaacaaaataatgtgccggttttgaaagtgaccgagacattacctaaaggcaaaaactatcggacttggatgaccagccaataccagcaacttgaaaaaattcaggatcaagcaacgaacagcgcaaaatagcatcacttctggtcacaggggtttatcattcccccaatgtttcggcaaagctcaccctctgtcgaagtttcgttaattgctttgatgacaagataaaccatatgcccgggccaacaacaccggacagcacttgaccagaaggaagcccgcgaagaaattcgcgggcttttttgatcgttccgcccacaaacaccggtgttacaataaagctgtattgggaacaagaaaggaagattcaaatggcaaatgtcatgatcttaggcgcacacgggcaaattgcaacgttggcgcggcatcagttgctgaaagaaaccgatcatcacctgagtttgtttctacgcaatgccgggcggctgcaagacgtcaatccgcaacgggagacggtgattgacggggatgtcaccgacaccgccaagttgaccaaggcgcttgctggcattgacgttgtctatgccaaccttggcaacaaggggattgaagatcaggcaaaatccgtcgtgaaagcgatggatgctgcaggtgtgagtcgattgatttggatttcgacgttgggaatttacgatgaagtccccggcgcttttggcaagtggaatcatcaaatgcttgatggtggttatcttgaaacctacgccgcagccgccaaagtcattgaaaattctgacttaaaatatacgatcattcggccagcttggctttccaataaaaacattatcagttatgaattaacggaaaaaggcgagccatttaagggcacagaagtctcccggcgcagcatcgctgacttcgtcgtcaagctgattaacgatccaagcaaacacatcggtgcttcacttggcgttgaccaacctaacacccaaggcgataaaccttccttctattaaagtaaccagtcatcggccaaatcaaaaagagtttatttccgtgttcatcactgggaaataaactcttttctgttgccatgccctttacttggctatcaaagtagtatctttttaaactcaatcaaactttgccatccagtgactagccgtatgtgcgtcaaatgccatctcaatgtcggccggcaaattgcgttgtagcgataagggcacctgaagcgcttgttctcgcgtaaaaagttgaacctttgcagtttcgatcccgctttttaacgcacgattctccggtagacaagcaatgaacattttgtacacatcttgcgaactttgcttggcataggcgtgcttacgtagtgcccgaactgccagtaattgttgcggtttcacggttaagccggcctcttcacgggtttcttttacagcaatttcacccgcactataacccaaatccgcccaaccaccggggatggaccatgtaccgcccgctcgttcctgaaccagcaatagttgatcgtcaataaaggtaaccgcacgaacatcaactttgggcgtcacatagccaaaatccgcatcgacaaacagctttgcttgctggtcactggcaccaagctttattgccagcttagtcgtcacgtcagccagttctgtataacgctgctgatcaaaaacatcctttgcgttatagttacccgtctgtgcaattgcctgcaacttggccagcaaagtattcaaatcatcttgatagggtgccaaacgatcgcctcctcacgtccaacctaacaaatcagcgcgccatcacctatcacaaccccgtcgatttgaaaaagtcttacgtttcaggtcgcctgacgctgtgtaacaaaaaaagcagtcatcaactgccttttgcgatcctatgtaacttgattgttacttcgagcttccgctatttgtcaccgcttgctgattgttcgcatagttgcgcacagattccggaacttgaccgccgaaagactgttgaccaatactgacggcctgcttaaagaaagcttgagcgcttgactgatagccttttccatcattgttaataacggctgtcaacacgtcacttgattgcttggcataatcaaccaatgtctttgccaaagcatcatcccctgaatcctgtgacttgttattatccaattccagccggatcttatcaagtttagagagactggctttagccgactgactgagggttttgttatcactttgcagtgagacctctgtcatcgttttcatcaccaagtcagaaatggtcgtataccgtttctgcaaagtctgcttggtaaaatggttcaccttaatcatcgtcgacccagtcgagctagacgactttgaactttttgactgacaaccagttacaccgatcatagccatcactgatactgcaataacaagccaccttcgcaacttgatccctccccaacatgatgacgaataaccgcatcattaaattaattcaaacataagccgttcgagacgtcaaacatttcaccagttatttgatccctttaaccaaataagctaagcatcattatttcgttatttttgtaagtattatctcacaaaaatcgccttactaagcaagggaatattcattatatttgttaatccgaataaatatccttatgttataattattttgttaaattatgactaaggaagtgccgagatgcaaaagcgccgccactcacaaaagcgtgcttcagtcttttttcttatcaccttgttgttgtcagttctggttgccttaatcccaccgctcataagcaagccgatcagtgtcggtgctggccagaatatcgcggtcaccggttttggtagtcaagatgctacgattactgacaccactgggaaagatttcacccacgcacccaatctttcgatgtatagcgtgtacacattaacctatcactggcgaattcctgacgaagtggtcgtcaaagccggtgataccgcgacagttttcctgccagcaacggttgtatcgcgagccgatgtggactttgcagtggttgatcccacaactggcgccacgattggccatttcttttccaaagcaggtagttcatccggcattttgaccttcacggacttcttcagccattcaacagttggccgtcaaggtgagcttcaattcatggtaagtggccgctatgatgatagtggtcatcaacgtccaggatggtatatcaacaaagccgggtgggttgtcaatccgccaacaggtgcaactccagaagaaaaagcgcagtatgttgatgaccttggtcgacccaaaattttccagtgggagattacgattaatccaaatatggaacatgtcgacaatgtggtgctcactgatacacttggtcccgggcagcattttgatacaagtcgtgggctggtcgtccacactggtacttacgatgacaactggttccatgctaccggtaccatcaccccaagctatcaagtgaatggtaaccaagtcaaaatatcgctgggaacgatcacaaccgccatccaaattgatttgtggactaatcccacctctgcaagtttcgaaaccacagattcttggacgaattcagtcgttgcttcaggcaagcaaggcggtaccggtgctccagcgcaagcaaacggcacaattacttggcgtaacggcggtagtggcaccggccaagttggacaggtcacgctaattaaacaagaccagaaaacacatcagcaggctctcgccggcgctgttttctcactctaccgtgccgatggaaccttggtacacgacgacctcacgactgatacgaagggcaagttaacctttactcaactcttagtcggccaatactattttgtcgaaacaaaggcgcctaaaggatacaagctgaatgcgactcacttgccgtttaccattacccttgataaaccgcaagtgacggtcaaggcctatgacgagaacctgacgccgccaccggtaacgccgtcgacgccatcttctgaatcttccagttccaaaccgtctgtaccttctagctcggtgacaccgccgtctaaaccatcaacaccttctagctcggtgacaccgccgtctaaaccgtctgtaccttctagctcagtaacgccgccgtctaaaccgtcgtcaccttctagctcagtaacgccgccgtctaaaccgtcgtcaccttctagcgagccttccaagccggctgcttcatcaacccctagccatcaggaaagctcatcttccatatctagcagtgatgtgatcccttcatcctcttcagaaagcgattcttccacaagcgtggaggttatcacgccaagccacaacaacacccatcatctacctgacacaggtgagcgtgttttaggctggctagccattgcaataggaagtcttttatcaattactggtatccttttattgattaaagattatcaataagcgcgtttcaaaaactgcagcatgacgatgaaatgaagccatcgcctgctgcagttttttgctgctttaaattttgcttgcgtgtacgccatgaatacgctacgcttacaaccgtaaccattacgctttccaacaaaggagcttttgcccatgttcaaacgattattgaccgccttcagcgtcatgttgttggcaatccttgctgtcgcttgcagcaccagcgccaaatctggcagcaaccaaaagattcaagttgtggctaccgtcgatttttacggtgaagtagctaaagcagtcggcggcgatcaggtgagtgtccaatcgatcatcgacaatcccgccattgatccccatgactacgagcccaccactaaagtcggtaaacaagtggccaccgccaacctcatcgttgccagtggtatcggctatgatggctggatggacaaactcgtgaaatccgaaagcaagtccaaacaatacttacgtgtggccgatgacctcatgggcaaacacgaaggcgataacgaacatatttggtatgacccacgcaccatgcctaaacttgccaatgccttggcagacaagtttgccaaacaggacccatccaaaaaggccatcttcaaagccaacgccaagaagtacatcgcctcactcgataacctcaatgctttgattcagaaactcaagcaaaacgttcacgatcaaaaagtcgacgtctccgaacctgtcttcggctacgcgctggactatctaggctacaaggttaacaacacccacttcgcccaagctaccgaagaaggcaccgattatagtgccaaaaacatcaacggtgttcaagacgatattaaagaaaagaaaatcgccttcttcgtcaacaacagccaagccagctcgaaaatcgtcgacagtctcgtcaaattagctaagcaacacgatgtccctgtgctcaacgtctctgaaaccctgccaaagggcaaaaattatcgcacttggatgaccagccaataccaacagttagaaaaaatccaagcaaaggccgacaaaacaaactagtctctctgtcctacccccccaaaaccacttcgtcttcaaaaatcgcaacttgcatcaacggatacctctctaaaagaaggtaaaaaatgcatggcctgctgttcattttgtgacaactgacatcttttcgtaaaatttttgcaatgaattcgttttcaaaagccctataccaattgaagttttgcttggcgactcttacaatgtagttgtaaacaggaacaactaataggggagatgttttaaatgtcactgatcaagcatacttttaaacgcgttgagcacatgatcgcagcaccacgcgatccccacgaagaagaacaagcccgtcttcaagaaaacctgttctatacgaacctcagtagtctgcaaccaaaaacgaacgctaagttttgattgaatagatatgaagtgaatgaccgcctcaacagcatgttgagacggttttttaatgccgtccattttgctttaagaatcaaaatgaccaccttgaggagcaaatgctcctcaaggtggtcaaaaaaactttcaggttatgttgttgagcctgtgacggctatgccaactgttttagctttcctaagttgttttcatacggttttttggcggtttaaaccacctccctgttgatacagacctttgtgctgccttctcatggttagtgcaatcccaacatcaactcaaccatgaagacttgtatgttctcttttcgagacatcacaatcatgaccgccactaaggccttcaaaacgcttttaaaccatccaatggtgtttacccacctctgtactacctcaagccatactaaattaatagcaggcaactcaatccaagggttgcacatatcaagccgctctcgctcccaaagcgaaaactcgtgtgatgatcaaagagcaacttacatctcaatgaagaatgctctctaatcaaaccaaatactagctgcagtgacatctgagccatcatcccatgtgatagtccagccgctagtgtaaacagctcattactttgcgtgacgatacttgcgaactccggccaagccaagaaccgcaatcacgacagcaccggcctcagccaaaattgcgcccgcttggctttcaccagttgcaggataggcatgtttgccattcctctgagcaacccgactcatcggctgactacttgaaggctgtgcggcaacaactggaataacagcagcactggaagtcttcgggttagccgcactcgatgctgaggaactggcggcactggacgctgctgaactgccggcgctggatgctgacgaactatcggcactggacgctgctgaactgccggcgctggatgctgacgaactagcagcacttgatgctgctgaactgcccgcactcgatgctgacgagctagcagcacttgatgctgctgaactgcccgcactcgatgctgacgaactggcagcacttgatgctgctgaactgcccgcactcgatgcagacgagctagcagcgctggatgctgctgaactaccggcactcgatgcagacgagctagcagcgctggatgctgctgaactaccggcactagatgcagatgaactggcagcactggatgaagctgaactgccggcactagatgcagatgaactagcagcacttgaagacgatgaactggtggcactggatgcacccgatgatgaggcaccactagaaggcgttgacggcttaggaccgggattcaacgcttcaacctgtttagttaatgcagcaataaatgaagccaaggcactttcttgttgcgtattgaaagcttgaatcttactgctattgtccttttcaacttgtgcttcttgactggcaaactgatcagctaattgttgaactgcattgttcaaggatatcttttgagtttgatatgtttggtcttgaccgtttttgagactctgaagattatcttttagagtttgaatcttttggtcaatttctttgttattgtcttggccagtagaaggcgttgatgtttgtgctggaacatataatatattcgaaccaggataagctttgtaagaaccattagagttcattacccaagcattttgaacagtattatactgaagagaaaagcccatatttacatcatcactaagaagaattccacgatgtccttgaccgctatcctcgtcaaagttaactaaataattaattgcatctgcaactccttgaaatacttccagcatagtttgattatttttgctatacattgtataagccgagaagtcaacagatgtcaaagtctcatctgctccgttactataattaaagatctgattaatgatattagggtcatgatttgtctcagaaacattgatcaaagtttctccacgctgttgaaccttgttaagaaaatcttgggttgtagaaatagctgttaaaccaatagacttacgataattattgactagcatcatagcatattgattcaattcatttttttgtgcatcagttaactgattattacctactacatctcctaaagaccatgatggaacattttcatttgattgagtgtacagattatccatcatgccagcttgacttggatctttgaacacgggaagattctgtactaaataattaccgttccaattgctatcgttatccttatgagtaacaacattagtccacaaaccatgctcagccacatagttaaacgtcccaccattttccaccggcgcatcaggcgtcgtccgctgtgcattcaaatcatcaatctgcgcagtcgcggcttgactcgcagctgcataacttgcatcctgttgagctttcagtgctgcgagactcgcagctgcacttgagctagcagctgccaaagaagcttgatcttgctgtttttgcgctgccgcttggctggctaagctgttggcataagaagcttctgcttcactggctttttgcttttcagcagcttcagagacagctgcgtctgatttggcttgagcatattttgcttgttgtgcctgccattctgcttcggtcatacctgatgaagccggcatgctggtgttggcattggcggcttgacttgctgcttgataggccgcagttgcttgttgttgtgcagctgccggactggcctcaccgttggctttagctgcgttggctgttgctacaggttgggtgtttttaacagcacttgcaggttcagtttgtgctgccgccggttgactcacttgtccatcttgggtgagtgccactggctgaacgacaaggtgcgtgtctgtttctgcagcattgacaggttgaagttgcgccaaggcaacaccacctaacgctaaggcaaatgcggaaactacgacccactggctgccgcgtttgtacatcttttttctatcattaacaacatgttctttaacccggttatataacatgttacttcctccaataccattaaaattgatgtcttttgattcggggcacaaatttcattatatatatttattaggtatattatgcctaggcaacctggtactggcctttcgttgctggcgttaccgatattgtgccaaaacgggcatccgcaccaaaatggccttgagccattggttattctctagtaatcgttgcatgtcgaaatggtgtcacaaaagtgtctttaaagtcacctgtcccttgaatcttttcaaggttacggtcactgattgacgcgctttgtgcacttacatactgccaaaagaaatcttgttcaaatgcttgtaacaatgacgcaacagttggtcctttctccttcaagcttgctggcagaatgtcccatctttgtgtcagaaacacttgcagtgctggttgccaccaattcttatagcttcggagaacaaacgttggtgccggaatacgatttggctcgtcaagatattgacgaatccgctcgatgacacttgctaaaataaattgtgtggacggtaataacgcaacctgcgcgccacttggtagtgctttgaatgacttttgcttatttgtcgccagttgataagcttccacactctttgcttgataactcgaagtgcttttaatttgtataaacttgataaagtcatctgcattttgcgttcgataagggactaaatcgataaattgaattggatagtgacttaaaatttgctttgcttcgctaacgggcatcgttgtgttagatttttcatctgcatcaaacaaggcccgaagcaacatcgaagtgtgctgcgcataccaatgctgtttatctcgctttgtgttctgtctcagataatccgttagcgtcatgtcgccagtatctgtctcgtttgttcggaagagctgttgataaataatattgttggctggcttaccatctatccattctgcatcctcctcatgcacatatttttgaatgttgacggagccaccctctctttctgcacgaatcaattcctcaacttgtccagatgctaccgctggattaatgttcgcgatgtaaatctgtgccttctgcggatcatgttcaatcggtccagcagggacgccatcataaatcgttgtttcggtttcattaaaattagctcttgcttgtggcttatggatatattgcgcatctgcttcaaatagccagttgaaggatagttcctctgccattgcttcttcttctttcaatttctcgtattcagcaatcttcttttcaagctcaggccgccattggcctttatcttcggtattcggttctcgatatggattcaaatttgctagcatgtctcgccagctctgttcgtctggtttcgtcatagaatcccctccattcatctaggtaaaataactatagtattttaaatgggcatattgcgcctatctaaactaaactaaaaaatttcaccagcaaaaaaggagactgctgaacaggtaacgattttcttgcggtttatgataaaaagtccggcagaatctgatttgacgtcagattttcccggacttttgtcgtatcagggttttccaccctcttacttttcgctcattattttcataattcgctccatattggcataaaagagcgtcatggcctcaatgctattagaccagcttattgatggctatgtttggttttgactgctgcattcttcgcgtcaattcgataccgtaacttgatgatgtcttgaaatgcttgagttgcctgaaaggtcctctgatcttgatgtgtttaagacttaatcgtgacgctataattttttgtctttgcgcctggttgataacacccttgctgccgtggacattcatgacaatgatgcgtgtcaaagtaataagtccggccttgatcgcagctcttatcttttttaccgtttctcgtgactcgcgagtccataaaatctgcagggcaaacaaacataccggcatctttgttgaagttccaagtctggactggagtccttgatccgttgagatgattagatagagctttgaatataactgaaagtgatcacgcttggcaagtttcagttttttccccagacgaggcgatgttaccggtcactttttcaaccctcacaacattttttctattttgattaactaggctttccagaaactgcccatcacattttgacataagagtggcagctcgtttcagttcagtggctgtcaatcaataaattgatgcgactaacaattagcactatgacatccttaaaaataaccgccatgaaatgcaggtttaacgctgctttttagataagtcttgaaaaatttcgacgtttatcggtaattgtacggcgttttaaaaataataacaaaaagctcgacatttcgtgtacattgtttgtaggaagctagccccctgtgttgtgagcattatgtcgaaaacaaacacgaggtgatttgtctaacattcaattattaacgaatactgaactctgcaaggtaaacggtggtagtaacgctcttgactgtgctgcaggagtcggtgctagcccacgaaggagactgattttttgaaaactctttccaagattgctcatatcgtcagtgccttgtcaggcgttattttagtcatcaccatcatttccattccaaaatacgacagtatggcactgaatgtgtttattctgacagtctcagcaacaatgattattgataactatagtcgagaatactaagacaaatttttaataaagttccattctctcagaatttcacaaattaaataccttgccactaacaacagcctctactttgcagcaattcgcaagcaaaacagaggctgttattttgcgggaaaagtgtaccttctgtctcaaacacatgtatggccatgctttggttttctgttgttaacgaaagaaaagatgtgcgatggcactttttattgataaggttaagtctcgcaaaattttcggctcacgcgacaacccaacagtgaggttgatatcattttgtctagcgacaccgttgaccaagacgtgatacctttaggggcttctactggaaaaaaagaagctgttaaactgcactatagcggtgatcggctggcacacttgccagttaggcaaaaagtatccctgaagtcatcatccccacaaccaccgctaccagccccgctaccaccgtgccaacataataaaagatcgccattgaccaccgccgatttttaatcaggataaacgcgtctgccatgaacgttgaaaaggtcgtaaagccaccgcaaaagcccggcagtaggaacaaacgaaacgccgaaagcgctggtagtccgactaaaagtcctgccagcaatgaacccagcacattgatgagtagcgtcgccaacggcttgccgggccagaacattttccctaatacggttataccataccggcaaacagcgccgaggccggctccgataccaattaagatcaccattgttttttgtcccttcttccaacgagtttcgaggccaagaatccggctgttgctgctagcagcccgcccagcagattgagcatcaacagtagtgtggcataaatcgcatgccttggtgccaaggtcgcaaagtccagcatgagcgtggagaatgtcgtgaaaccaccgatgacacctgtcccgagggcaagcaacagccattcgggcagatcgaatttcatatccaagccataagtggtgaaggccaacaaaaaactgccgattaagttcacaatggttgtccccatcatggttgtgccatcgtgggtcacgccactgatgacatatcgcaaaatgccaccaataaaaccgccagcaaagacggccaccagccaactaacatgtattttttcacgatgatgcatcatgatctcctttcgtgggaacgcactcgctgacgcagaaacctctgcataaacatatcaggctaagatctgtcactttgtcctgagaccatttatgctgcaatttttaaacgcaccagctcatactcaaaaaaaagacacctaccctgatttgctcaaggtaggtgtcatcaacttgcgtataggcgaacaccatcgccatttaatttattgaaagtatagcaaatgtttggtccgaacatcaacaacactgaacgtggtttgtgcatatcttgatacgtacaaaacgaattattattttgttcatatatacgtgatatattaaaacaatgcgtagataagaacattctcctgaaatctaattggtctctcaatggtaatgggttcatcctagtcgcacttacaagccaactgataatcgctttttcacatcaacaaccgcgctactgctggatcaagttcaattagttgcactgcacaagtatattgaccgcctcacgacctctaaggtataattacggagttgaaaagaggccaccgggcggcttcccgatgacctcgacgcagttcagatgacgatttggtaaaagctaatccttgaggttagcttttttgatgatcgcgtacgctttggccttactggtaatcagtatgctaagcgcgacgataatcgacgccacatccaacgcggcgaaccgctttcgtctcctgattttggcacggctatcacctccgcacttcaaaaaatgttgaggggtgtgcgccacccaatctgctggccaaagaaaaagggtaattactcctctctctaagcttgcttttagtctataggttcccccgaatgcgatcaataagaaaagttgatcttgcgtactcaaattaatcgtcctcttgcgccaaaaagaaaaaagcgtccgctctattcgtatagaagaacaggcgatgatgttcgccgcaaatgattgtgtagcaatctgatgacgtctactgaaacgacttttatgtcgcttcggtaggcgtttttttcgttgttaccgaaaggggaaatagacatggcaatttttattgatacggtaaaggctcgcgaaattttcgactcacgcggcgccttctctaatattgttttccaaacagaataaaaaagtaataacggtgcagttggtctaatgaattttatataatttacgttattttttgtcacgatccgggcaccagaattttcaaaaaatcagaaatgttgtatcgggttaacctcagtatcgttctgcaccagaataaatctaagtataacggtcatcaaaaagcaggccgtttgtgtaaaagccgaacgaaatgtataaaatgtaaaattattgtaaagttattgattcagatattctaaaaaagtatgatttgaatgttcaagtgacttgttcgtctcagttcactcttttgcgtcgccgagacaagcaaggttctgcttacaaatgattgattctacttttatggaggaaaactgatgaagttctggaaaagaattgcagtggctgggatggcaaccattgctgcgttatcgctagctgcttgtggtagtaagagtagttctagcagcacaagtacaagcaatagttacacccccaagtcattaaatattcagtttgtaccatcaagcaacgccaatacaatcgaagcaaaagcaaaacctctggctagtttgctgaagaaagagcttggcatccctgtcaaagtcaccgtttcgacagactacaactcaattgtcgaagctatgaagagtaaacaagtcgatgttgggttcttaccacctgatggttacgttcaggcacacgcgcaaaaggcagccgatgttttgttgatggcgcaacgatttgggatcaaacagccaggtgggaaaagcaccgacaaactggttgattcatatcgttcgatgattgttgttaaaaaaggcagtagcatcaaatcttggaaagatctcaagaataaaaaaattgccgttcaagatgttaccagttccgctggctatatttggccgattgccgaactgtcccaaaagggtctcgacattgttaaacaagataccttggttactgtcaaaggtcacgatcaaggtgtcatgtcagtgctaaacggtgataccgatgccgcctttgtttttgaggatgcccgcaatattgtcaaaaaagatgtccctgacattatggacaaggttgaacccatctacttcacaaagccaattcctaatgacacgatttccgtacgtcaggacatgagtgccgccttccgcaaaaagcttagcaaggctttcatcgacattgctaagacaaaagaaggtcatgcgattatctcaagtatttatacacatgagggctatgtcaaaaccacagatagtgccttcaacattgtgcgtaagtatgacaaaattgccactggtgaatcaaaaagcaagtaaagcaacgttgcaaaagcgctagccacctagcgcttttgctatacatggaggaagtttgcatgtcagaaagtaaccacccagttattgagtttgaccacgtctcaaaaatctatcctaacggtgtcgtaggccttaaagacatcgatttaaccattaatcaaggcgaatttgtggttgtcgttggcttgtcaggagccgggaaaagtacactgatgcgggccatcaatcggcttcacgacatctctgaaggcgatgtacgtattgatggtgtttccattaccaaagcaaaaggcaagaaactattgaatattcgtcgaaaaatcgggatgatttttcaaagttttaacctagtcaaccgctcgtcagtcttgaagaatgttttaactggacgagtcggctattatccaacttggaaaatggtactaggtttattttccgctgaagacaagcaacgtgcttacgatgccttgcggacagtagaattggaagataaagtttatacccgtgccgaccaactttccggtggtcaacagcaacgtgtggcgattgcacgtgcccttacgcaaaccccaacgattattctcgcagacgaaccgatcgccagtcttgatcctcaaaccacaaaacgggtgatggatgacttgcggcgaattaaccaagaaatgggcattactgtcgtggctaatctacatagcgttgaggttgctcaagcttatgctactcgcattatcggtattcgggcggggcaaaaagtgtttgacggtccggttgccgaagccactgatgaaatcatagctagtatttacagcggtaatgagcaggaggtgtcataatgacagctcctacgttaccgaaacgtcagctgcaatggcgcaagtggctgctgactggcatcatggtacttggtttaatttggtcgattgggatcaccaatgcaaatatcgggttgtttttcaagaatttcagtcaattcactgtcatttttaccgaaatggcgcatgttgactggagttacgcttattacacaatcgatccgatgattcagacattgaaaatggcaatcattggcaccttgattggctctgccgttgcttttccatatgcccttttagtttcgcgcaacattgtgactaataaaattgtggtaggcatttttcgctttgtgctcaatattgtccgtaccatccccgatctcatgttagcggcactttttgtcgccattgtcggaatcggaccagtggccggtatttttgcgttagcgatctttacttttgggatggttggcaagctgttttatgaagcagttgaaacgattgatcctggaccgcttgaagcacttaaggcagcaggtgcaggccgaattgaaatgattcgttttgcagtgttgccgcagatcgcaaattattttgttagcttcgtcttgtatgctttcgaaattaacgttcgggctagtacggtgctcggctatatgggagctggcgggatcggtatttacttgcaacaggcattatccatgtttcggtatgatcgggtcggtttgattgtgctagttatctttgctgttgtacttgtcattgactacattagcggtaaggctagggaggtgcttctatgaatcactcagcttcattgccaaaggcccccctgcaacatcgttggcgcaattggttactgacaataatcaccttagcgattatcgtttggtcattcacaggtatgccaagtcttgaaatcaaacccaatgcgtgggtcgttaccaagtcaatcgctgcggggttggcacatcccgattttagctatgtttggacaggtgatggcgaagatctgacttctacgctgctgcaaactttggggatcgcctttttagggacgttcatttcagctattattagtctgccatttgctttttgggctgcgaacacacaacacaagttttggctgacgactcgttctggcaaatttgtcttgactgccattcgaacttttcctgaaattgtcctggcgttaatgtttatcaaagccgttggtccaggctcttttgctggcgtactagcagttggctttcatagtgttggcatgctcgcaaaacttttttccgaagcgattgaaaacatgaacaatcgtgccggagaagccgtgattgctgctggtggcaatcgattggatgtcactgtgatcgccagtttgccacaattgataccagagtttgtttctaatactctctaccgttttgagttggctattcgttcagcatcgattcttggtatggtgggtgctggcggtgtcggaacacctttgattttcgctattcaaacccgttcttggtctagagcgggcatcattctgtatggcattatcattttagtaaccctcaccgactggctttctggttttctgcggaaacggttagtataaaattcgttgaaatcctaacatgtcggatcacttgcagatgaaggtccgctcttcttcgaccaaaagtgagaggtcgatttagttcagtggcagtcgttcagcaatcaaattgatttgatggaaaagaattttcaaggccgaggttcgcttaattctgtttttgatttcagagacaatgaaaaggtacatcacggccattttcatgcatgaccacagattgatgctggaaaaatgccagaagcgctcagcattgaaaaatgtcccgttaaaaaaatagttgtgattgctgtatgatgccatggtcccatcaaaaaagactccctgagatatttcatctcaaggagtcttttttatccagcaagtcccgggctgcaactgatcaatcgctaccactgactaatgttgtcttcatatccaccttctcggtcacaacaccttcttgataaaaggtattcgcgatttgattttcttcatcgacaatgctgctatctgctttaacgagcgccatggcataagttcggcgttcaaccattttttgaatcacagcgtctgatagtttcaaggttttactgagcatggcaatgagttgtgtgtggtgattattggcccacgtcatatcatcgttgatataggttgtcagcaatttgcttagcgcggtgtgagttttggcataattttgggttgagatcaggaagtcacgattctttgccaagccggtgccgtttgtcagcaacttggccccttgattgacttgtgctgttgccgtatacggatcccaagtgacccaagcatccacactgccttttgcaaaagcgaccgatgctgaactttgatccatattcactaatttaacatcattggtggacaaacctgccttttttaaggcctgaataatcaagtattgggcggtagtgcctttttgataggcgatcgtcttgcctttcaattgcttgagattggtgatctggctgttcttaccaacaagaataccgctgccatattccttggtggcaccagcagcaatcagcgcaatatccgtgccagcagcttttgctgtcactggcggcgtatcgccaacgcgagcgtagtcgatcgccccacttttcaaagcagtcatgagcgcagcaccatcagaaaactccttgaagacgacttgatagccttttgctttcatttttttgattaactcaccgtgctggcgggcaatgtcgacaggatcggccttttggtagccgatcgtgactgtttccagatcactggccgccgtcgtggtctgcgtatagccatagacggcaacactaagccacatgattaagccgatcaccaagaaccaaaggtgttttttatgcttcataggcttgtccgccttgcattagctgtttgcgcagtttcggtcggagtactttcccagttgcattgaccggaaaggctttgacaaaaacgacatcggttggacattcatacgctgccaaatgctggcgagcgtaatcgatcaaggcggctttggctttcattgggtcgccggtcacgttttggcgaatgacaaccgccgtgactgcttcgccataaagtgcatccggcaaaccaatcaccgctacttgagcaacccagtctaactcattaaggatattttcgacttttgccggggcaaccttttcaccaccgcgattgatcatttccttacgacggcctttgacaaacagatagccatcttcgtctaaatagccaagatcgccagtgaggaaccaatcgtctttgaaagattcaggatgcggttcgaggtaatcgtgaatgacgtgatcgccgcgaagagcaatttcaccttcaacatacggttgctggctcaaagaaccgtccgccagcatcagtcgcagttctgtacccaccggcttgccggcagatccaatttttggtgcattaattggatttaaggtactctgactcgccgtctcagtcatgccataaccttcgagaacctgcgtatgaaaatacgtctgaaaggctatcaacttatcttctggcaatgcaaacgaggaactgcggacgaatcgcaaatgaatgtcagggtgataagctttcaaggcgttttcgttcatgagcaaaatcgatatgattgtcggcacaactgaaacccacgtgacatggttgtctgcgatgagcggccagaatttgctagcggagaacttcggtgcgatgacaagtttgccacctgaaagtcgggtagccaaaaccgaaatcacctgcgcattgatgtgaaacatcggcatcacgaccatggcgatatcatcagctgataaggcatgacttttggcatcgtgttgggccgcattcaacaacatgcgatgggttaagcccacgcgtttcggcttgccagttgtgcccgaagtgttgaggatcaaagccagatcctcttcttttggccgtttttgcggcgcgtttatgcgatacgcaagctgactggcatcagttaaaatcgctagcgctgcgatagtatgcagacgaagccgactgcacggcatcaatggttctgccagcttttcgccaacatcaggcaaggttataactgcctgatagtgatacaatgaccattccgccttcagttctggcaacggggtcgcggcagcaatcggatggacaaccgcaccaatctcccaaagtgcctgatttaacgccagatggacgggagcgtttggcaaagcgacaagaatctgattccccgcaccgattttcagtttattcaactggtcacgcaaggctgcgacatcctcttcaagatcgcgcccggtataccaagtatcggcagcgactgatttcacaattgggtaatcacgctcatttattagattctgagacaacagatcggtgagtttgctcatgattcaagactcctttcgatgaaactgacaaggactgcggacggccaatcagccacccaaacggcgcgatccggtagcatagccaagcaatggtaaatgaaacagctagaataaagatatagccgattggtagtagtaagatcaacatgccattgctaaaaccaccgagactcaacaagccgcctaacaggctaatagcaatggtttgacaaagataaacgccgaaagaaacttgcgcaccatgaccgatcagtcgtgccaacaaatgttcgggtcgcttcgtattaggccgcgtatcgctggcctaatacgaacacaaaagcgatcatcacgacatcgtagatcaacatataaggctggtgcggcgaaacagcagcgttgtgaccaaagttcagaacttgtttgttaaaaacatagagaccaatggtaccgatactgaggctcaaagcaccccagctgattgacacctgatgggcaagaagccattgcttgaccttttcatagtgcatgctgacgagtccaccgctaatgaagaagaactgataggtgaaaacattgaccccataggccttaaaccaccataaccagtcgcttgtgttgacatgtggcaacccatacttaatgctgatgactagcagcatttggacgccgaagctagcgacgactaacctgatatgatgaccagccgtccgtttaaatagccacagcatggctggaaacaatagatacaattgtaaggtgaccaaaacgtagtagaggtaaaattgatcgccatgcagcaaggcactgagatagtctggccagaagttggcgatggtaaagccgccaacaccaagcagtactgaacctgccaacaataaagtgttccacaagacgtaaggtacgccgactgttgtgaagcgttttttgtaaaacagcggccaattgcgctgacgccggtaatacaccatcgtcaataccaaaccggtcataaacatgaaacccattcgcgtaaaatgaatcattaaatgtgtggctaagaatccagtactgattaaaccgctggatgtttgatgctgaaatgccgttgtcgtgtgattcaacagcacacctgcaataaaaatcaaacgcataagatcaatttcatatagataaggatgcttaacttttttcggctcgcgccgctcgccgtcattcgcctgcttcatgttgtcaccggctctgacacaatcgcgttcaaaactcgtgctgctgtgttcgcaattttctctggtgattgaccacgagcaccgcttgtttcgtatgccagcttgccatctttgacaaccacaatgcgatcggccatgcgtgcagcttcattaacatcatgcgtgatgagcaaactgcttaaatgctgttttgtgaaaatatcaaggatcagatcttgcatatgttgccgcgtcaaggcatctaatgcgccaagcggttcatcgagcaacagtaactgcggcttagctaacaacgctcgcgccaacgccagccgctgcttttgaccacctgaaagttgtacgggataaccatcgcttttgtcagcaaggccaactgctgttaacagtgatttagcttgttgcacgatagcgggatcgtgtgatcgaaaagaaacgttgtccaaattggttaaccacggcagcaagcgatcattttgaaacatcatccgcatgaccagtccattttgacgttggatgtcaccggcagtcggcggctcgagtcctgcgattaggcgaagaatggtgcttttgccgccgccactcatgccgaccagtgccaagaattcacctgggtacaaattaagatgaatgtcatgcaagacagttttatcgttataggtttttttaatctgacgtaaactaataattggatcagtcatgcctcgacacctccttgacgccaactaaggaagactttttctaaacttttcgcaatgaggtcggacaccttgccgagcaatgcgtagatcaaaatacaaagcaggacagtgtccatccgcataaattcttgtgcattcgttgccatgtagcctaagccggaactcgaagaaatggtttctgcgacaatcaatgtggtccacatcacgccgagcgcgtaccgcacacccatcaaaatgttgggtaaagccccaggaaaaataattcgcgtgaacaagtcgcgctttgaaagaccataggcatgccccatttcaagcaattctggattggccgttgttataccttgataagtattgatgtagatcgggaacatgaccccgattgccaccaacgatattttggccgattcgccaatgccgatcagaataatcagcaaggaatcaaggatagatgcggaatgttgcgaagcatttgaatcggactatctaataaggctcggattggtctgaccaagccgttcatcaggccaagtacaaatccgatactgccaccgatcgcaaacccagctgttgcacgatacaggctaatcgcaatattttttggcaattcgccactttgccacaaggtgatgccatcttgaatcaccgttaagggtgccggaagtaaggaactcgtgagccagttaaaactgaccgcagcttgccatccagccagtaatcccaacggcacgatccaaggcagtaccttgaaccaattgatatgtcttttggtccgcggctttggccgttgcgtgagtgtcgtgacttcttgcatcagggccatctcctttaagttgatggtgttcatactaacgagagcaacttaaagctgacttaactccatttgaagagtttatgacctaatcagcataaaaaaatgccctttcagcacgaatcatcagctgaaaggaccggaagtttgtctaaaatggttcttgaccaaaaggaattcataatcaataacatggcgagcacatttgagttttaaatcatttagcttaattctgtcacttcaaaatttaaaaaagggcatcaggtgttggatgtcgcaaatgattttcgccttattttacgtgcctgagctttgatatttcaccagaaaaagccgccatagttgataaacgagggtgaagaaagcaaccgagatgccaacaaccaaaatagcaaaataccagcggccatcgttaatgaccgttgattgcggaatagcggccacccaacctaatggcaaaaaccaagtgaggatcatttttaacggtgtattgtaaatggagagcggatattttgaaaattcaaaaaagtcataaactgtctccgataaatctgctaacccttgtgacaacaacgacaccatcccgcctagtaaggttaaggataagaagattaaagaggtggcacagcacatcagcaggaccagcaagaaaataagtaaaggcatgtgcgagctgaatgcaatcgtggtcaaaatcagtacggatatcgccaagtcaccccaagcatcttcatcaaaactttcattcaacaactgaaaaagcggattgacaggtttaaccaacaagccgtcaaactttccttttcgcacataatccgcaatattcagcgtattaatgaaaaaacagcgaaaaatcgcaaatgaggtgctggcaatggcatacgtcgtcaacagttccgtaaacgtatagccctgaatcgtcgggactaacaaatataaaaagcgaagtgccgcaacattgatcaaattttgaatcatcatgccaacaattgaaaaataaaaatcaaaatcgtaaatagtggctggtgaattaggcaacatttcggctacctgaaacgtgaatttgataatgaattaagatggattcctgcttaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccagtgcacagctttactgtggaccgtggcactgagtttagtgggctagtatcacttgaatcacaatatggtattaagacctattactgccatgcttatactccagctgaacgtggtagtaatgaacgctttaatcggaatttacgttatttttatcctaaaggaactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccatataaccgattttattaaaaaaacggaaaatttgtatccaattttcagaaaataattttataaatattgcgatagaaccagtctgaaaccggcattaactcaagtgcttgtttttaaatgtatcgccgatcctctgttgtttctgcaaatcagctacatcttcgatcacaataaaaaaacacgatgttggtcaacgatccatcgtgttttttgacaagtatctttttagagcagaccctacttaccaatttttgcgcagctgattcttttaatcgtgccggactcatcagcaacttgcttaagttgagcttctgaccacacttatcttcaaagcttttcatcattctatcagtatatttttaattaagattcgtttgtttgcattctaaacaaatggcaagcattttgttgtaatcgtaacaataaggctttgcagattgttttcattttctagttgacttcatacagaacatcgcgtatgttaaaaattatcacataagatgagatttacatgagaggagttttgtcgatgaagttagatttggaactacgccctggggcaaatcgttttgtgagtgagtcaggtgccttggcatacttagatacgatcttagcggattttaatcaaccagttgtgattaccggcgaaaaaagttttgctgctttcaccaaggcttatcccggcgaactgaacttgccagtctatcattacgacggctccgccagtgatgagaatggacacgaacttgcacaggaaatcggtcatgctgatgccgtggtaggaatcggtgctggtcgcttgatcgataccgccaaagttgcggccgaagccttgggtgctgagctcatcagcatccccaccttggcctctaactgtgcgccattcacaccgcttgctgcgatttatcatccgcaaggtcatacctttagttacgttgaatattttaaaaaatctgcctatattactttggtagactataacctcttattgtccaccccacatgatttctttgttgctgggattagcgataccttggccaaatggtacgagatggacggcattacccgtgataaagtggatcagttaaaggcatacggccagttgagtcgtgccgcggccaaaacgattcaaaagattctctttaaagatgctgaacaggccttggccgatttggatgccggccgcgacaccccggcttttgaggcggttgccgataccattatcggcttggctggtgaagtcggtggcttcggcggcattgatggtcgcgctgccggtgctcacgccactcacaatggcctgtcctacttaccagaaacccatgccatcttgcacggttcaaaagtggcttacggcattctggttcaactggctgaaaccggagatgatagcgaaattcgcaacttgattccattctatgaaaaaatcggtttgccattgaaccttgaagatttgcatgtcaccgatcaagtcgatgaaaagattaagcaagtggccgaatttgccgctaaaccggatgaaaccttcatcttggttgatccaactttaacccctgccaaagtagcagatgcgatgacaaaagtggaacaagtcaccagtgagccagcagcttaaagtccgaaatcggacaatctaatgaatactgtttcacaaaaattttaaaaaaccttgcagccctcttaaaatggttgcaaggttttttcgtttttgtattaaagaaagcatatcaaaccacgaccgcgcaaagtcctacctgttcatcgcgttgtcgattcactttgcaaataccctaacgccgccgcgccaacagccttggcagcaatcagaatcgcatcttcgtccatcataaagtcgggactgtggtgaggatgattagagccgtctggcagttgacagccaatgtagaagaaactgcttggtaccttttgggcaaaatacgcaaaatcttcggatgggtcttgaacgccagtgtccttaatggccttaatctccggaatatttgctgctttgatcgcggccatcgcattttcggttaaggtcgcatcattcatcaaaaccggataattgtcatcatagtccagctttgttttaaccccaaacatggtttctagtccttggttcatggtgacgatctgttgtcgaatcgttttgcgcgttgtttccttcatcatccggacatcgcctttcaatacaacgtcttgcttaatcgcattgaaagaaccagcgccgtcaaatgagccgatggtgacgcttgccgtgtcaaaaggatcaactcgccgcgacacaatcgtttgcagtgccgtcaccaaatagctgccagccacgatagcatcgttgctcaggtgcggcatagaagcgtgtccacctttgccgataatcgtatcggtaaagttggcccgcccggtttgggttgcgcctgtatggtagccaatcaaccctgtcggcatcgatgacatgacatgaacgcccaacacattatcaacgccttcgagaacccctgctgctaccatccccttggcaccacctggagagacttcctcagcgggctggtgaatgattcgaatggtaccggccaatttggctttgatcttgatcaattctttagccaacaccagcaaataagccgtatgcgcatcatggccacacgcatgcatcaccccaggattctgagacttgaacgacaggtcgttatcctcttgaatcgccaaggcatcaaaatccgcccgcaacgataacgtcggacccggttgaccgccttgaatatcaacgtacatgccatagccctccccacacggcgtcacggggacgttcaaggctgcataatattgtttgatataagcagccgtttgtttctcatgaaacgaaatttccggatgagcatggagatgccgccgaatcgcaagcatttctgattcatcggcagccagtgtctgcatcaattgttctgttaaagtcatggtctttttcctctctgtgattttgtctgaactttcggcaactttgcaattaggcgaacaagttgcggtcgaacggccttaaaaataacctccgcgaccacaaaaccgactgccagtgccatcgcaatcaaaatgacgttatagatttgctgcgcagcactcgcggcttttcccatggtgaaactgcgcgcacccagataagcaatgccgcctggcaccagtgatacaagacttggtatgtaaatcgtattaaccggcacccggtgacgaatagcaaaacaattccccagcaacccgatgattaccgtggccgtaaagttcggtaatatgaggctgtgatcctgcaggctgatgagccagtatgcacaccacgaaacgccgcccgtgatcccagctggcagcaaggcgcgtttggggatgttggtgatgacgccaaacccgatgctcgacaagacgctaatcataaattcaattaataagcgcatgctagcgccctccccaaacattattcagtacaatcgcaataacgaccccaaaaccaatcgcgcccgctacaaaaatggcgtctacagtgcgaacaatgccgctgatgatttgccgcgaaagaatttcccgaatcgcattggtgatggccaccccaggaaccaacggcatgagggcactaataataatattgccggaactatcgccccacccgatgctcaccagtaattcagctaaaatggccaccacaaaggcaccagtcgcttctttgaaataaggcgtcgtcgtgcggcgaccgacatactcagccgcaagataaccaaaaataccaacaaaaaaggctaaagccaaatcaccatttgtcgctttgaaaagcagcattggcgcgaccgaaacccaaccggcgcccagaatccgcgcccaccatgggaaattaatgacttggtgatcaattcgcgcaacttcttgcttaagggcttcaaatgttatccgatgagcgacgaattcacgtgacagttgattcaactcatcgaccttttgcaagttgaatccgcctaatgttgatttgattaagcgcgtacgactttcgttctccaaactgacaaaaactgccgtaatcgtggcataacacgcaacgcttgcccctgccgcatgcccgatatattccacggttgtctcaatccgtgatgtctcggcgccggcattcagtaaaatctctcccaccttgccgcagacttctaaaatttcctctgttcctggttgactcatcgcgtttgctcctcaagatcgcgtttccgcattttgcattttattaattgtcggcttttttgatagcggtggcaagtgatgacattaggcaatcatcagcaaatttttctgaaaaggtttttcatttattaaccccttaaacaaatgaaaacacaagcgcgttatggcgtgttaaaaccaatgaaagaaataaataacaaaacataaccaatgcctaaaaatgcgattatcagcagtagcgccaaagccagtttcactgctaatgaaaaatcttttctgcgcaaaatgacgactatcccaagtcctaataagatgagcaccagaaataaaaagaaaaaaagtagtgctctagatgtccaaaagcctaacatggttaccactcctctaatttcatcttgctacttagccgttccccattttttaaatcgataattcgccgacagtgacaaggcaaaaaggcgtcatgtccagtagactttttcagcttatcaaaggttgcttcaaagcacaaaactgttgcttctcatgatcacgcgcccccgtccaaggctacacatgtcggtctcttcccgggctggcttggcatcaaaaaaaccgaatcgccagctagtttggcaattcggtttccaatttattgggccactttactaatgcgtccctgctcaatgtacactgacaaaatcgccacatcagcaggattgacgccgctgatacgactcgcctgcgcaatggtttctggctggattttaaccaacttctgacgtgcttcagttgccaaaccattgatggccgcgtagttaatacgtagcggaatctttttgccttctaggcgcttcagtttggcgacactggcttcttcctttgcaatatagccagcatacttaatttgaatctcaacctgctcaatgacacgatgatccaaagtcggattatctggcaagaattgcgccatcgtctgatagtcgatttccggccgcttcaggaagtcgctagccaagacgccatccttaagtggcgcataatgatgggcctctagccatggattcacgtctttaggcttcaaccgggtcgtattcagccggttaagttcagtttcaatggcctgacgctttgccaaaaattcagcatagcgctcatcgctaattaaaccaagctcatggcccattggtgtcagccgcagatcggcattgtcatggcgcaacaaaagtcgatattcagcacggctggtcaacaggcgataaggttcattcgtgcccttagtcaccaaatcatcaatcatcacaccaatataggcatcggaacgcttgagcgtgaacggccctttgccttgggcacgcaacgccgcattgatgccagccataatgccttggccagctgcttcttcatagccgctggtaccattcatctggccggcagtgaaaagattatcaacgactttggtttctaacgtggccttcagttgccatggctcgatcacatcgtactcaattgcatacccggcacgcatgagttcggcatgttccaacccagccacactatgcagcattttcagttgaatttcttctggcatagaagtcgaaaaatcaccgacatagtattcggaggtatcgcgaccttctggctctaaaaacagttgatgccgcggcttgtcagcaaaacgaacgatcttatcctcaattgatgggcaatagcgcgggccaacccctttgatcacaccggaaaacattggcgcccgatccaaattatcgcgaataatttgatgggtcgttgcattagtgtaagtcatccagcaactaagctgatccttcaaataaactgaatccggcgtcgtgaagctaaaatgattcggagtcttatctccaggctgttcctcggttttatcaaagtcgatggtgttgccattgactcgcggcggagtcccggttttaaatcgccgcaatttgaagccgagctgttcaagattttctgacagcttgatacttggcaggctgttattagggccagaactgtacatcaactcaccgatgataatcttgccgcgagaactggtgcctgcggtcaaaacaacactcttggcccgatacattgcgccagttgccgccacgataccgacagcttggccattttcgacgagcacctcagtagcgaggccttgacgcagatccagatttggcgtgttttcaatcacgtgtttcatgctgcgatgataggctgccttatcagcctgggcccgtaatgcacgaacggctgggcccttgccggtgttaagcatccgcatctgaatatatgttcgatcaatattcttgcccatttcaccaccgagtgcatcaatttcacgcactacgattcccttggctgggccgcccagacttggattacacggcataaacgccagcatttccaagctgatcgtcaatagtaacgtcttttggcccatccgcgcggctgccaaagcggcctcacaaccagcgtgaccagcaccaacaacgatgacatcataggtaccggcttcaaattttttgacatcaggcattcgatttcctccatgaataagtttctaattggcactgagctttacttgcccaagcagaattgactaaacaattgggtgattagttcatctggcgcactttcaccagtaatttcaccaagtttatcccacgccgcagtcatgtcgatttgcacgagatcaattggcataccagcatggattccggcgatcacagcgtccaagctcttgttggcttggcgtaatagcccgatctgccgagcgttggaaaccatcactgttgtttggctattttcgatgccgccgaagaacaacttcgcaatccgttcgtctaaggcatccatgcctgcgctagtcgggatagcggtcttgatgatttcatccggcgaaaccaacttcaacaaggcggtggtatctagctgtgcaggtaagtcctgtttattcaaaacgataatccgttttttattagctgttgcttgaatgagctgttcgtcttcatccgtcaatggttcactttgatccaacactagcaaaatcaaatcggcttgtgtgatggcttgacgtgagcgttcaacaccgattttctcgactttgtcagtcgtgtcatgaataccggctgtgtcgaccagttttagcgggacaccacgcacgttgacatactcctctagcacatcacgagtcgtaccagctacatcggtcacaatcgctttatcctcatgcaacatgtgatttaacagcgaactttttccaacgttgggacggccaacaattgcggtggctaaaccttcgcgcaagaccttgccttgactggcggtactcagcaaattgctgatagctttttgaacggtttgcgccttttcaagcagcattttggtggtcatttcatcagtatcatactcaggatagtcaatgttgacttccacctgtgccaacacttcgaggatttcctgacgaaggcgtttgatcaatgtatgcagattaccgtctagctgattgactgccacctgcatcgcccgatcggttttggctcgaatcagatccatgaccgactcagcttctgtgagatcaatgcggccgttcaggaatgcccgtttggtgaactcacctggctcagccatccgtgcgccttcgcctaagagcaactgcaaaatgcggttagtggcaacaataccgccatgacaattaatctcgacaacatcttcacgggtaaaggtcttaggtgccaacatgacactaaccatgacctcatcaatcaactcgccgctttcagggtcgacaatatggccataatgaatcgtatggcttttaacctgcgagaggtcttttcccttgaaaacttgattagctgtcgctacggctgtctcaccgctgagccgaacgatgctgatagcaccttcgccaggcggggtggagatggcagcgatggtgtcgtacgcagtgatggatgcagacatttgaaagactcctttttgagatgattcggtaagaacaatgagttgatgggattggacacggcaggcgactgaggcggatgagtgatgtggcggcctctgaaacacgcaatggaattgtagagcctgcatgtagggatttgtgtggtaaaggccaatcccttcatggcctctgaaacgcgcaatcaggcgcatctcggctatgcgaaggacagtccaaccagatggcccaaagcccagactttctggttaaggggctaggcggttccgaaacgcgcaatcaggcgcagaaacctgcacataaggacatcagacctaaatggcaaaaccagccattaggtctgatgccacttatgctccggtttctaaccgcgtctgattgcgctctacaaaaaaagcgcaaaatccagtctttccccctatcagggaaagactggataaagcactttgactacttcatcattattaaactgtgactatcatacttaagcaacggtcacttgtcaaaagttagttacggtcttttgggtgtgactacgacatatcgccgaggatcgacgccttctgaatgggtctcaacgtacgtattgtccacaagtgtcgtatgaatcgttttgcgttcaaatgatggcatcgggtcgagatagacggctttgccagttgctaaaacctcgcgagcggtgcgttctgctaaacgtgtgacggtcgcctgccgtcgttcgcgataatcgccgacatcaagcatgattgtccatttacttttggcataatgattgaactcagtttgggctaagtattgaattgcattgatgattttgccatgcttaccgatcaacaggccttcttcatctgttttcaactgaaatgtgaccgtgttaccttgccgttcacttgtgacttgagtgtcgatccccataccagtggtgatgtcttccagataactctgcaccatggccaatgcggtttgattatctcgctttttggtggtgatatcgttgaaagcactggcaattttcttgcctgcaccatcagttaaagccgttgcaagttttttccctgcccgcggtttggcaggcggatcgtcgcttggcgtcggatcagcgtctatcggcggttccaagggttttaaattaacaatcgctggcttacgcatcaagcccagaaatccgttcttattttctcgaacgacttcaacgctaacggcatcacgcggcaagccaagctgcttgagaccagtttcgatggctttttgaatcgtactgccttgaaaggttggcatcttgcttcctcccgttgttatttacgccgtttggttgcttttttgtacgctcgcttgagtgcccgttctttttctttttcagcctgcgcttttgcttcacgttcgcggcgaatcttgaatgggttctggatcagcaactgctgaatcattgaaaaggcattggtaactacccagtaaatggccagcgcacttggcaaggtaattgagaaaacgaaaatcatgacaggcgagacgatcatcatgagccagctgctagaattacgcgttggttgtgccatcatggataagacactagtacccaacgtgaataaagttgccagaatctgcataatccacaacggatctggttgtgacaggttcatccaaaggaaagtaccagtttgcagtgatgatgtgcgcaaaattgcttgatacagcgcaatcaggaatggcatctggatcacaatcggcagacagcccatcactgggttaaccccagctgaagcataaagtttctgtgtttcatcacgcagtcgtgtctgggtttccgtatcctttgaactgtacttcttttgtagttcttttagctgcggcgcaatttcctgctgtttggacatgctcttgattgacatgtaactcagcgggaaaatcaaaattcggatgatcaaggtgaaggcaataatcccgacaccagggttgccaccgaacaaattcgccagccagataacaaattgaccggctgtgtagacaacatagcgatcccagaaccccgtactattttgcgtaacgggtccggttccgcaggccgtcaaaatgaagaccagacttagcatgctcaaaatgacgagcacacgtttgatttgacgatttttcacaaatgatccctctcttttttaaacgcggtcgctaggcgcagaaatctgcacagaaggacctcaaatttaaatggctaaagcccagccatttagatttgagtccgcttatgctccggtttctaaacgcgcctgctcacgctctggtcagatgacctcgatgtcttcgttcaggatgccagccaatcgcatgacatgaatcaaatttttcttggtgccagccatgtcgagctggttagcagatttacgtgcaataaccaaaaaatcggtttgcgtgtcaatattaggttttaactccagtaaactttgccgaatatagcgcttaatctggttacgcatgaccgcagtgtggccaactttcttccccactgagataccaacacgaaaatgcggttggtcgcgtttcatgtgatagatcacaaaattgcggttggcaaccgaatcgccatggtcaaacacattctgaaattcagcttcttttttgatccgatatgacttgcgcaatgatgctccctcacaatctggttctaagtatacaagatgactcggtgttttcctatatgtatcagcggtttgttgacggtttctaatctgcacattgaaattaagctgttgagcagaaaatgaacggcaacgaccaacgattgggccattgccgttcattggggtcatgctgctgccgccgaaacgcgtgaacaagcgcagaaacctgcacgtaaggacctaagtcgcaatgaccaaagaccggtcatcacgacttaggccgcttacgctccggttcctaaccgcgtttgtttgcgctctaaaaaaaaccactgacgcggtcagtggcttaggcagataatactttacgtcctttagcgcgacggcgtgctaaaactttgcggccgttctttgtgctcatccgcttcatgaaaccatgaacacgttcacggtgacgtttctttggttggaaagtccgtttggttgtcattgacgacacctcctatgaaaaacgatttatcttattaagatgacttgcattatcagacatcatccgagtttacacgaggaagcaactatcgtcaaggttttttccattgaaagcaggatctcatgatgatgacacgacatccacagatagttatgaacctgtggataacttgtgtctcaaatttttaggtttcggtcatttccacaaaccaatcacaggaaattcgcagataaacagggtgtgaagaaagttatccacaagttgtcaaagccctgttcatatcttgtgaaacacttactgccacaaggtttttgttccacagtgtcaatgtgcataactgcgaatttattgtcatcacgctttcgttgtccccgaccttggggatagtctgttcgcaccctgttcatttctcaattttttgtttgtggaaaactgtgctttctgtggaaaacttacgccagcaatgctaaacttatttttacagagcgctcgcatgcccggttagaaaccggaacataagtggcctcgagtctaaatggctgctctttggccatttagactcgaggtccttatgtggaggtttctgggcatgcgagcgcgtttcagcagagcgtgaattggcgcgttcagtaaccgaagtgtaagcggccttgactgtgatgaccgggctttggtcaatacagtcaaggtccttacacgcaggtttcggtgccaatgagcgcgtttttatataggaatgtccgtcatcactcgtcagcatagctataagctggtttgctaccggacataattggaggaggggcatgaatgcccaatttagaggaactttgggcttacctgaatgataaattccgtgaagaattgaccccggtcggttacagcacatggatccagacagcaaaacccgtcaaattaaccaaagataaactcgaaattgaagtcccagcttctttacacaaagcttattgggaaaagaatctcgtgaccaaggtagtcgaaggcgtttacgaattcgcgcaacttgaagttgatcccgtcattatgaccaaggatgagttgcaaccagctccggctacagatcaacgtcctgcggttgaagaagacgatcaaaatctgacttttaaggcaaaaacccatttaaatccgaaatatacgtttgaccgcttcgtgattggtaagggaaaccaaatggcccacgcggctgctttggcggttgctgaagcccctgggacaacatacaaccctctgtttatttatggtggcgttggtcttggcaaaacccacttaatgcaagcgattggtaatttggtgctaggtaataatccagcagccaacataaaatacgtcaccagtgagaattttgctaatgacttcattaactcgattcaaaccaaacaacaggaacaatttcggcaagaataccgaaatgtggatctgctgttggtagatgatattcagttttttggtgacaaagaggccacacaggaagaattttttcataccttcaatacgctgtatgaaaatatgaagcaaattgttttgaccagtgatcgcctgcctaacgaaatccccaaacttcaagaacggttggtttcgcggtttaataagggcttgtctgtcgatgtcacaccgccagatctggaaacacgaatcgctattttgcggaataaagccgatgctgaagatctcagcattccagatgacaccttgtcttacattgctggtcaaattgaaagtaacgtacgtgatctcgaaggtgcgttagtacgcgttcaagccttttcaaccatgaaaaacgaagatatcacgaccagcttagccgcggatgccttgaaagccctgaaacttgatgaccgcagcggacaattgaccattccgcaaatcctgaatgctgtcgcgaaatattttcagctgacggttcaggatcttaaaggaaagaaacgcgtcaaacagattgtcattccgcgccaaatcgcgatgtatctagcgcgcgaaatgaccgataacagtttaccgaaaataggtcaggaaatcggcggcaaggatcatacaaccgtcatccatgcccacgaaaaaattatggcttcaatgacaactgatgagaatttaaaagctcaagtgatcgaattgcggaatatcttgaaaaaccgcgggtaatgcacatgtggataaccttcaaaaacaaaccattttatccgtcgcacttatccacaagtgcataactttctcagttgttgtttctcaaagttttccacagtttgaacacgccctattactattacttcaaaagctttatattatatatataaaagacgttcaggaggctcttatgaaatttacgatcacccgatccacattcttaaaaaccttgaatgatgtttctcgggccatttcaaccaaaacaaccattccgattctgactggattgaaaattgtgctcaacgatagcggcttaatcctcactggtagtgatgccgatatttcaatcgaatcacggatcaacgcaacggatgaaaataatgatctccaaatcggaagcactggtgaaatcgtcttgccagcccgtttctttagcgaaatcgttaaacgtttgccagaaagcacaatgacgcttgaagttaaagacaatttccaaaccgtcatcacgtctggggcatctgaatttaccattaatggtttggatgccaacaactatccgcggttgccagaaattacagccgatgcagcgttgagtgtttcagctgatgtgttacgtcagttgattaaccaaacagttattgccgtttctaatcaggaaagtcgaccaatcttgacaggggttcatctgacaattaccggcgatcagttggtagctgttgcgactgattcccaccgccttgcgcaacgtagcctgaccttaccaacagcaagtgcctcggattatgacatcattattccagggaaaagtctgacagaacttagccgcatgttaagcgatgacgttgaaaaaatcgaaattcgcattgcggaaaatcaagtgctgttcgtgtttgggcaaacggccttttattcacgcttacttgaaggcaactaccctgacacaagccgacttattccaacatccagcaatacgcaagcggaatttgacgcaccagcattgctggcctccattcaacgtgccagcttgctgagtcacgaaagtagcaacaatgtagttcggcttgtccttaatatcgctgatcaaaaagcgactatctacggtaattcgccagatgtcgggaatgttgaagaagtacttagtttcaacaaacttagcggcgaggatctagaaatctcgttcaaccctgattatatgaaggatgccttgcaaggatttggccaaacggcaattgaagttgacttcaccgcaccattgcgaccattcactttggttccaacagaagacaaggaacggtttatccaactcatcacgccagttcgaacgttctaactaaacatgacttgaaaacgcctttaccgaaaagattcggtgaggcgtttttttgacgaacttatgcttcatgaaatgaactgataatgtgcgcatcaaaatgcaaagcagccacatgatccgttagccaacatcagcttttttgatggcagtgagtcgttttatgggtcttttttcgtcccactttaatcaaaggtgatgataacagactttgattgttggtttgttcacaaatggatcagtcattttttctgtaaacctaggtcaaacagatgactttcataaagtttcacgatcaatcgaatatttctatttagaattcctaatgacaaataatcgaaagttgcgttgagagcggtcaaaatcgatagaaatcaaaatttagccgattttggcctttctgggtctttttagtctagggggacgcacaacgttcacattgcctcagagccgctttaatgccgttttagaattgtgttttaagtagtataagggtataattaatttgtgttcattgacgacaaatcgcggtttaacgcggtttgtctagcacttttcggaatggagggcgacagcaatgacaacaatcgaaatcacgaccccttttttgaccttgggccagtttctgaaagaggcgggattgatcgatagtggcggtgcggccaagtggtatctgggtgaaaactcagtgacagtcaacggcgcagctgaggagcgacgtgggcgcaagctgtatccagatgatcaagtcagcgtggccggccaaacatacgtgatcgtgagcgcatgaaactggatcacttggtgctgaaaaattatcgcaattatgctgctgttgatacaacattttcaccagaaatcaatgttttgattggggcaaacgctcaaggcaagacgaatctgcttgaatcaatctatgttttggcattggctcgcagtcatcgaaccaacaatgataaggaactgattcgctttggtagcgagtttgcacgggtttccgggcaagtttcgcgacaaagcggttcccatcagttggagttgattatcagtcatcaaggcaagcgtgcccggattgatcgcatcgaacaaccgaagctttcccagtatttagggcattttaatgtcatcttgtttgcacctgaggatttagccattgtcaagggcagtccggctgggcggcgtcgcttcatcgacatggagtttggccagatgagtcccaagtacctttataatctgagccaatataaaacgtttttgaagcagcgcaatgcgtatttgaagcagcttaagtatcatcaggccaaggatctggtttatctggatgtgttgactgactcgcttgcagctttcggggcagagctaattacggcgcgcgctaagttgttggagacgatgtcggattatgctgcaacgattcagcaagatatcaccaaggggcgggagtcattacatttttcttatcaaacacaggttgaccccagtcttcgcggtaacagtgagcaggtttacactgctttgggcgagatgtttgccaagcagcaagcgcgcgaaatcgaacaaggaaccagtttagtcggtccccagcgagatgatgtgttgttcatcgtcaatgataaggatgttgccaattttggcagtcaagggcaacaacgcaccacagcattggctgttaagctggcagagattgaccttatgaaggatcaaaccggcgaatatccagtgctattactggacgatgtgttgtcagaattagatgcggctcgccaaacccatttacttaaggccattcaaaccaaagtccaaacctttttaaccaccacaagtttggaaggcattcaaaaagaaatcatcgcaacccctgcagtctttaaagttgatgaggggacattagcaagagcgtgaaccagcccggttagaaaccggagtgtaagtgggcctgaacgtgatgaccgtactttggtcattgcgttcaggttccttacacgcaggtttctgggctggtgaacgcgtttaaagcagagcgtgaacaggcacgtttagaaaccggaacataagtgggcttgaacgtgatggccggtttttggccattgcgttcaaggtccttatgtgcaggtttctgtgccagtgaacgcattttaacaaggaggataaccagtgacggacaagaaagaaacggccgaagagaagaaggatgaactggcggctgagtatgatgccagccagattcaagtactttcaggacttgaagcggttcggaagcgtccagggatgtatattggctcgacaagcagccaaggcttgcatcatttggtctgggaaatcattgataacgggattgatgaagcgctggctggattcgcagcacggattgaagttgaagttaacccagataatagtgtgacggtaacagatgacggtcgcgggattccagtcgatatccagtctaaaaccggacggccagcacttgaaacggtttataccgttttacatgccggtggtaaattcggcggcggcggctacaaagtttccggtggcctacatggtgtcggggcatcagtcgtgaatgcgttgtcgactgatttggacgtcacggttactcgtggtggcaaacgttactacattgactttattcgcggcaaggtgaacacgccgatgaaagtgattggcacggcaccggagcacgaacatggcaccaaggttcattttctgcctgatccggacatttttaccgaaattagaacattcgatgataagattctgaccaccagaattcgcgaactggctttcttgaacaagggtctcaagttgacctttaccgacaagcgcgcggcaacgcacgagaagctggtattccattatgaaggcggcctcaagtcttacgttgactttttaactgagaaaaaagaaaacctgttacaagaaccgatttatgtggaaggacaagacaaaggcatcacggtggaagtcgcgttgcaatacaccaacgactatcacagcaccttgttgacgtttgccaacaacatccatacgtatgaaggcggcacgcatgagaccgggtttaaaacggcgctgacacgggtcattaatgattacgctcgccggtctggtgcgctaaaagacagcgatgatccgttaagcggggatgatgttcgtgagggcttgacggcggttgtttccgtgaagcatccagatccgcagtttgaagggcaaactaaaaccaaattagggaactcggatgcccgaacggtggttgaccgtaccttctctgaccacttcaataagtttctcatggaacacccagctgatggcaagctaatcattgacaaagccatgctggccagcaaggcacgtttggcggctaagcgggcgcgtgaagtgacccggaaaaagagcgggttggaaatttcgaacctgcctggtaaattggccgacaacaccagtaaggacccagagatctctgaattatttatcgtcgaaggggattccgctggtggttctgccaaatcagggcgtagtcgcctgacgcaggccattttgccaattcgtgggaaaattctgaatgtcgaaaaggcttcaatggaacgcatcttggccaatgaagaaattcgaaccttattcaccgcgatgggtaccggttttgggcaggactttgatatcaataaggctcgatatcacaaactgatcattatgaccgatgccgatgttgatggtgcccacattcggactttgttgctgacgttgatttatcgctacatgcggccagtgcttgacgctggctatgtctacatcgcacagccgccgttgtatcggttacgccaaggcaaaatgacgcaatatatcgattccgatgaagaattgcaagacattctaggccagttgccgccgagtccaaagccagagattcagcgttacaaagggcttggggaaatggacgccaaccagctatgggagacgaccatggatccggataatcggcgcttactgcgggtatcgccaaaggatgccgaagctgcagatggcgtttttgaaatgttgatgggtgatcatgttgaaccgcggcgtaaatttattgaagataacgctgtgtttgttgatccgaacaacattgatgcttgattgatcagtttaactaagtcagcttttgcatgagaatttttgagaggagacttttcgcttaatggatgatcgccaagaaagccgaattaccaatgtgaacctcggcgaaacaatgcgtaaatcattccttgaatacgcgatgagtgtcattgtggcgcgggccttgcctgatgtgcgcgatggcctcaagccggttcaacggcggattctgtacggtatgaatgaactcggcgtgacgccggataaaccgtacaagaagagtgcgcgtattgttggggatgtcatggggaaataccatccgcatggtgatagctcgatttatgaagggctcgtacgaatggcacaggacttcagctatcgttacatgctggtcgatggccacgggaactttgggtctgtcgatggtgacggtgccgctgcgatgcggtataccgaagctcgcatgagcaaaatagcagtcgagatgctgcgtgacatcaacaaagatacgattgattttcaggataactatgatggcacggaaaaagaaccggttgttttaccggcacgttttccaaatctgttggtcaatggggcgactgggattgcggtcggtatgacgaccaatattccgccgcataatctgtcagagactatctcggcgctgcacgtgttgatggataatccagatgccacgacagctgacctaatgcaggcactgccaggacctgattttccaaccggcggcgttgtgatgggtaagtcaggcattcgccatgcttatgaaactggccgcggcacgattgttttgcgcgggaaagttgatgttcagacggagaagtctggccgtgaacggatcgtgattaccgagattccatatatggttaacaaagccaaaatggttgaacggatcgcagatttggttcatgaaaagaaaatcgatgggatcgtaaccttgcgggatgaatctgaccgtgacgggatgcggatcgtcattgatgtgcgccgtgatgctagtgcatcagttattttgaataacttgtacaagctcacgccactacaaaccggcttttcattcaacatggtggcaatcgttaatggtgcgccaaaagtgttgagcttgaaacagatcctgcaatattatctggatcatcaagaaaacgtcattcgtcggcggacgcaatttgacctgcgtaaggccaaggctcgtgagcatatcctcgaaggattacggattgcgcttgatcatattgatgaaatcatcacgattatccgtagttctgaaactggcgacaaggcaaaagtcatcttgatggacaagtttaagttgtctgacaagcagagccaagcaatcttggatatgcggctggttcggttgaccggtttggaacgcgagaaggttgaaagcgaatataaggatgttgaagcagcgattgctgattatactgatattcttgctagaccagaacgtgttcatcagatcatctacaacgaattgctggatattcagaagaagttcggcgataagcgccgtactgaattactggtcggtgaagtgctcagtcttgaagatgaagatctgatcgagcaagaagacgtggtcatcacgttgagtcataacggctacgtcaagcgattggcaaccagtgaattcaaggcacaaaatcgcgggggtcgcggtattcaggggatgaacgtccatgatgacgatttcgttgaacgcctgatttcgacttccacgcatgatgtcctgctcttcttcaccaacaaaggtaaagtttatcgcagcaagggttacgaaattcctgagtacggtcgaaccgcaaaagggattccaattatcaacttgcttggtgtcggtgccggtgaaaagattcaaacggttatcaacgtgcatgaaggcgaaaatgatgatcgttatctcttcttcgtcacgcaaaaaggcgttgttaagcgcacaccggtgaaggaattcgccaatattcgcagcaacggactgattgcgttgaatctcaaggatgaagacgaactgaataatgtcatcctaacgtccggacaagacaatatcctgatcgggacgcatctgggttacagtgtgaccttcaaggaacaagacgttcgctcaatgggacgttcagcgactggggttcgaggtattcgtttacgtgaacacgattacgtagtgggttccgacattctcaaacccgattccgaagtctttgtcatttcagaaaaaggttacggtaaacggacggcagcgaaggaatatccgattaaaggtcgtggcggtaaagggatcaagacagccaacatcaccgccaagaatggtccgttggcaggggtcaccaccgttgatggtaccgaagatattcttgttatgactgattctggtgtcatgattcgcttcaatattcaaagtgtttcgcaaactggccgagcaacgttaggggttcgtttaattcgagttgacgacgatgccaaggttgcaacgatggccaaggttgaaccggaaagcgacgatccagacgatggcagcaagccagatcagccaactagcccgacagacggttctgctgaaccaacctcgcagcagccagctgatggttcgtatgctggcgatgccgatcagcaagtgagccaattgcttgatcgcgctgaagctgatcaaccagagcaacatgatactggcgaccagcctgaataatctaataatgctagcatcaattgagctgattcacgctcaataaaaataccggtcgaaatggcaatttgccacttcgaccggtatttgtttgcgtacagataacctcaaatcgtgaaggttgattggttgcccatgcgcgccttaagttcacggatgatcttaacgccgctgctggtaccgatgcgagtagcaccagctttaatcattgccaaaaaggtatcaacatctctgataccgccagccgctttgacttgcacttgatcgccgactgtttctttcatcaaagccacattttcgacagtggcaccggctgggccaaagcccgttgaagtcttaataaaatcaggaccgatgtccttagcaatagttgccattttgatgatttccggcttggtaagataggcggtttcaaaaatgactttgcacggtacattgaccgcatgacagacagcaacgatttgacgcatttcattttcaagataactgtattgctgttccttaagcgccgtgatattgatcacgtagtcaatttcgttggcaccgttttgtaaggcgtctttggtttcaaaaactttggccgcgatgctcctttggcctaaggggaaagcaattgcggcgccaacatcaatgtcggtacctgctagttgtttcgcacaaaaagccgattggacttggttaatcgccaccattttaaaatgatattgtttggcctcgttgcaaagctggcgcaaatctgcgtgagttgcatctgcatgtaagtttgtgtgatcaatcatgcgactgaattgatctaaagtataagctgtcatgatttttcctccaaagttgaattcgtttacatttagcataccactttttgcgtaatgtatatctgacagcgataaatagtacggtgttgtgcaagcaaccatgcagaagaaaggtcattgcggtcaaggtccttatgtgcaggttgctgcaccagtgaacgcgtttagaggaggagaagcgaatgttgaatagtgtgagtctaacagggcggttgaccaaggaacctgaagttttccgaacggctaacgagcttgatatcgtccgatttacgttggcggtgaatcgcgttttcaagaataaaacgggacagcgcgagactgattttattgagtgtgtcatttttggcaaacgcgccttaacttttgcgggatcaactaccaaagggtcattgttgggtatttcagggcggctgagtaataatcattttgaaaataagcaaggtgagcaagtgtggcggaccgctgtcgtcgttgataattttgcttggttggagtcgcgagccacgacggaaagccgccgggcagggaccttgcaggcgacaggaacagacgacgtcatgccagtagaggaaggcaccccgccacaggtcgcaaccgacgatctgccattttagtggtggtattcgccgcggatctatgctacaattttaactcgtgagtatccggctattctatagccttagtactctccttgctccggcaaatgaccggggcctaaagtccataaggaggtgaatcgtcatggctgaaaccaaatatgaagtcacttatatcatccgtccagatttggacgatgctgcaaagactgaattggttgaacgttttgacaatattttgaaggaaaatggtgccaacatcattgattccaaggattggcaaaagcgtaagctcgcatatgagatcaacaagtacaacgaaggtctctatcatatcgtgaacttgtccgcagaagatgacaaagcgatcaatgaatttgatcgtcttggcaagatcaacaacgatattctgcgtcacatgatcgtgaagcgagaagactaatcgtaacttttttgaaaggggcgctacggcatgcttaacagtgttgcattgacaggtcgattaaccagagacgttgatttgcgttacacgcaaagtggcacggctgtcggttctttcacgctggccgttgaccgccagttccgcagtgcaaacggcgaacgtgaaactgacttcatcaattgtgtgatctggcgtaagtctgcagagaactttgcaaacttcaccaaaaagggatccatggttggagttgaaggccatatccaaacgcgtacgtatgataacgcgcaaggacaaaaggtctacgtgaccgaagtcgtcgttgaaaactttgcgttgctggaatcccgggcaacgactcaacagcggccgtccgaaccggcaaatccagctggccaaggtaatcagaactatggcggcgggcagcagtttggcaataaccaaccgcagaatccgccaagttttggttcacaaggcgccccgaacaatgcatcatcaccgaatccgggtcaaaatccggcagcaagtcagaaccaaggaggcaactccgcggctaaccctgctaatcccgatccgtttgctaataatggcaagccgatcgacatttccgatgatgatttgccattctaaggtgtgactcaaagtcgcactaaccgcggtaatcccttcaggcgaagggttatctaagtggaatctttgataagggaggaattctcatggcacaacaacgccgtggtggccgtcgtcgtcgtaaagtcgacttcatcgccgcaaaccacatcgaatatatcgattataaagacacgaacttgttggatcggttcatctcagaacgtggcaagattttgccgcgtcgggtaaccggcaccagcgctaagaaccaacgtaagctgacgatcgcaatcaagcgagctcggattatgggtcttctgccatttgtttcagaagattaattggtattcaaaaggacgttcctgcttaactggcgggagcgtctttttttgtgtgagcgtgaattggcgcgggtagtaaccggagcgtaagcggcctaagtcgtgatgaccggtcttgggtcattgcgacttaggtctttacgtgcaggatactgcgccaattcgcgcgttatgatgaattttgacgcctttaattgttattttcgatcctgtcacaaagaagagaagtgtatgagaccaatcggtaaaacagcaagcccttttctcgaaataaattgaatactggctaaaaacattttctatcatgaagcagaccaatgtatgacgattgcaatatttatcacaagcttattgttatataaaataacgagatagttctacaatagcggtgatcaggaatacagggaaaaatgacattattggttaatagaggtgatcaaaatggggctcacgttagccacgattccgctggctgtgacgaatctctcacgcatgcagtttgcggtaaccgcgatcacgcattttctatttgtaacaacgaccattggcatgttgttgacgacgatgatttttgaatttatgtacgcgtatggccgtggcgatactgaaaagtatggccggctgaccttattcttcagtcggattttcttcttcagttttgggacaggtgttgttaccgggctgatcatggagtttcaatttgggatgaattggtcggcgtttacgcggttgatgggtgatgttgccggtgtaccactggcgatcgaaagtatgatttccttcttcgttgagtcgaccatcatcggtttatggcgctttacttggggtaagttgccaaaacgagcacatgcttggttaggcgttgggatgttgggtgcatcgcttttttccattgtctggatcattgcaatcaatgcattcatgcaaaatccttatggtttccgtctggaaggtggccgtgcacggctcacgagtctgattacgttattacagaacccgcaatatcggccggaatttttgcatgttttattcgcgatcctgatcaccggcggatttttgacagcagggattgctgcctggcagattctgcacaagcgtgatacgtcagcgttcaaaattgccgttcaaattggcttactcattgctttgccagcagcattcttacagccggcacaaggcgacgatcaaggtgccgcaacagcagcgttgcagccgatgaagtttaccgcaattgaaggccggtatgagacggaaggtagtcccacaactggggcaccttgggcgatggctgcgctgatcaatgaagacacgcacacaaccaaggccgtgtcgattccgaacatggggacttacttcggcaagaacacgttcactggcaccatgccgggcatgaacgctgttgccaaaatgtatcacgcaaagttcgataagacggttgccaagtcgtacgatggccagatgacttattatccgccagtgaccctgctgttctggaccatgcatttgatggtttatgcggggtacttcttcacgatgttcgcgttgtttgcgacgatcatgctgcatcggcggcaatcggcaatcgaagatcatcccaaaacgttgcggacactcggttgggtactatggctgccatatttgaccttcacatctggctggatcgttgcggaagttggccgatatccatttgtggtttatgggctactcacgcagtacgatgcggtttcaccgagtgtgaccgtcactgaggctggtacgagtctggccttgttcttaatggccgatatcttcttagtgaccacgatgatttacatttcacatcgcactgttaaacgcagtttgccgcaaatcaccggtgattatccagaagatcgcacaattccggatccatttgcaaaggaggcgttcagtcatgcctagcctttcaaatttacaagtgatctttctaggtatcatttcgactgagctgatgctattcttcgttttggacggcgctgatttcggagccggcatggcgacattctttgttggcgatgatctatccaagcgtcaacaaattatgaaggttactggaccagtttggggcggtaatgagtcttgggcggtcaccgcctttgcagtgatgtttgcggcttatccggggtggtactcagcgttaacatccggttattacccactcatcttccttatgctgttctttctgatctttcgcggggtctcgtttgattatcgcaatcaatggcacagtcgccactacaatcgcttctgggactgggcacttttcattggcagtttaatgccaccattcctgttaggcattatctttagttccacagtaagcggcgtgccgattcgcaatggcttcgtctacgccagcatgggtgacattctgacgccattcagtatcctcggcggcattctggccgttctcttcagcctgaatgttggtttgaatcgggtcatcaaaaaagttaccgaaccggtagcaacaagtttgaccgttgcgttaaaacgaaccacttggatcctctatccagcgctcgtcttgtttgccatcttattgccgtttaacacgcagttctttaccaaccggcctgtcattgtcacgttactgctgattttactggtggccttcctcggtgttgaaacgtgggcaatcagccaacaacgacggcgtgtagccttttggcttagtgtcggcaccatggccagcttcatttacaccatttttctaggggtctttccaaccctgattgttggccgaacggcgggtacctccattacggcgttaacagcaacaagcggtccggtttctctgttatggacagcgtggttgttcggcttcacgattatcttgatggtgggtttgcaggcaacagcctatcacctaatcaataagtactaccacgagccggcatcgccaatgatataagcggcggcgaaaagaaggtgcatatgatgaaaaagatctggatcaatatcttctgggggctgttagtcgtcagcttctggctctatcagctcttctggccattattctggaacccgatcagcaagttctatgcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccccgcactgaaccatcgtcccagacgtattctgaactatcttcgcccatgcgattactaccgatgcatggcgtaacagcctagaccactatcaagaattcgttatcatcgttgcacttgacttgaaaattgaggaccggtgaattgttgtaatgaaacagaaccggcatcatcggtgccttctgcactgaccgtcaaatttgcagcttttgcaacatcgatttgacctgcgccttgacgccgaggagagatgatttgtccagggtaattgatatcgagtattgggttagcggcattcatcaaggctagtttcactgccttcacgagttgcgcaccagttaagtttgtactgcgtttcagattttgcatcaccagtaagctggcaccggtaacataggcatttgcctgtgaagtgccgctcacttttccaagtccatcattcagtaaggtagaggcaactttttcaccaggtgctgtgatatcgggttttaatttgtaggatgctgttggtcctcatgaagaagcggatatcaaagcggccttagcatccagaacatcgtttccggcagcaaccgccatagctgatggcgttgcgctaggtgtcgtcaaagttgaagcattggcaggctgataactggttgtgatcccatttgaagcggacttgtcgtaaataaccccggcgtgaccattattgccggtagctactgtcacaaaaacaccatgatcggttgcaaatttaatggctgcctgtcctttagcggtaggatcatcaatatcgacgcccatgccaaaggaaatattgatggcattcgcacctaagtccactgcatcatagatggcccgcgcggcattattaagtgagtcagaactggacttgcctagtattttcatgctgagaagctgggcttctggggcaatcccagttacaaatttctttgaatcactaggttgaccattggcagcgatgataccagcgagatgttgaccgtgattactcgtgtcaaattttagattttcgttgacgttattggtgtaatcgtaaaagaatgggatcttttcattgacataatcgccatagccatgacttgcagtgaatgctttgatttgatcctctgaaagtgcagccgttttggcatcgctgagtcgaaagtcttgatgtggctcaacaccttgatcaataacggctgccaccatgccttgacccttgatattttgatcccagagcggttgaacattgcctttagttagactggctttgttttctgggttggatgttggagctggttttgctggggctgctggcgcctgttgtgcgggctggctaactgttttttgagcagttttggtattggttgttgtcggggtggagggggtgaccgatgtcgtttgagtaggttgttttgccttagctgatgcttctggtttagcctgtgacgctactggtgctggtgtagcaggcttcgcagtggctgtaggcgcggaacttgcatctgttgttgttggggtgtcggctgaggacgttacttgtccagtggtcgtggatgctggcttgttgacgggtgagtcagccgatgtcgcgtctggcgctgcttgattagattttgtttgggttgtcgttggtggggtagtggcatcagcagaaacaccttgagcaggttgcatcatcagaaaactcgctgcaccaaaagtcacgatggcactgtagacccaatgtcgccctgacttatacattttgtagcggcgcttttcctgtgaaaatggcttgactctgttcatttttatttcctccaatggtatttaaagcagtcggtagtaaccggcgccatcagcgatatgtgtttcaataagtgatccagtgaatccttgtttgtaatttaactcgttataaaactaatgtcaatcataaggcatagaaaattaacccggtttaacgttttatttagttattactataggaggtgaataattaaacaattataaaaatattcagataggtgtttaacgaaatggctagatttatttaacgatggataatcataaaataaacgaatcaactaaattatttgtgtgatatagatggataccatatgcgtatcacgatgaacagacgcttgttttatgacaggcgttgcgcgaactttaaaaactttcaatcagacagaataaaaatcaatgccttcaatcaaaaattgggttcaatatcaggctcaccgttacgaaaaaatgctaagtactgtttccagcaattagcattttctcttggctgaggttgaaggaatactgaacacaatagtttttgtggacggctttcccttgtttaagaattgaccttgtttttctcgcgtttcttcttatcagtgacaactatccctagcgttgtcatcaggctgatgatgatgacccctagaatttgcaaggcattacgatgcgaattcgccatttgtggcaacttggagctgacaccggattgagcgtcgtttctggtactcatggcaggtgttggggctgcgttgattttggtggctaggtcattgtcagtggtagcatttggtacagtgatctttggagcatcctcgtcaccaccattagcggttgattcaaaggaatcctttcgttcggttttgatggcagcgtgcgcactgacttccttttcattatttttgtcgtctttaaatgctctcttagcttttggttcagtggtcagttctgtaattgccgatttaatgccctctttactaggcatttttttcttcccattttctgttaaaacagaagcgaaggcagctccaatgtcgatcttctcgtctgcgattgctatcagagcggtatcactggcgttagctttgtcgcttgagtctgtgtcggctactgaatcatgagcttcatgaatgaccgcttgcgaagaagtctcaggtttagcagctttttcttcgttgatatcgctgctatcttgaggcactttgtcattgagaaccgctgttttcacgagggtatctttgacttcagtgtcagtcactactgaagatgaatcatttttaggggtggtagcgtcatcaaaagagacattaccttgagcgtcttcgatactgtcaacagctgatttcgcatcattggtgtcttcaattgccttatcgtcattgggggccacttcacctttagatgcttcggtttcgctaagggcttcctgcgaagaaatatcacttgtagcatcgttgtcctcgtttgaagtcacgttgtctttagacattttggcatcactaaggaccgcttcaaaagaagtatcttcatcaccatccgaagttgtctcatccccaggttccttggcttcacttgaagtcacgttgtctttagacattttggcatcactaaggaccgcttcaaaagaagtatcttcatcaccatccgaagttgcctcatcctcaggttccttggcttcactgaaaatttcctctgccgagatatcgttttcaacatctttatctccgtctgggaaaatgttttcgtcagattctttggcttcgctaaggactgcttccgaggaagaggtctcttcactgtcgttgccgccatctgggactaagtcatctttagctttttcaactaaatcttcgtcaacgacatgttctacaaaggcatcttctgcagaatctttgacttcacgatcttcactttgaggatcccgcgtatcatcagaagccattacagcactagcgtcagtcacgccgtcgccgtcattagccgattccgtgcttgaaatttcaggactatccgtcaccgtttgatcttcgacgtcagattcagattcttctttaacatcaactttcttgattttgaacattttgacagtgcggttgccgacttgatcgacggcttccaacctgacaatgctcgtaccaacgggcaaaatatatccgcgcttaaacggcaccgggtcatatgggttcgttctgtttgcgcctgcctcagctgttgccgccggttgatggatgttgaaaccagcacgagcatgctgagtgaggacattgctgccgttactgtaaagacgatagccatcaacgttatcgtcaatggtgccttcaagggtaaaaatatcggcactggtttcggcggtgtagaccccgtttgcgtcaacggtcatgtcatctgtgtcactcacggtcaatgctggtggtgttgtatctaaaatgatttgaaggaagccgtcagtggtcactttctgaccagttgcgttaatgctcgttaaggcataaccgacattcttttcttcagttgatttgaaaggaaccgtgacgtcaaacgaaccatctgctgcgatgattgcctgattttgcgggtcactcaaattcggcgtggcaaaaatctgcaagtcggtatgcgaaggatctttaatttttcctctgatgtgaagcagttgatgctcggcatcatagcaatgactggctttatcgacacctactaaagtcaagctgttgtcgttcagatcggtaaacatcaaaccgcttgttggcatggcgcttaacaagttgtccgagaatttccgccccggcaatggttcggcactgcttaatcgcgttgcagcgtttttggccgttacttcgtcatcaaagctttcagttttggtgttgtcattgctataagcgccagcgtcaggatcgtggaaaaccaacagcgaaggaatagccggtgatttgatgaaggttccgaattgtggctcataaagcgcataaacgtctaggttggcatagaagttggggttttcaacatcgaaagtagcgatgccggtggtttggtcgcttctttcaacatagacattgccggtgacactatcttttaaaacgacaagataatcaccatctttaggcaccatcacttgaaccgtgtacttgtcatctttggttctgatttcataattgccatccattctgagtccgttaccatgaacaatcggaattgaccagcgaacttgtggcgtcggcgtggtgtccacttctggcagatactcgccggcaactgcttgaatcgtctgacggctgctgttgccggccaaatcggtgattgtcagcgtcagtttgccatcgcctgcttccagcgcgtcaagttgatcgtcgcttagctgataggtcacggtaccggtgtttttagttccttcattgccaagagggacttcataggttcgcaatccgatggccaatactgcggcgctatattgggtgaagccgacaccttgatcttcgtaattgaaggtgatgtcgccattgtcataagtgaagtccgtgatcgtcggtttgacggtatcaatcgcaactgggagattaataccttgccgatttcttatcccagcagtgtaggtagtgccaacaaactggtaaacatagcgaccatcttcggcagtcaccaacttgcctgttgctcgatcataaactttaccgtcccatttgaaaccatcaggatggcgccgcatgctatcggacagggtcaaatccgtattatagttagtatcttgcatgtaatgtgacttagcggtgtcattttcaagatcaatgacccggacaagatgaccgtctgtgtctagaatttgggcggcgacctgttgaagattttgtttaacaaaaatacgcgggatgacggcatctgaaaccccatcgttattgggggaaaatgccactttattgtcttttgcagaggcggcaacggtttcccaattaacgctataactaccgctgttaacaatgtcgcttaaggtgagcggatcggcaatgcccagtgggtaattattttcatcaagcaaatagctgcctgtaaaagtacttcgaccttcattagcagcattatcaaagacgacttctgcattggttgagccataaaaacccatgtaaggcatggaaatggattgactgtcgtccgcagctttgaaggagatgaagccttcaatgacttgatgcagccggacagtttgatctagggtcaacgtgaaggccacggtttgtgacgcgcctgctttcaaagtgaaagttggcgttgcagttgttagcgtcgcacctggcaaggcaacagcataaatgccattagtgtgggcggtgtcaaaggtttgcgtgaggggatggccgggcacaaccgtataagtttgatcggttgtgccgtggttggtcaacgtgatagtaaacgttggtgctgcctcgaattgttgcaaggaaacggaaccggtttgatcagtaccttctgccgtcaccgttaaaccgctggctttggcgacatcaatttgaccagccccttgacgtcggggtgagacaaagttgcccggataatcatgatccatcataggggtagcagcattcatgagcgctaatttgacagctttgacgagttcaacaccagttagcttagttgtttgcttgagatgctgcataacgagtaagccagcacctgctgcataagcactggcagccgcggtgccgctcttggtcgctaacgcgttgtttttgccaatcgagacggatttttcaccaggtgtcgtgagatctggtttcagtttatagtcagtagttggtccccaagacgagttatacgccatggcggatttagtacccagcgctgaattttccgaagcaacagtgagggcactaaggccgccacctgtcagcgaaagcgtgctatcatttgtcgtgatataaccagccgtggtgccgccggggacggaggtgccgtgaatcgccatggcattaccgttgttactcgtggttttgatgacaaggacgccgtgatcggtggcaaattgaatcgccgcttgatcttcagcagtgggatcttcaacatcgacaatcttggccagcgataaataaatcacatctgcacctagcgagaccgcgtcatacactgcacgggcaacgttatttgtggtcagtgattttgcttggcccaaaaccttcatgcttaggatctgtgcttccggcgcgaccccgaggatatagcggccatctggtctttcttgtccattcccggcgataatgccggctacttgttcaccttgaatatgattatctaaatgcagattagtattgctattggtggtgtagtcatagaaaaaaggcagcttgtcattgagataggtaccatagccgtgactagcagcaaagtcggcaatggtttcttttgaaatcttggccgtcgtgttgtcgcttattcgcaacatatcatgcggttcaacggcgctatcaatgacggcggcaaccatgccttgtcctttaatattttcatcccaaagcggttgcacattccctttggttaaaacggcctgattaatcggtggtttggctggcgcaggtgttggctttgtttggaccgcagatcgcggagaagcggttggcgccatgactggtgacgctggtgtttcaacaggcacagtgactttaactttatcggttgcaacaggtgcagtttttggcgtagcggttggtgttgctgatacgatcgatgcggcatggctgtcagacgctgccttcgaatggtcagccggttttgttgaaggcgcttcgacttgattggccgctgatgttggctgagtttcaattgcgggggccgctggtttgtcaacgctgggctgggggttatcagtgggagtcggtgatgcggtaacgggctgtttgtctttgagttcggtatgcgatttggcaagcgtcgtcgcgctggcagtcggtgatgcttcatcagcaaaaacggtttgcgttggctgaaacatcagaatgccagctccgcctaaaacagcaatggcactataaatccaatgccgtccggccttatacatcttatagcggcgtttttcctgtgaaaagggattcagtttgtacacgttatttcatccggtagtcattaaaacaaaatcttgaaaagtgagttgtagcagctctagagaagcgagtgtcttgctcattttctctcatgtctgtaatttatcctgatataaaactaatgtcaaccattagaaaaataaaataaattggttttagtatgttagctagttgttaaaataaacaattcgcattatattaattgacttttaatcgacaattgaatttctaaataactgaggatcttaaaggttatttagcagcatttaaaaattgaattatcggtaatatctgcggacacgatcagttgagaaacggcctgacacgcaagttcaataaccgtattttcacgcatgtaatttttttaagtcgctgagccgatttttggcgaaaagaaataagtctgtcgatttcaaccgacaccgtgagcttttcgatacttggcaaccccgtaaccgtctggcttggcgtataatgagcgtaatcttacaattcgaggaggaaattatgactgaagcaacgcatttttatcaggcatttcaaccggcacattatgagctttacttggctattaaccgggcaaacaaaacgattaccgggaaaacaacgattactggtgaggcgaagcaaaccgcgatcgcccttcatcaaaagtatctgaaggtgagtgcccttcaggccgatggtcaggatgtaccgtttacgattgatgatcctgcagaagcgattcgcatcactttgccccaatccggaaaggtgacgctgacgattgactacacggcaccattgacggataccatgatggggatctatccgtcttattacgaagttaatggagtcaaaaagcagattattgggacacaatttgagacaaccgctgcccgtcaggcttttccaagcgttgatgaacctgaggccaaggcgacatttgatttggctatcaaattcgacgaacagccgggtgagacgatcatcagcaatatgccggaaattcgcgaagaaaatggtgtgcattactttgacaccaccgtgcggatgtcgacttatctgatcgcgtttgcttttggcgatctgcaaaataaacaaaccacgactaagagtggtgtgaagattggcgtttttgctaccaaggcccacaaaccaaacgagttagactttgctttggacattgccaagcggtcgattgaattctatgaagacttctatcaaaccccatacccattgccgcattcttggcagttggcactaccggacttttcggctggcgcgatggaaaactggggattggtcacctatcgtgaagcgttgctgacgattgatccggacaatacctccctcgaaaccaagcaacgcgtggcaacggtgattgcgcacgaattagcccatcaatggtttggcgatttggtaaccatgaagtggtgggatgatttgtggttgaatgaaagtttcgccaacatgatggaatatgtcgcagtggatgccttgcagcctgattggcatatttgggaggctttccaaacccttgaagcaccaatggccttgcaacgtgatgcaacagatggcgtgcaatcggttcacgtgcaggtggaagatcccgccgaaatcgattccttgtttgacagcgccattgtttatgcaaaaggtgcgcggatgcttgtcatggtgcgagcactgattggcgacgatgcgcttcgggctggcttaaaagcttactttgaagctcacaagtttggcaacgcagccggcgctgatttatggacggcattaggtaaggcgtcgcatctggacgttggcaaaattatgcaatcatggttggagcaaccgggctatccagttgtcactgcagctgtggtggacggcaagctgaccttgtcgcaacagcaattcttcattggtgctggcaaagatgtcggccgccagtggcagatcccgctgaatagcaactatgctgtggcaccccaaatctttgccgagaaaaaggttacgcttggcgactatgcgcaattacgcaaggaaaatggcaaaccattccgcgtcaatgttggcaacaactcgcatttcattgttcagtacgatgaacaattgatgaccgatattctagccagtgtggatcagctgaatgcgattgaccagcggcagattatccaagacctgcggctgctagctgagggtcgtaagaattcatacggcaatattgtgccattgctgccgcggtttgctgcgagccacagcgcgattgtcatggatgctttgttccgcgtagttggcgacttgaagaagtttgtagcccctgattcagacgctgaaaagcagttacaggcattctttgacaagctcagtgctggtcagcttgatcgccttggatggacgccgaaagctgatgaaagcattgatgatcagttgacccgtccatacatcctgagcatggcgttatatgctaagaatccagacgcgattgcgcaaggacatgagttgtttacagctaatcaagcacaattggttgctttgccagctgacatccggatgttcgttttggaaaatgaagtgaagcattttggcaatgcagacttatttgatcagctgctaaaagcctacacgcaaacgacagattccagttataaagctgatattctggcagcgttgaccagcacaactgatccaacgcaaattgccaaattggttgataagtttgaggatgcggacacgattaagccacaggatctgcgttcatggttccgcggggttctgaataaccatgctggcgagcaagctgcgtgggactggattcgcaatgaatggcagtggcttgaaaaaaccgttggcggcgatatggaattcacgacctacatcactgtgatcgccggtgttttccgcacgccggaacgattgacggagttcaaggccttctttgaaccaaagctgcaaacaccgggtctgacgcgggagatcactatggacaccagtgtgattgccagtcgcgtcagcctgattcaagctgaacaacaggctgtgcaagctgctgtggcagaagctgttaagtaaagatttttaatccaatatctgcaaaccgtcactttgaaaataggtggcggtttttctgtgtgacatgcaggaacataacttataactgacgaataagggcgaataactatccgtattgggtagtattgcaaaaaatatcataagttgtttgacttttctgtttcatgaataatttgatggggtatgaagacaccagtgccaaggcggagcagtcgtaggccagatggggctcagccgtgcaaacaacacagcgactgggcttgtcgctgatgttgttgggctcgaagcgccgtcaccgctctagctacgcgtcgccagccccatctgaccggagattgcggagtttggcacggcatggcgtctttagccaattgattttcctgcgattgttggccacgaagataaagcccaacgctcatttcacatttttcatagcttataatggttaattcacaacgttaatttaagaaaaatctaatcctcatctatacaatttcacgggaaagaaaacgggttaaaccggtacactaaaaaatgagtcgctgttgattgatggacaggcggctgtttggagggatttttagtggcagatacaaagaaacaactgcgctggtataacgtggcgttaattgcattcgtctcggtctggggcttaggcaatgtgttcaacaactacgctcagcaaggcctttccgtcgtgacaagctggattttgatcatggcgatttactttgtgccatatgctttgattgttggtcaactcggctccacctttaaggatcaagccggtggggttagctcgtggatcaaagaaaccggtacggtcaggttggcctattatgctgcttggacctattgggttgttcatattccatacttagctcaaaagccgcaagccattctgattgcgttgagctggttgtttaaaggcaacggcaatttcgtgaataccgtctcttcaatgaccgtatccttaatttgtttagcactcttcttgctatttttatggctgtcgtcacgtgggttaaccactttgaatcgcattggcagtatggcaggtacggcgatgttcttgatgtcgattttgtttatcattttggctgtcactgcaccgctcatggtcaaaggcgtgcatgtggccacaccggatatgggcgacattcatacctacttgccgaagtttgatctgaattacttcaccaccatttcgatgctggtttttgcggttggcggtgcggaaaaaatttctccgtacgtcaataacacgaaacatgcggcaaaggaatttccaacggggatgctggtgcttgccgggatggttgccttttgtgccttgctcgggtcatttggcatgggcatgttgtttaacagtaaccagattcccactgatttaatggccaatggaccgtataccgccttcgcaatgctgggcagttattatcatgttggcaatattttcgtcattctctatgccatcgccaacgcactcgcttccatttcggccttagccttttcgattgatgcaccgttgaaaatgctgctaagtgatgctgatccgcattttattccaaagaagctgagtcatctgaataaaaaaggcacgccgatcaatggttactggctgaccgggattttagtcagtttgctgatcattgtgccagcgcttggtatcggcaatatgaacgagctgtataagtggttgttaaatctgaactcagtcgtgatgccattacgctacttgtgggttttccttgcctattatttgcttaataagcatttggaaaaattccaagcagagtacatgtttgttaaaaacaaacatgtgggcatgattattggcggttggtgttttctttttaccgcattggcctgcttgttgggaatgttgccgaaaatcaattatctcaacgatccagggacttggtggttccagatgggcttaaacatcattacgccagttattttcctggcattgggacttattttgccgttcattgcgcgacgggatgaagctcggttactttagtaaataaaaattgatcatagtaaaaaaagtctgtgttggcatgccgaagatttcggttgtcagcacagactttttagttagcggtttttacattgaagttgaatgcatcacttaattgccgcttttttcgcgcagcatgtcactgatgacgatctgattgaccgtgttccaaaccatgtgaccgactgcttcggataagtgttcctcaaccggttgatctttagcgacaggcacaattttcagtgccggcattgcccacaaatgggcacctgcccaaacgcccaggccccacatactgccatagccaagtttaaaaagcggtacgtaatggccggcaacagcataaagcgcaccgaggcttgatgagaagccgaagtgtatgaggaggctgacccaaggaatctgatggtctgaataagtataagttgcatgggtttgtgctgcggtgagaccgtgttgctgcaggaatgtttgcggcggattggttgcgtcacgttcaggtgtccgcggcggcaaaatattttcccagcctaatttgacaagtcctgatactaaaccggcaacggcgccaaccgcggcaagcttcatgacagatgtttttgtttgtgtacgcatgcaatgacctccttgaaaatgtcttgaacacttccattttagaacagcgacaggcatttagcatggtctgatcttgttagttttggctttccgctaaaatggcgcgaacttgattagtgcaccgcagcctttaacgattaatagcgccagactattgacatggtgcatcaggcgcacattactggcgaatgtccgcatgatgggcatgaacaaagtcaatgaagtctttggcggctggggattggtagtgatcttttaaagttgccatataaaaaatacgctgccaagttggaaaactaagcggaatgattttaacgggtagcgttttaagaagtggcatattggggacaacggcgatgccgaagccgtttgcaacgagacccgcgacggcttcatcctcttcaatggcgtacacactgtgtggttggccgccgcattcggcaaaaagctggcggatgatgggcgcgaggccgcttcttttggagaaggtgacttgatcgaaagccaaggtttcactaagttcaatctggttgcgagtagccaagggatgatcagtcggagtgatcacgacgagtgcctgagaagcaattggaaaataggcaatatcttcttgctcgtcaacttttgagcaaaagcaaatatcataatgtttagcgcgtaagccttgaataatttgtggtgatagcccgttttcgttcgtgaattcaaaacggacatcttgttggctgttttgtaagaattcgcgtaccatgccagggacccagcgtgtgctgagggtacgtaaggcggccagtttaatcaccgtttgctcgttgttttggtgttgcaactgttcaatgccgctatcgaggatggttagcgagtgatccacaatgcgactgaactcgcggccttccgaagttaaaacaacgttgcgtccttgtcgaacaaacaaggcaagacccagttcggcttcaagaccatgaatggcattgctcaggctgggctgggtgatgtttaactggcgggcagcacgggtatagttctgtgatttggctaatgtaacgaaatatcgcagatgaaaaaggttcattttggtcctcctatgaaggcttaacctgaacgatagcctccagctataagcaccctcattataatgaattagaagtcgcttgtgcaaccgtatacaattcaatttgtaaacaagattgaaaaattaatcacaaatcattttgggaggcactatcatgacacttactcatccaattaccgtcagttcatggacattaggcgaccaatgcaaattcgaagatcgcgttaaagcagccgcaaaagctgggtacgatggcatcggcttacgcgccgaaacctacgtcgatgcgctaaatgaaggcttaacagatcaagggattctcgacattcttgatcagtatcatatcaagtgcaccgaggttgaatacatcgtgcaatggtgtgaagaaccgcggacatacgagcaaaaatataaggagcaaacctgtttccatatgtgtcacttgtttggcgttgaacatatcaacaccggtttgatggaaagctatccagttgacttcacggccaagaagttgcaggaactggcacatcgcgcagctttggctggtaatctcatcattgccctcgaaccgatgccatatagcggcatgccagatttgaagaagacttgggcgattctccaaggcgccggtgctcaaaacgtgatgatgttgttagacatgtggcactgggttcgagcagaccagccgttcgacttgctgacgaaggaacaagctaagcgcgtgatttcaattcaacttgatgatgcttacaagcggccatatgcaaagcccattttgcgtgacgagtcgatgcacgatcgcttagcaccgggaactgggtttgaagatcggactgaaaagtttatcaagatgattaaagaggctggcgtggatccaaaagtgattggcgttgaagtcatttctgatcactacatggccaaagggattgactgggttgccaaatatacttacgacaccacggtgaaaaccttgcaggcggcatggccggaaattttgaaggaaactgttgcgacacactaaaaggagcgtaatttttatggctgattggttaggtttgaaagacaaagttgtcgttgtcactggtgctgttggcggtatgggcactcatttttgcgaagcctttgcagagcatggggcgaagcttgtcttggttgatattaagaaagatgcgattcagacagcagctaagaagttagctgatcaatatggcgttcaaacattagcagtggcaaccgatacgacagatgaagatgaagtcgatgctgcggtgcaagcggttgtggctgagtttggcaaagtggatattctcgtgaacacggccgctatcttgcgtttttcaccgtttgaggatttgcgtttggatgagtggaagacggctgtgaatattaatttgactggttatttcttgatgtcacaacgatttggtcggcaaatgattgcccaacatcatgggacgatggtgcatatttcaacggttgcggctgatttcccagagacatacagcggggcgtacagcacaaccaaagctgcggtcaatatgttatcgaagcaaatggccgctgaatggggacagtttgggattcgcagcaactgtgtcatgccatgtctggtgaagacaccaatgtcggccgatttttacaaggatcctaacgtgttggacggccgtgagcacttagttgccagtcgccggattggcaacttggatgacatcgctaatgctgtcctttacttgagcagtgaccgttccgattacacaaacggtgatgaactgcgagttgatggcgggctgggcatcatgatgcaagatatgattccgaagccgggtggtcggcgtgaatacgcaattaaagcgcaccaagctgccaagtaatttgcaatattgatagaagcaacttgatcgcaccttgggtcaggttcttcttttcaaaatgctcgtgaaaatatgaacttaatggaggcactgaacatggagacgtggatttctggaacgactggtttgttgtgtttgctgggcagtccggttggccattctggctcgccagcaatgtataacttcagttttcaaaaacaaaaaattgatgcagcttatgtggcgtttgacgtgaccaaggagcagatgccagaagcactgaatgccatgcgccttttcaaaatgcgcggcggcaacgtcacgatgccgtgtaaaaatgtagcagcaactttgatggacgagttatcgccagctgccaagatcattggtgcggtgaatgtcgttgtgaatgatgatggcaaattgatcggtcacatcacggatggcatcggatttgttcggaatttgcaggaacacgggattgatatcaaaggcaagcatttggtggtattaggtgctggtggcgccgcgactgccattcaagtccaagcggcgctagatggtgccaaacagattaccatctttaatcggcaggatgaattctattcacgtgctgaatcgactgccaaaaagttggccgaggcagcacctgctgtcaaagtagatgtggttcagttggaaaatactgacaggctcaaagcagcgattgcggacgccgatattcttgtcaacgcaactactgtcggcatgaaaccagacgatggggtttcccttgttgatccgagtttcctacgcgcagatttggtggtggctgacacggtatacaatccgttgaagacaaagttgattgaagatgctgaaaaagctggcgcaaaaacagccccgggtaaaggcatgctactttggcaaggcgcagccggatatcaattgtggactggtcaggacatgccggtgaaggcatatcaggcatttgaagaagagcgtgaaccagaccggtctctggtgtagggaacatgtttaaaaacggaggcaacttgaacgatgaaaaccaaacgtaatcattttttgccgggtgcactggcactatatttttcctatgcgatgctggggattgcatcttccattctaagtcagtataaggcgcagtttgcttcgaattggggtgcgcaacaactgagcaatggcaccgttgacgtcagcatggtcgtgtcagtgattgcggcgttcgggttaggtcgcttgattgcctatccgtttgccgggccggtgtcggatcattttggccggaaggtttctgggacaattgggatcgggttgtatgtgatcttcttcatcggcatcatcacggtcaatagtttctgggcggcttatctcatcggtattcttaatgggatggcgaactcatttttggacacctgtgtttccccgagtctcatggaaatgtttccggaatcggcgtcaattgccaatcttctgacaaaattcgctgtggtcaccgcgcagtttatcttgccgttcttcattggcggcgttgcggcggctggcctgtcatttcggacgatcttcatcatctgcggcgtggcgctggctgccgatgccattgccattatcgttttcccatttcctaagcgggaaaaaccacagctgaatgcagctggcacgcctgaaaaaatgcatttttcaattgggtctgtggcggccattttaattggcttcactagttcgaccaccttcatggtttggttgaattgcaatcaggaactaggggcggcttacggggttaaaaatccagcaacgctgcaatcgttatacgccgttggtgctgggattgcggtgttgctgacggctcgtctgatcaaagctgggttaaaagaaagcaccgttttgatcctgtatccgacgattgcggtggtcatgttagccttgtgctactttgtgcagacgccggtcattctttacatcggcagctttgtgatcggttatgccgcggctggcggtgtgttgcaacttgccacctcaacgactatcagttttttccccagtcataaaggcacagcgacttcgctggtcatgattgcttcaagtattgcgaactatgcggtgttatccgccgctgccgggttgaccaaggcctttggcgatgcggcaccacggatgatcattcttttgaatattgtcatcacgattgtcggcatcggtttagcactggtcgtgaagacgcaggaaaagcacgtcctagcagtttcacaagtccattagcaaaaaggagttcggaacatgtcattaaaagatgaaattgacggtcacaccgttttagctggcttactggcgcatcctgctggccactcgatgtcgccggcaatgtataacgcaacatttgaaaaacttgggttaaatgatgcttacctgtcctttgatgttgatgcacctgaattggcacacgccttgcaagctatgcgcagcctgcattttctgggtggtaatttgtcgatgccgaataagcaaaaggccataccgttgttggacaaactatcgccggccgcaaaattgatcggtgccgtaaataccattgtcaatgaccacggggtgctgaccggccatatcaccgatggcacaggcttcatgcaagcactgagcaacgatggcttggatattcgcggcgagaaaatgacactggcaggagctggcggtgcggggacagcgattgcgattcaagcagctttggacggtgtccgggaaatcaatatttttaatcgtcgtgatgcttcgtggcaaaatgccgaacgtaatgtggccatcattaatgaccaaacgcaaggccatgcgacattgtttgcactcgatgatcaaccggcgttaaaggctagcatttcggattcagtgatctatgttgatgcgacacccgcggggatgaagccgctagaaactgttagtaatgtgcctgatggcgattggtttacgccagagacgatcgtgtttgatacggtctatgcaccgcgcgaaaccaagcttatgcagctcgctaaagaagccggtgtgaaccacgtgtataacggcattaacatgctgatcaatcaaggcgccgccgccttccatctgtggacaggcttacaaatgccagttgattatattcgcgagacggtgtttggtgaaccggcggcagtcgcgcactcgtaagcaagaagacgaattcaagcagtcagccacgcgcttaaaatcgtcatttcgacaaatcaaaaaagaagataatcttgtaaaaaagccctgatgccagtggcacactgacatcggggctttttgcattccgtggccatgtgccagcgttttctaagctgactgagcatgcggtcacctgctaattgaataaaaagtattcgcgaatatatcaacgtcaaaggttgttattggccttacatttagttagtatataagtactgaaagggaggatactatgaaatacctcattgaattcaaacgatgttggcatcagtcgaacggtcagggtatccacctgatgtgtccgggcaaatgaccacatgtggggtttcttacccacggtcacacgcaaagtttcttttaaggttaattagtcattatgagggaataggaggtgaaccttggaaaaatcgccactcaagatcggtattttgaacgtcatgcatgataaggctgacaccaaaactcggctacagcatgttttgacgcacactgccataccggtcgatttgcatttttactaccccatgacccattacgccggacggacggtgccggaagcggtcagttcaatcctcgatccgctggacattcatgaggtggcgacgatggatgggttcatcatcaccggttcgccgattgaaaccttggaatttgatcaagtgcattatatcgccgaagttcgaaccttgttgaaaatgttaagtcagcatgtccctaatcagctctatctttgctggggtgggatggttgcattgaattacttttttggcatcagcaagctaatcttgccgcataaactttttggcgtttatccgcaaaccattcttgagccgcacccacttttgaagggactcaaaaatgacttcaagtcgccgcatgcacgctatgccgaaatggatgtccgcggtattcatgccgatccgcggctcacgattaacgcgacaacgacgaagggcaaactcttcatggtgaccgaaccgactgatacgcaaactttcgtcttttcacacatcgaatacgatcggtggggattggattcagaatacaagcgtgaagtcgctgctcatccagagatcgactatgttcgcgctaaacattattatcatcacaaaaatgattacgatcatcccaagttcaattggaagaaaacgcaacgaacgatttttgacaattggattcaacatgtcgcggatcatcgcaatgacaatcattaggaaaatcaatcaactaatatggaggcttttaatatggtgacagcagcagataatattaccggtttgattggcaacacccctttgcttaagctaaatcgtgtcgtcccagaagatgcagcagatgtttatgtgaagcttgaattctttaatcccggcggttctgtcaaagaccgaattgccttggccatgattgaagatgccgaatacaagggcgttttgaagccaggcggcaccattgttgaaccaacatctggcaacactggcatcggcttggccttggtcgccgcggctaaaggctaccacctgatcatcacgatgccagaaacgatgagtgttgaacgtcgtgcgttaatgcggggctatggcgccgaattgattctgacaccaggggcggatggcatgccgggtgcgattaaaaaagctcaggcactcagcaaggaaaatggttacttcttgccgatgcagttccaaaatccggctaatccggatgtgcacgagcgcaccaccggtcaagaaatcatccgttcttttgatggcggcaccccagacgccttcgttgctggcgtgggcacaggcggcacgttgaccggggttggccgggcgttgcggaaaatcaacccgcaagtgcaaatttatgcacttgaagcagctgagtcaccaatgctcaaagaagggcacggcggcaagcataagatccaaggtatctccgctggcttcatcccagacgttttggataccaacctataccaagacattattgaagtcaccagcgaccaagccatcgacatggctcgtcacgttagccacgaagaaggcttcctgccaggcatctctgccggcgccaatattttcggtgccattgaaattgctaagaaacttggcaaaggcaagagcgtggtaacagtcgcgccggataatggtgaacgatacttgtcaacggacttgtttaagttcgaagattaaaggtacaattttgcagctggcattgatgaaatagaacatgaaatgaaagtggctcggtatctgacgaaggtcagctatcgggccacttttatatggataaaaattatctggaccatttgataaactaattaaatgcaagtatgcatcaactgatgatcacgggcatcagtccgtgattctttctttactttagtcatgacgatcaagatgggttcgtttgaaaatgacggcttgaatttttggctctttctgcaacagtcgccatgtatagaccagactagctgtggctgacatgatcatgatgttccatgtgcttgaggaaaagttcttccatacgaaaagatctttttcaatctcctcactaagttccgataaaacatccacatgccatcctgatagcaacgcaaacccaagaccataaataaagatcacgatccagcctaccaaatattgccatccgtggcgaatttcaatgataggaaggccattgacatcatgtttttgagaaacgtggatttttagaccagttgtttgaaaccagcccagaatggcaccaatcaagatggttaccccaagtgccaaaaaggtaggccgcttatgagaaactaataatataccggtcactaaggcataagcgggtatgataactaatgttaaccgtgagattctttcgaaacgaaagacatgacgagtgaagaaaaacaatgcagcaatgagtagtattatttgtgacatagggggcctcttattcaggattataaaggtagaacttaattttcaaagtttactgctttgaagatttcgaagcaataggacgatgcaaattattcgagaatggctataatgggacttataagtctccatggtgcaacggatagcataatggtcctcgaaaccacagatccgggttcgaatcccggtggaggcattatttagctttctttaggttattttagctttttaaaaagcttatgtatcagcatttacagcaatttaggtatctttatagttactttgtttttatttttcgggggacaaaaaggggacaaacacaatcatagctgatccatgaataacacggccttatgtgcttcttgttttctctgtgagtctaacaaatgaccatagactttcatcgtaatagtcacgtctgaatgacccaaccgctttgaaatataatagatgtcgacgcctttgctgatcaagtagctgacgtggctatgacgcaacccgtgaaaggtgatctgcttatcttcagggatcccagctttgttctgaatgacgtgcagggctttgttgcatgcgctgtctgtaatcacgttgtgacgtggatcacgcataatcatctggtcttcgtcacgatatccagtacgaagataagatgctgcttgttcctgatggatcttattaagaagctcaatgacgctgggcgatatctcaatgtcgcgaactgacgaatcagttttagttggtttgaatcctgttccatacaaatgatcccaagaacgcgtaacgtgaatgacgcagagcttagtatcgatgtcaggccaagttaaagccaacacttcagatattcgcatgccagtcatcgagccaatataaacagcaagcgccccgatattgcggtacgaagcccgttcaatagcaattgctttaaccttagcgaaatcacggctgtctagcacctttactttcccactagagcgcacgcctgatgtcttcgttccaaaggtaaaatcagaaaatagaatgcgttcattgattgccgcttttaccatcccacgaacatagctgttcatcttggtaacgatatctttcgaacgctcacgtggccgctttcgtgtggttttctccttgcgatctttgccagcagcaaaatcgttaataaatttctgccattcgataggtcgaatagaattaagctttcggccatcaaatcggctctttaggtgctttctgaaaagtttgtaacggtatacagtgttgattgacttgccattgattcggtatgcttcagcccattgatcccaataatcaagtaacagaacgtcttgttttgatggatcgccaccacgtttgaggtcatcttctacagcttccgcagcatcttgcgcagatgatttaagccgatacccgccgtgtgaagcaaccagctgtttaccggcggagtccgtatacttaacccggtattcccaatatttgccgcgtttcctaaatgttgccatgcgaattgcctccttttctggtaaaatcgagtatacaaagagccttatgactccgagtatttgttaggcgtctacccgttcactttggtcggtggggtaggcgctttttgcgctatttcctgcctgcttttttcttgttaagtgcctcgtttacgttactgagcggaatatctttgatgaatcgtttttctctaattctagaaaaggggacaacgatcttgtcgtttagttctgttttttctttatcagtgaagacttcggtgtctgaaatgtctaggagaactgagtgctcatattttttgatcggttctccttcaaaatttttccaagttttttcgccaaacttataagagattactgtaattggtttcataggctttaccccctacaatctgtgtggttttttgtgatataattaagtgaatgaaattcatgcaaaaagaaattaggtgagtataaatcatggaaatgcaacaactaatcttagcgggtatccctgggttcttgactttcatatggctcgataagctagatgctattcatttcgatttgccagcaagacaggcagatcgtactatcgctttgattctgatatctatgctgaatgctgctggtggcctcgcaatttaccagcaaatctggggaacagttggtcacagcttctggagtgaatttggccttttcgtagttacgctgattttgtctgttccattagccttcacttactatttcttaattaagctaggaaattcatgcctgatatggatacaagaataatttcacgttgccaccgtattgccagggtcgccgctagttgaggcattaaaaaataaagaatacagtgaggaaaagcttgtcatcattttcgactttaacgacaagcttatctctagtggttacgccaatcgcctacctggaagcgacgacccaactcaacaaatcgggttgatgacatatggacaggattggaccgtgaaattggcacagaaaaaatatgatgagtctccacaaaacagtgaacaaatcattgacttcgaccgacaattgaaaacctggattattcatagaatttcaaaaaagcagcgcaatcccacgattcacacgggactgcgctgctttggtgtttcacaaactctcatataaatatgagctgttcgaatagctcgatttgttgttctagcgaattgacttcgcaaatgttactttttgcctcggtaccaaagtaccaaggaccctgcacatttaaacgaaactttgttcagttttcaaaggacgaccttgtcaaaagacaactttgatagattatcatgaccagcgttacatgtcaacgtctttttaaacattgaatatttattcatctgttctcgacgtcgcacattgcgcaagccatcaacttgatctaattaagtatatccgctaaagatcagcgccttttgttttgacaacaacaagtatcataccagcactttaacgatgtagtcaataaaaatttcatgcaaattgaaacattttaaaataccgaaagatcgcgaacgttttctccagaattgcataaaaattcagcatttctgcgaacattattctattcatcgtgacaaaagttcagaaaaaagaaccggctcatttgtgagccggttcttcgtctaaatgatcaagtgcttcagcgacccacccgtctaaccgagcggcaatcggtgcaaagcctgtgtgaaatttacgactggtccaataatgcttgcggcgacgctttttactcattctaggcgacgcttgtaaggcacgtaaggataaactgattttttgggtatattcgtcgatgtccaaaatcacaacttcaactcgctggccgacggtaaaaatatcgctggtgtccttgacataaccatgctggcattctgagatgtgcactaaaccttgcgtatgctcatcaagcatgacaaacgcgccataaggttgaacgcctgtcactttgccagtcaagatatctcctatgcgatattccattctgacacttcatttcattggatttctctttgagtataccctaaaaatcattgccgaccaatattagtcttcaatcgtaacctgatcaatcgtgaccggttcaaccggcttatcattagcacctgttttgactttactaatcttctcaaccacggacaggccacttaggacttggccaaagactgtgtggcgatgatcgagccacggtgtaccgccttgtttatacgcttcaatgatgggttctgggaatccagcctcacttagttgcgcctgcatgctcgggtctaaatgcgcattagtcacaatgaagaattggctgccattcgtatttggaccagcattggccattgaaagtgcacctttcaaattgaatagctgatttgaaaattcatcattaaagggcttcccccagagactttcaccgcccatgccggtaccggtggggtcgccgccttgaatcatgaaatcatcaataatccggtgaaagatcaaaccgtcgtaataatgttttttggcaaggcctacaaagttttcaactgtctttggcgcctgttcagggaaaagtgcgatttcaaagcgaccttcgcttgtttcaaaaatcgcttttggtcccttaaagtctttgagttctaattgtgggtaatccatgatcaatctcctttacaagttaacgttcttgtactaggcgtagtataccagcccagcccctgagcgcaaactacacaggcttgctgatgcaacgatcgtctattaaaaaggctgcttacgggctaatcacacttgacagaccggtgttcagcctattttggtacttatcgtgaaaatatggtagtgtatggacgtcatactatatagaaacggagcattgcaaatgtcagtgcagcatgtatatgaaatcacggtaatcggcggcggcccggttgggatgttcgccgctttttatgcgggtttgcgccaggcagacgttttgttattggagagtcttgacgagcttggcggccaaacaggcaacttataccctgccaaaattctctatgatattggcggattcccgcatgttagtggcaaagaccttgtcacgcagctcaaaactcagctcgtgcattttcatcctgaagtcaagaccgctacggaagtacagacgatcgatcaagatccagatggctttttcacattgcatacaagtcaaggcgatttccgcagtaaaactgtgatcgtggcaaccggtggtggtgcttttacgccgcgcaagttagctgttgactatgatccggcattggaaggcaaaaaactgttctacttcgtgcaggatttggaaacttttcgggatcaggaagtggccgtggctggtggtggtgattctgcaattgattgggcactggcacttgaaccggttgccaaacatgtcagtctgattcaccgtcgtgccaaatttcgcggcttggaagccagtgttgctgcacttgaaaaaagcagtgtgacaatccagacgccttacctgatcgaatcagtcacccctcaagatgatcagttagcgattcaattgaaggaagttcgcggcgaggcacagccaacgctcaccgtcgacaagctgttgatcaattatggatttgtcaccgacaaacaccacctacaggcttggcaacttgacacggatcgtaatggtatactggtggacacacaaatgcagacgagtcgtcccggcatttttgcaattggcgatgctgtcagctatgctggcaagttgccgttgattgccagcggttttggagaagcgccaaccgctatcaatgaggccttaagccgcttatatccagatcgacgtcaggccttgcacagtactcagttgtatcattaacgctcatctgcgcaatttacccatcaaggagcaaaaacatgacgaatgaagaaaaattgtatgaccgcacgattcaactgttacatgaacgcggggttcggatatccgatattggcgaacttgtaatgttcctgcaagaacgcttcatccccaagctgacactcgaagaagccacacaaaatgtgcgcattgttctacgcaaacgtgaagttcaaaatgctgtgatgactggtattgctttggacaaggcagcagaagctaacagtttggaagaaccgttgcaaaaaatcatcgctgaagatgaaggtttatatggcgttgacgaggtgcttgccttctcgattgtcaatgtatatggttcgattggttttaccaattacggttatattgatcgcatcaagccagggatcttagctaagctgaacgcccatgagcctggcattatccacacctttttagatgatatcgtgggagccactgctgctgctgcagcaagtcgacttgctcattcacatccagaaattgaagacgacatttattgatgttttggtaaaattctgtcaggattcatgaaattttcacatcaatccgtataataagctgtaattcattaaaggagttcacaagatgacccaactgttcgacttcatcatgcatattgatgagcatctgattaccatcgttaatagcttcggcccttggacctacgccatcctttttgcgatggtcttcatcgaaacaggtgtcgttattttccccttcctgcctggtgattcattgctatttgctgcaagcgcgttggctgcaaatgccgcgtataacctgaatgtgtggattctcttcgccgtctttctggctgctgcggttattggcgacaccgtcaattatgaaattggcaagcgcgttggttcggcagcatccactggcaatggctggtttggacggctgatcaatcgcgacaaactgaagcaggcggaggctttcttcgacaagcacggcggtaagacgattgccatcgcccgctttatgccgctgattcggacatttgcgccgtttgtttccggcggctcccgaatgcattacggcaagtttatccattacaatctgttaggcggtttcctctgggtcaccatgtgcgttttcggcggtttctacttcggcaatgtcaccttcgtgaaagaacacttttcgttggttgccatcggtatcgtgatcatttcccttctaccgatggtcattgctgccattaaaacccggacagctaaagctactgaacgctgagcaaaatgatttgcatcaaaaaaacgcatcgcctgtcacgtggtaaattccacgtgacaagcgatgcgtttttgcttgcgctgccaatcatgccaccttcgcatcttgacgcccgcgccaaatgccccagatcatgacagcttcaaacaaagcaaatgctgtcagaaaacacaacatgaagaatccttcaggcaaaacgttgatgatcggatcagtcgccgggtcaaacagccagtcgctattgcgaaaaaggacttcatgaaacgtgatgaaaaattggtcgaagtttaccgctaatatagccgtcaacacaacaggtaccacggccccaatcataaacggacgaaccaacaaatatctttttctggcaatgcgaagttgatgcaaccagcgtaccgcaaatgggaccgtgaccacagcaacccctatatcgaagagaaagaggtggcgaacgtccgcaaaatgaatggcgccatgtacgcttgtggggaaatcattcatatgcagagtaccaacccacggtaaatttaagtaagccatcagctgcaaataattctgataaagccggccaagggacatcacggcaatctgcggtagatcatccatgtgtgcataaactggaaaagtgatcagcgtacttaaaatcgtcatgaacacaaggacactaatgatggctagccacaacgccacccattgagcaatacgcttcatggaggttaaacctcccaatccgtcaaggcatcaatctgatgtgtgggctgatggacttgcttggaaacataatcacgggtagaaacgccggtatacactaaaatcgtatcaataccagcattcagccctgccttaatgtccgtgttgtaattatcgccaaccatggcaaccgcttctttaggtaagcccatttttttcaaggctttctccataatcgttggttcgggtttgccaatgtaaaaagcccgctgctgtgtgctgcgctccactagcgcgatcaatgagcccgcgcctggaaccaaaccgcgctcattcgggagattggtgtcagcattcgtcccaataaactttgccccgcgtttaatcgccagtgttgccagttcaaacttatgataagtcacatcatagtcaaggccgacgaccacataatccggatcaacttcatttaatcgtaatccagtatccagcaacgcctgcttgaggcctaactcgccaatgatataaatagacttacccgtcacatcgccatgattaaggtcggtcagatacgctgcagttgctagtgccggggtgtatacctgcgccggttggacatgaatatcatgattctctgctaagtttttgaccacatcttctggacttttggtcgtgttgttagttaaaaataaaaacgggatttgtgccgcctgtagtcgttcaacgaaatcctttgcagcgggaatccgctccttaccgcgatagatagtgccatcaagatcgatcatatagcctttatacttcaagttcgtccctacttcttattagtctcacgccgccgaatcgtaaaatgtcgcttgcgtggttgtgtctgattgatagttttagcctgatcgccgcgaattttggttggtcgggttgttttttccgtatacggtttttccgcttttgctgaccgtggcttatgcttattgttttggctgttgcgccgatttgttgggggtgtctggcgatgcactggtttgatcgtttctgatctctgccccgcctcacgatgtccctgacgacgatgcggctgcccttttgtcactgacttgtctaaacacgccaaaacaaagtaagcacagccaaaattacaatattcatacaaataatcttcaagtgtgccgatgagctggtctttgctgacaccgcgtcgatcatctttatagaatccgcgtaaacgcagctgatcatagccccaatcaccaacgatataatcatacttatcaagaatttcgttgtagcgttcgttcaaacgcgcaacatcaaaagcatttcggtgatccttaacaaggcgatagcggcgaccatcaatcgttagtaaatcaccgttaacaatgaccacccgcgaatctttatcagcttctggggtcaatgcggcatcgatttgttgcataagcggttcatgttcgcccatgtgctcacctccttatgtgtgctgatgcttcgcaaagtatatcacgaaatcataatggatatttttgagctaagtactcgcccaccacattccgtaatagcttaggaaaaagcaattcattgctgcccataatctcaatggttggaaagaatggaatgaacagaaaattgtccaccgtcacaaacgtatattgttgttctggcaccaacggtttcccatgccatagaacaacccgtttttcacgattaacgctaatcccccggtaaccaatgtcaccaaaaatctttccacgaaaactcatgccgatcatatgaaaatgtcgcaggaacattcgattcttttccatttccatgattaagcgccacagttccttaccactcagcgttacttttaacagatgcatgggatgcggcaaacaggttaataaatccgtttgggttacaacacccggacccagcggcataaggaaaagtccggcatttaaaatcgccgcgtccacctgagcgccatcagccaatgcttctaaacctaaatccagtaatggtgaaggcccatcatatttgatcgatagctgtttgggcaaccgcgccacctgatgctgcttgagcaaagcaattcctttgctctcatagccctgtatctcacgcgggtcagcagctgccgcttgcatgagctcagttttaaatgtctcggcctgacgggtgataatttgatgctgatcatccagcgtcagcgtcactttgccgacataatggccatacttttctgcagctgttaataaggtggtgccatgtaactcaccgtctgccaataaatgatgcgtatggcctccgatcacgacatcaatctctggatactgttttgctaagtgccgatcagcctcaattcctaaatgtgacagcacaattaacacgtcataggtacctgataattgcttcaaaatatccggaaatacatccgccacggttttaacttgccagccatttggtcgatatgtcagaaaaaatggcgccgtgaatccgacaatcgcaatgcgtgtaccagcacgcgtttgcgttcgcacaaacggtttagcccatgtcggtcggctgccgtcaacctcgaataaattagccagtgccactggaaagttcgcatgatcgtataaatgttccagcacatcatgcgggttaccgacaccttcattattgccgatggttgctgcatcgtaaccaatttcattcagcaattgcacattgatctgaccttgcgtagcttccgttaagggcgctgagcgatccatcgcatccccgtcatcaaatgccaacacactcgcgccttctgcttgttctgcagcgcgtgttcccaacataaaccgccgaatcttcggccaattttcaaaatgagaatgcagatcattggtatgcaggatcactaacttttccacgagaaacctccctgtgccggcaaaaataaatactctaactggtgaatcaccggcgcgctttcttatttttatcctatgctctgataagcgggcggtcaaacaaacggttgttcatcgattttgggctaacgcctgggccttaagccgataaatttcatgcacttcagcagcggacagcggtgtcccaaatggcaggtgtggcatcaacaaatcgcgttccggtgcatctaccccgacattaatattctcagcgagattgacgctgttgtgatgaatatggccatgtaaattcagtgtttgtttgacaatccccatcatcaacgggtagtgcgtcataatgaattgtgtatggtcgtccttaataatggtgccaacatcatgaaacgtgaattttggctgtccattcacaccaggatcatttcgatgaagaaacttgaacagtgactcataatcatggttccctttaatgaagacaattcgaccgttcagctgttttaatataccaagcacttctggtggttgcggaaaatgctcaggattcatcgcgatatcgcctaaatgatagacaatatcccgatcccccacgcgagcattccaagcattgatcattgccgtgtccatagcctcaacagaggggaaaagtcgcggtgcaaaatcgttttggcctaatagatcggcgtgaaaaaaatgagtgtctgcaatgaaatactgcatattattcctttctgcgatgcgcatgacgagttgtcacaacccaagttgtcatcggtaccgtcaaaacaacggcaatgaccgaaatcaagacttgcaacaactccccaacaaagattttattattgatgatttggctgaacggatagcgcaaagatgcaaaccaaatgaacaatgatgaaaacccgccaaaaaaaccaaagaacaatgtatttaacgccgtgccaataatctcatgccccatctgtttgatgccggcatcacttgcttgatccttgatttcatccatccccgccgctacggcaatggccgcctccgcgatggctcccagcgtgcctaataaggttgttgcaatcaaaatatgcggaaaactaaccccgatgtaaacagagaagccttcaagactttctgaatcttctggtccaaagccagctgtctgactgagcgtcatagtcaaaataatgagccccacaagcaacgtcatgattagcaacgcggaaacaaacgctggacccgcaaccgctacatgactcgtgctcaagaaaatggtgctggctaaaataatcaatccgaataccacagcgagaataattggattgaacccgctcgccatcaaaatcacgactaaaatcataagcaaagcattgaccgtcagcgcaaagaaattggctaggccttgtttgcccccaatcaagagcatcatgactagtagcaatagtgccaaggcaagaattgcattcatgatgccaccttctttattttagccataaacgcggctaaaccgctcgtcattggcaccgctaggacaattccgaaggcactaattaaactttgggcaaacccaagccccatcacccaaatgactgtttgtgcaatcgagttattattacgaatccatagcactgattccacaaaagtatcagcaataaagatcataaagagcactgaaattagcggtcccatgacattccggccgattgccatacctgcctgaaaccgttctttggcgctgtcatgcaactgaaaaatcgccactgaaatgtcacttgcttcatcaagaacagcgcctaatgaaccaataacaatctgagcgaagaacagcaattgcggcatttgcgtcgcatatttcacttcttccagatgcacaccgttataatttgtcaacgtcagtacaccatagcctagcgccacagcaaggccagttgccagtaacgatcccagtgaaatcgtgacggcaatcggcttaaaaccaacaatgaaaaccgcagtcagaattgtaaatacgactgctagaccaacaaacaaccaccacgcctgccattgcttactgccaatttcccacgttaccgcgataaaaaagatcaccgtgttcaaaagaatactaatacttgttaaccaagcgcgacgccccataaccaaaaaaattaggccaaatgtcaaaacaagcaacgccgcaaggatggcatcgcgtttgatgttgttgagcgtatagacgcccttatcgacatctaaaaagatttgttcacctggccgcaactgattgtctaaaccgccgctgaacgagtacgtattatgaatggtgacgctttgcccgcgttttgctgtgttcagtaaacgcactttaacctgttgcttggttagccgatcatgattctgatcctcatcatcatgactggtcgttttaatgacttgaactgattcgacacgaccgactggtttggcgtaaagactgctatcaaactgcatgccaataaaaaccgcaattgccgcaacgaacggaataagccatttaccaaaatacttcacgctgacgcctcctcacattcacgcggccaaaatcaacctagtgaatgccctactttcatatgccctacattatataagtggcgtcaacgtgacgcaaaatgcggcgtgtatcaaactaaccgaaaatcaagccaactacctgacgattcgcgatggtgctcacctagttagcgcagtaggtgagactaaagccaccgcaccgctgctagcatcacccaagccaacgttaccagtgtgaatgccagtgtttgttaggttttgtttaaattgttactgtcgctgacgatccagcgatatcaccactcatccaacatggttctgcttcagaatctcgtggtaagcctggcgtaccggcccttctggtttgtcccactcttcccagctcgtcaaatcagctgacgggaattcataatgatcgttgatgtactgttcgtaagctgtcacagcagttgaatgaggaatgtttagttgaacgatccgcacacgtttaataagccccttcatagccgccttttccgcccgaccgttcatcatgaggttacctagttcaaaatagcgactaccgtcattccgtgtgatttcttgaattaaatcgaaaacttgaaatttatcagccatgttcttcgtactcctttatcaatttagccactgcttgtcgtgttctaaaaattgtcccggctactttgtggtgctatgtttatggtatgatgtttttttctggaaaggagcagcctgtatgggcaagcgactcacgctggcagtgctattgctgcctttattccttctgctttcgggtttcacgctgatcggccatcgcggcgatccgttgaattatccggaagagacttaccaaagttttgacagtgcttttaataatggcgccgactatgtcgaactggatgtgcatgaaagtgctgacggtgtcgtggtgattcaacacgactcaacgattcaacgaatgaccggcgctaatttggcaattgccacaacgaactttgctcaacttcagcaatatcataccaaaaatggcgagccgattcacagcttggaagatctcttcattcatgagcaacaaaccaaccataaatttctaattgagaccaaaatcgtaaagggagaacctcatccccatctcgaagacaaaatagcggcattaatccaaaagtatcacatggaaaatcgtgtgatgtttcactcattttccgctgcaagcttaaaaaggcttcaagccgttttgcccaatgtgccccgtatccttattgttggctcacttaaacgaatcaattttgatgtcttaacctacgtagatggtatcaacctgagttcggacttagtgacaccgcaacttgtgacccaacttcacgatcttggcaaaaaagtctacatctgggacgagatgaacgaaaatcgctcattatggacttggctggtgaatctcaacattgacggtatcgtcaccaactatacggctctagggcatgaatttcaggcattgaaggccgctgcagtgacaaccgatattaacgatcttggtgccaactccagtaccacgcccttacccatttacgaaaatccatatcagccgacgttgcgccatgaacaattagcgcctgaaacccctgtgatgatttccagcatgatcacgattgctggcaacacctattatcaaattggcgacaatgctttcgttccagcgacaactgtcaatcttgcgccgcaagccggatgggctagcctcttcattaatcaaaatgctgttgtcaccggaaaaaaatttcgcgtgccagtatacgctgatccgttgcatcaacaagatgtcattgctcacatcgctaaccatacgcgtcatcacatcacagcggcacggtatgaaggcaatcacctctatgtaaagatcaaaaccggttggctaaacgcccaagatttgcaactgttgccagatgctgaaaatatgactacctggatgagtcaatatcgcagtattcctgctgcacaaaagccacttgtccactgggcattaggcgacacggcctttgacacaccactgttgaatgctagcgtcgttggcatcggttaatcgccgaaccacgctcaatcataagccgttcatcaattgtgactatcaaccctcacaatttgatgaacggcttattagtttcccatgattaaacatgctatcctaaagacaatgacagtaagaaagtaggttaacctcatgacgattaattggcagcaagaagcagagaagttagaaccgcaactcctttcagacttgacaacccttttgaaaatcaactctgagcgcgatacggaccatcaaacaaaggcgtacccacttggcccgggaccggccaaagcactggaagcctttttgacaattgccgaacgcgatggtttcaaaacacttaatgttgataacgttgccggtcgcattgagcttggcagcggtgacgagatctttggtttgtttggccatgtggatgttgtgccagcaggtccaggttggcaaactgatccattcgtacccgttatcaaggacggtaaaatttatgggcgtggcactagcgatgataaaggaccaagcatcgcagcttattatgccttaaagttgattcgtgatcttggcctgccaatcaataaaaagatccactttatcatcggcaccgatgaagaatccgaatgggtcgggattcatcgctatctggaaacccagccggcaccggattttggcttctcaccagatgctgaatttccaatcatcaacggtgaaaaaggcattgccagtttcaaaatcgatcaaaagccaattgccgctgcaccagctgagttaacgctcaccaacttctcggccgggattcggccaaacatggtgccgcaagtcgcaactgcgaccatcaccggcgatttaccagaaacttttgccacacaagcaaccgcttgggcggatgaggctggcgtcaaacttacccttactttgggtaatccaacaaccattgaagttgtcggcaaaggtgcacatgcacaggagccaaaagatggcaaaaatgctggcacttacttggccaatctactggcagacttgccatttgatccagccggtaaagcttatctcctgatggtcgctaaatacttgcacaacgactcacgaggcaagctgttaggcatcaattataccgacaagctgatgggcgaattgaccgccagcccagacatcttcacctttactcaagatggcgaacaaagtgtgcttgtgaatgtccgttatccgcaagggacagatgctgacaccattcgtgatcagattgagacgacattaggcgccgacaaggtcaccgtaagcatcagtggtcatgcccaaggccctcactatgtgccaggggatgatccattggtgaaaacacttctccaaacattcactgatcacaccgggatcccaggacatgagcaagtgatcggaggcggaacttatggtcgtatcattaagcgcggcgttgcattcggtgcccaaatgccaggtcaagaaaatgtgatgcatcaagctaacgaatacatgccgattaaggatatcatcacggctgttgccatttatgccgatgccatcagtcgcctggtcaagtaatctctgggcgtcattttatcgacattcagttcatgcaaggccgtcttagttttaaactaggtcggccttgttggcgttaaccgttatcaaaacgtctgaaaggaagcaatttatgtttgaacctgatgctttaaacccatggttagatgatccccgtttgcgtgccgctgtcaccacagcaggtaccgtcacatccacaaatgtcattttaaaaaagtccgttcaaaacggcggccccttgccacagattttaattgccgaccagcaaaccgctggcgttggacggcatggtaaacattttgcaagcccagctgatgctggactttacatcagctatgcgtttcatccacaaattaaccgtgccctaatcacacctgctgctggtgttgcgcttcaacaagcaatcgccgatcagtttggcatcagcactcagattaagtgggtaaacgatctacagaaagctggtaagaaagtcgcgggtattttagccgaagcgttgttggaacaaaatgctgtcattttgggaaccggcgtcgatcttttccctgctgccagcggtcctttgccaaatgatcagccgatgacaaccattttgcgcgaggtccctgcaaatgatccgcgtcccgagcttgctggtcgttatttgacccacttgatgcggctttttgccaatcccgagaccatcatgccagcgtaccgcaaacgagcagcatgggttggtcgccgcatcacggtcagcggcacacaaaatccgctgaccgggacgatcagcggattcgatgataacggcgctttactattaaaaacagatcttggcacattggtggtctcaagcggcaccatccgactcgttgaaacagtctaagtcacctcagttaagcgccaatagcttcgtcaaatcgctaaattcgttgagttgataagttggtgtgatgtgatcgcgatttggctgaaaatgtggattaaaccaaatcgaatcaattttgccattgatcccaccttgaatgtctgaggtcagcgagtcgcccatgatcaatgtctcacgccggtcaaaccgcgggatgcgtttggcaacatagtcaaaaaaggccacggtcggcttcgggctgcccacgctatcagaaacaaaaatatcttcaaagtaatcaatcagaccgctcgatgccaagcgttcacgttgcacaggctcgataccgttgctgacaataaacagccgataatcctgcaacgcatccaaggtgtccagaactcgcggcagcaaaatggcctcttgatccaaaaaatgatgataggtgcgttctgccaaatgcggatcagcctcaatgtgatgatggcgaaagagtttggcaaaccgcacatcaaataattctggccgcgtgatgcgccccgcttcgtagtcacgccatagactggcattaattttcagataacttgcctcaatccgcggcgagtaagtcaaattgagtctggcaaacatctttgccagactttttagttcacctgctttaaaatccagtaacgtgtcatcaacatcaaacaaaattatccgatacatactaagctcctattctcgtcttaaagctacatgctatcagttttacacacctgatgagacgtgacaagctgtttgcgaagtcagcgcttaggcttcgccactgcgtcaaagatgtgctcactagccttggaatctgcagacaacgaccccgtcaaaaaccggtcatcacgcctcaagcagcttacaccccggttttaggctaggtcggttcacacgcctcaacaaatccccggttagaatccgcttaatatttaaggtatactaaggcgtactagaccataatttaaggtgggacaagcatttgaagaagttctttgatcgagtcaaaacgctcgggactcgatttcgccactggttcactgcgtttgtgacccggcgtcctgattccgaagcagagacaacaaacttaactggcaaggaggccgttgtcttttacggcaacgtcaccttacaaagtattaaaaccattgtttattacttactcggcgtgctcggtattgcgactgtctttggcctcggtttattcggcggctatttcgtttcaattatcgatgccaccccgattccgaccgaagctgccatgaaggccaccctttccaatacaagccgcacttccagcatgtattttgctcacaatgtcaaactcagcaatgttaaaagcgatttggtctcaaccaaggttgatttgaatgaaatgtcgccttggctgacaaaagccattgtcgccactgaagatgaagacttctatcggcatgatggcgttgtacccaaagcggtcattcgtgcttttttctctgatttaactggcatgggcaatcaaaccggtggctcaacattgacacaacaagtggtcaaaatgatgtttctaagctcagaaacgacctttaaacgtaaagcggcagaaattatgctcgcccgacgtttaaataatcattttagcaaggatcaaattctagccacgtatttgaatgtggccacacttggtcgtaacaataaaggtcaaaacatagctggggttgaggcagctgcccaaggcctattcggcgtctcggcgaaggacatcaacctgccagaagcagcgtttattgccggcctgccacaaagtccgtttatttacaccccgtataccgcttctggcgcccttaaaagcaatctcaaagatggtgtggatcgtcagcagaccgttctattccggatgtatcgagctggggtcattagtcataaacaatatgtcgacgccaaggcatttgatatcaaaggtgcttttctccagcatgagaatgctgaagaagacgacaatcaatatggctacgtgtacaacatggtgttaagcgaagccgaatcattacttgctgagcagttggctaaaaacgatggccattccgccgccgaattggcgaaagacaacgccttaaacaacgactatctgcggcaagctgctaatcttttttcatcgaaaaattatcagattaaaagcacgattaacaaagatgtttacgaccggatgcaatttgtgatgaaggcaacacgcagcacatttggtcagacttataccagcacacaaattaatccgaagactggcgaaaccgaaaccattaaacatccagtccaaaatggttcggtcgtcttggacaatcaaaccggggctgttttaggcttcgttggcggagtctctggtgaactcaatcacatctatacattgcgttcgccaggatcaacgattaagcctttgctagtttacgcgccggccgttgaccaaaaaatcatcggctcgcaaacagcgttggctgattttaaaaccgatctcggcaacaattacagcgtgacagactacggcggtcagattcagaatcgctttattcctgccaccgaagcgcttgcccaatcctacaacatcccagcagtcaacttatataaacacatcaagccgaccgttaatgttaaggactatatggataaaatgggcatcgataccctcaccaaaaatgactatagtcagcttggactcgctttgggcgggactgattacggggttgatgtcaaagaacaagccagcgcattttcaacctttgccaaccaaggtgagcacgtaccagcctacgtgatttcggagattgtcgatccgtctggtcatccaatctatcaacataaggttaagaaaactaaagtcttctctaagggcacgacctacatcatgaatcaaatgttgaaaaacgtgattgattccggaactgcggaaagcctcaattatcaactccacttcaacactgataacctgatcgggaaaacagggacgagcaatgatttccgggacatctggtttattggctcgacacctggggtaacaatcgccagttggatgggctatgacaataatgatggcacaacttattcactagatgagactggctccatgaccaatgaagcctattgggctaaattaaccaacgcagtttaccagacgattcctaaacaatttaaggttaatcagaaactggcacgcccggatacggttaaatcagtgactgtcgataaacaaactgggcaacccgctggcaccttgacttttgacggaaacacctaccgaactggcggctcaaccgtcaccagcctttacaatgattggcagccaaccacgaaaaatgattttgccatcggtggcagtaaagctaattatcagttgttcttcgaccatcttgatggcaaacaaaatggctatggtcaggtttccgatgccaacggcaattcaactgaagccaaaaaagaacatcaagaaaccccgatcacgccaactgaagatactcagacgacacctagcagtgctcctagcgtgacagtgccatcaagtcagcaaaaccaacaagggacatctgaaaaccagccaagcgaaccacaaaccaccgggactggcggcacgaatggcgccaccggcactggtgggactggcggtactgggacgaccacagaaactggcacgacaaccggcacaggtacaacgactggtggcggtacgaatactggtggcactaataataccaatcaacaacagaccccacctgcaacaacgactggcggcggtcagtaacaacacgatcacgagttttcgtttcaacgcaagaaaaaaggcctccaagtaatttgcttggaggcctttttctttgtcctaacgactttacatgtcagctaaacagctcacaaaagctggcattatttcgttgagccacgcttcaaaatatcgaagccaagcataacggtcttttcctcgatctcttctttattcatcatcttggtcagcaagcgcatagcaaccgcaccaatatcatacaatggctgatcaatcgaagtaagttgtggccgagtcatttccgtcagtttggtgttattgctggtgataatttcaaagtcgtccggcaccttaacgcccttatcaattgcgtcatccaaaaggccaactgctaactcgtcatcacctgcaataaccgccgttgccccaactttctgcaacttatcaaacaaggccaaaccagcttggtagcttggctcattttcaaaaatcaggctttcgtcataagcaacaccggccttttccagagcctgtttgtaacccttgagccggaactgcccattgatcggatgcgtcaatgaaccggtcgccagagcaacccgcttgttgccactttccaataactgacgcgtggcttcttcgacagcagccacgtaatcgatgttgacactgccaacctgttcgtcaggatcgattgagccagcaagcacaacaggggtcttactgcgtgagaattcagcacgaattgagtcagtcaattcatggcccatgaaaatcaaaccatccacttgtttagccaacaatgtgtttaacaccgtgacttctttttgattgttttcatcagagttcgccaagatgatattgtacttgtacatcgtggcaacatcatcaatcccacgtgccaagcttgagaagaacatgttcgtgacatctgggataattaccccgacagttgtcgtcttcttgcttgccagaccacgagcaactgcattcggccgataatcaagccgttcgatcacttccaaaaccttcttgcgagtagctggtttcacatttgggttaccattaacgactcgagacactgtcgccattgagacattagcctcgcgtgcgacatcataaattgtaattgtttgcttttccaattgattttctccttagtcgtgaaaagatgaaatcacgaagttctatttacattccaaagtaacagaatagaaatagcaatgcaagcgttttactgaattttacatgaaattttcacaaccgcctttttcagaaagcccatcaagctagtcacgtgatatactaaaagttaaagttttaagttgtgctattttaccacgatgcttgattggcgcacgacttttaagccagatcgcgagctaatccggttaaaaagtgcaccgcgtctgcatggtactgcgccagtgaacacgttgaggaggaaaaaatatgaatgaacatttagctgctttgcaagcttgggttgcaaaagaagggttggacctggcctatattagcgacccaatcaatatcaactactacacaggcttttttcaagatcctgaggaacgcatcacagcgttgattgtcacccctgacaacgatcctttcctattcacccctcagctgacgattgaagaggtcaaaaaagctggctggccgtaccaagtcttcggttatcttgatcacgaagatccatttgccatcatggctaatcacatcaaagcggtgacagcgaacccgacaaaatgggcaattgaaaaagataatctagctgtcttcaaatttgaagctctcatgaaacaatttccggatgctaccttcccagttgacgcatcccggttcattgagaaccagcgactcattaagacaccgtcagaaatcaaacagatggaagcagctggtgctcaggcagatcgcgcctttcaggccggctttaacgcgatcaaagctggcgcgacagaacaagaagtgacagctgaaatcgattatgccatgatgaaggaaggcgtcatgcacatgagctttggtaccattgtgcaggccggcgtcgacgctgccaatccgcatggtgaaccaatgggcaccaagcttcaaccaaacgagttggttttgttcgaccttgggactgacaaccatggctatatgtcagatgccacccgtactgttgcatttggtcaggtcaccggcaagccgcgggaaattttcgatgtctgtttagaggccaatttaaccgcaatggcggctgtcaagcctggtttgaaagcatccgagctcgataagattgcccgcgacatcattactaaggctggttatggcgattactttaaccatcggcttggtcatgggattggcatgtcgacacatgaatttccatcaatcatggaaggaaacgatatgctgttgcagccaggaatgtgtttctcaatcgaaccgggcatctatgtacctggtgttgctggcgttcggattgaggactgtgtccacgtcaccgaaaccggctgcgaaccatttacccacacctcaaaggaattcacggtcattaacggctaggacaggtctaaaaaactgcactatagtcgtattcatatgccacaaaaaaagctgcccggaaagattccggacggcttttttagcggcatcagactacctctgctccacttgttcatatagcatccccgcctgccgcaaagctgctttgattttgggcatatcgcgctcatttttaacgctaatcgtatgcaaatgaatgccaccggtcaattctgacaacagtcggccatgatagcgcgacaaccgactcataaacagtttcatgtcagccactgtccggatgtttaactggccgcgcaattgtccataaagcggatgctcaaccaaaacatcctcgatccatccgccattttcaagaatcaactgtaactcttcggcagtttgtgccggcgtatgtttgcaaggcaacaaaaactcatgggcggttggtcgagaaaacatataccctcgtggcgttgcaataatcggctcaccttgtgcgcgcaacaacgcaatgtcgccaacaattgtctggcggctcacggcaaactgccgggcaaaacttgaggcactaagcggctcagcggctgtacttaaagcagccttgatctgcgcttgacgttcactattcagcatattctctcctttaaaaaagatctatagacggtgctgcgaccttggcaaccaagtcgtcgtttggttgctgcaaaaggccccaacctgcctgatctatgaagtaccaccgattatggcaaattgacaataactgatgcgaaaagcgacaaacgtcttgctccaatcataggaacaatccgtttgtcgcctttttttcatcaattgtgactaagtgatgcatgtctgttacttatcatttgtcgcagatgcttgcggttcatcaggtgcgacactgctagccggtgcggtatcagttgacgctggtgcaactgcttctggttctactggttctggcacttcatcggtgcgagtgtcactgccctcgtcatcatctttagcttgcgcaaaagcacttttaccgtcaagaacaatgtcatcaaagtctgctgatgagtccacatctgttgccgtattcagttgatcacgcaattgctcggtggcagcatcatagtttgccaatgctttagaaccatcagcatcgtcgcctttacgcttcaattcatcaacaaaatctgtggcactttgtttccagtcagcgctagcttctttggcataatcgaaataatcaactgcccgatctgccaagtcttcagaagcatgcttcacacgccgcttcaattcatcgcttgtttgtggtgttaataaataagtggtggctaaggcactagcggcaccgaatacaaatccaagcaaaaaatgtccttttttagccatgattcttccccctgctattgatcgttatgttttttcttcgtcaacattgaaaacgccttggcactcatacgagccgcaacggtcgccttggctccgttcttggcaccatgcgcaacacgctcagttaaattgcgcgttgattgattcaaatcggagacactctcaccaagttcgccgatcgcagtaaagacggggtcaattgccgccaccttaccgttcacgtcctcaagcagggtgttgctcttagccaaaagaccttcaacttccttcgtcaaaatgccaagctctccgttgatcgtgttcaacgtcttattcgtctcggcaaccgtgcccttaacttctttcgtcacaccagaaacacgaaccgcaataatcgcaattgcaagtgcaataatcagaaacgcaatagccgcgataatccaagcaatctctccacctgacatccaacaccctcctatttcaaaccagttgattaaaacaatcataacatcgtgacaagaacggtgcaaaaaaattaagagcgcaaaccggcgcgcttagaaactggaacgtaagtggccttgggcgtgatgaccggtttggggtcattgcgtccaaggttcttacgtggaagtttctgcgccggtttgcgcgttttggcgagcagccccgttcagaaaccggagtgtaagtggccttgggcgtgatgaccggtttggggtcattgcgtccaaggttcttacgtggaagtttctgcgccggtttgcgcgttttggaaaaccttaccgcccactcaaaccaaatctcccagcacacacccaccgattctggtaaaatagtgccaatgtaaaggaggcagtcacgtgatatacatgatcgtcacagcaacaaccgtcaacgagcaaaccaacgtttggctgaaatattttacaaccatcgattgggataaaatcgtaggcacttttatcgacaaagtgctgtcgttgctgtttttcaccgtcttatttttaattttgtaccggctcggccgctttgcgctcaatcgcacctttaaaagctatcaacgacgggcacatctgacaggcacccgggtcaaaacaattcatgcgttatcggtgaatgtttttttctatctggtactcttcttctacctttacgccatcttatcgattctcggcgtaccagtggggacactgttagccggtgctggggttgtgggtttggcagttggttttggggcacagggatttgtaaacgacgtcgtgaccggcttcttcatccttttagaagcacaatttgatgtcggggatgtcgtcaaactcggcaccatctccggtaccgtgaccaatgtcggtttgcggacgacggtggtgaagagttccgatgggactgtcaatttcattcccaatcgcaacatcaccatcgtcagcaacctttcgcgaagcaatatgcaggtgctgattaaattgccgcttgccccaagtgctgatctcgatctagttcggaaaaccattgaacgtgtgaatcaagatttggtaccgaaatttacaaccattaccgaggagcctgacattcttgggctaactgaagaaaagaatggtgctttcacctatcaggttcttttttacgccgaaaatggcgaacaagtgagcctgcaacgcactttcttaggcgcctacgttgctgccttgaattctgcaggcataaaagttgtcacaccgccgttaaacttgcaaagtggttcatgaaccaccgtgccattgtcacgttatcatcaagcggcttaacccaattcaaaaggagatgttatgctaaatttcgttaaaggtgccattattggcatcgcacttgtcattccaggactttctggcagtatttttgctgtggtcgttggcctctatgaccgattgttaaatgcggtcaaccattttcgcgatgatccaaaaaaaaatatgcggtttttgacaccgatcgggttgggtgctgtgatcggtatcctgctttccactaaggcggttctggtcgtcaccacccgctggccgctgccaagctatggcttctttattggtttagtgctgggtatcggtccgttcatttaccgtaaactgacaaccaaaaagttttcatggtggtacttactactagtggtctttggcttcgttgccatatacgggctggctaagcttggtggtactgaccctgagaatctgattgccattaaacgtttgacaagtttcagcaatgctggcgtcatggcttttgccggtgtttttgcagtttcactgatggcaattcccggtatttctggttcagtcatgttgatggtgattgatcaatacggtacggtttacaatgctgtgggtcagttgggtgatgctgctcgtgctgctgcatccggcaactggcccgcgtttcatacggcgatgggatcagttgccttgttgctcccgttcatgattggggctgcagcaggtctgatagcagtagctaaattgatggcctacttattggcccattttgaagcacaagtctactacgcagtttgcggcattgtcttggcagcagtcgtaattcttatcgaagctggtatcgccccttattggccagccaccgatcacttcggcgccatcgccatggttgtcattagcctcgtcatcggcgtgctcgccaccattttcttagacaaaccagatgctgacgagaaaaaataagtttggcatcacgactgtcactgaatgtgctcgctgatataaaaaagcgtcgccctgcttttagcaatgcgacgttttttctaagttaagagcctgtttagtgtctttacggaatagctaaatttcaggtatgctttgcacaaaaactggagctaactatgcgaaggggcacaaatgaacggttcaatcgagaacttcgctactatttcccgaaggaaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggaccaaaaaccggtcatcacgttcaggcccacttacactccggtttctaaccggtctggctcacgctcttgttgacaagacacctaaaattgcgcattctcattattaacaactatcttttcagaaaggattcgtgctgtgaacacaaaaagtctgatcatcagtcaagatctttgtggtgtgggtcaagtctcgatgagcgtggcgctgccgttagcggctgggctggggttgacgccgtatgttttgcctaccgcactgctgtctagtcacactggcggactaggcgccaatacttatcttgatcttagctccgaaatgccggggattctcaagcactggcaacaactgcaactgcagcctgatggcatttaccttggttatcttggtcaaaaggcggccgaccaatgggatcgttggctgcctaaatttcatgccccgctcgtgttgatcgatcccgtcatggccgataacggcaaactttacaagggatttgatgctgcttatgtggcgaccatgcaacagttggcgcatcgggcaactgtcttgacgcccaacatcaccgaagctcagctgcttttggatgaaaagccgacaacgctcaccgatccttctgccgtcacggctttggcgaaacgcctgcatgcccaatttgacagcgccgttctcatcaccggcgtgccttttcacaaacaaattgcggtggtcggcatcgatgcatccggtaccacgctggccttggctcagccaaaagaaacgggtcattattttggcactggcgatctttttgctgctgccttagcgacgggtttgttaaaaggtcaaaacttgcggcaagcggccgcaactggcatggttgccgcccggcttgcgatcaaggccacgcttgccactgatgccgatccaaagtacggcctgaatctggctggcgtcatccctgcgctaagcaaacaactgccataaactgccacataccatgcattattatcaatattttggaggcgattacgatgcaaacatcccataatacgttaaagaatattattttcaccggtttatttgctgccattatcttcattggcatttcactcttacggattccaattccggcaatggttggtcggccattcatccactttggtaatcctttaatggtgcttgccattcttttcctaggtggccgcttaggtggtttggccgctgtcatcggtttgggcgggtttgatctgctgaacggctatgcggctacctcatggttgactgcccttgaagccattgtgatggccatcgttgtcagcgctttggtcaaagcctttaagcataacgatcaaccacgcaatatcatcataattggtattctcgcaggcctgacaaaaatcgtcacttcttatctcactggggttgttgaggcgcttatggtcggcagcgttttcaaggcagccgtggtcggtgccttcctgagtttgcctgccaccgtgatcaattcaattgcaacggccattatcgtaccagtattatattttattcttcggccactctttcgtcggttcacaaactgaccgatttttcgttttttatttggctctcgtttggcctagtccattaaattagcgaacctcttaacatcacgttgtctctcgtgatgttttttattgtcgccaaaaagcggtattcaaaagttgtttctctatacaacaataatcttttctgtcataatcggcccaaagaagtatgcagacaagcgcgtttcatttcttgctggcacctttttagacgcgtacctactcatccctacaagaggaggcctatcatggcagaaccaatcgtaacactcagccacatccagaaaagtttcggatccaaggaggttttaaatgatctcaactttacgattactccaggaagcattgttggttacatcggtcctaatggtgcagggaaaagcacgacagttaaaatgatgctcggtttgatgcaaccagacggcggcaccattgagctgtttggtcagccaatcaaacccaacgacccaagttataaacggcggattggctatgtgcctgaaagtgccgacgtgtttgacgccttgactgctcgtgaatatttaagcttgattggccaactttacggactcagcgctgccgatgctgaacaaaaggcctttgcactggcggatcttgtgaatttgcgggaggcttttgatcggcgcatttcatcatattcaaaggggatgcgccaactgattttgattatcgccagcctgctacacaatcccgacattcttttttgggacgagccgttaaacggcctggatgccaacaccgtgcttgtcattgaagaagtgctacaggatttgcgggatcgtggtaaaaccattttttattccagccatattctcgatgttgttcagaagttgtcagaccgcatcatcgtgctgaatgacggtatggtcgttgctgacggcccctttaagtccattgccaaggaagccgacaccaacctgcaacagctcttcaacgatctaaccggctttgccgaacacggtcaaaaggcacaaagtttcgtggatatcgtgactggcggtgaatcccatgaaactatttaaaaagacgtccctagacaccgctgatccaactgatacagccgcgttgcctttgccgaaaacatttgcatggctcgcgcgctttaggcccttattggaaaaacgtggtattcagtttgatcaattgcggctaatccttgcgactaaaggtctcttggccgctcgtgaatctagcggcttaggcagtatgttcaataaacgtaaacgtggtcaagatgcgagcatcaaaaccgcctttttatggaatctcttctttggcctgattttagggctgcttatgtttctcccgacctcaattctcacgacctttacccttttcatgacgattcaactacttacgagttttctcgctattttgaccacttactcaagcctgattcttgacccgcgtgaccggagtgtttttgcctcccgaggcgtcaatgatcaaacgttaagttttgcgcggttgatcaatatttgcttctatctgggcatgacgttgctagcaatgggcgggcctggactcgtcatggccggtatccattatggcccaatcgtggcacttggcggtctcatcggtttgctgctgagcggcgtgttaagtctggtcatggcgctttttgtttacttgctagtcttgcgcttttttgatggcgaacgattgcgcaacatgctgaatttagtgcagatcttactgatgattggtatctacgttggtggtcagctgcctaacttgctgccgcgttccatgtcgcttttcggcatgtccatcagcggtcagtttaattggcttttcttaccagctgtccccgcttggttcgttggtctgcccatgttgtttgcaggacaggtaacggtattaagtctgacgctcaccgcgttaagtgtcgtcgtcccgatcgccttgaccctcgtctttctacatttttctggtgtgtttgaagcctatctagaaaaattgaaccaaggcgatgcccgcacgcgtaaacttggttggtggttccgcggcgtgagtgccctgctgactcgtcctggtgaagaacggacatacttcactttagggtggcgtgtgctaggcagcgaacgcgattataaactgcgggtctatccgcagttggcttatggcatcattctaccgctgatctttgttggcggtggactgcgcgacatgccatttagctcggcgaagcattttattgcctacgctggcatcggcgtcattgtggcgttggctcccgctttggttaatctgcggttttcgagtcaacctcaagccatggcaatcttccagtatgtgccttttacgacccacgggttgttactgcgcggggtagtcaaggccatgttcgcccgattattcttaccaccgctattgctcattaccattttgaccactgcgcttggcggctttgatgccttgttggccggcattgccgtgatcattttcacctatggcatgacgttaatgatgggatggccgctggttggcagtcaatttccatttgctagtgtgtattcagctaatgccaacttcagcggtggcgcgcttggctttgccagtatcttttttggcgtcatcatcgccatgattgtgatcggcatcggcgggttcctcggtggttggcttttcccgctcggtctcattgtcttaggactaacgctaggcatgctgcttgggcatttctatcgaaccaacctgcgctacgaattaaaaattaagacgactcaggaatgagtcaaagaggcagtcattcttcaatgaatggctgcctctttttaggcacttgcatcgcaacttcaagacacgccatcaggaagcttgatcgatattgcacgaactagccaaccctagtttttttgcgtagaatggcttggacagtcttacttcgaaaggatcccgccatgccacgcactgaagctcatctcgctcgccataccaaccaaaaactaaaaggtgtttctttcgccgttattggggctattttttggggtgccagcggtattttcactcaaacactatttaccgatgcgggagtaaagccgctgtggctggttggcattcgcttgtttttcgctggtctcctacttttgctttggagcggcgtgcaagaaccgcggatgttccttgcaatttggaaaaaccgccacgatgctatactaatgatcgtgttcgcctttttgggcatggtaccgtcacaactaacctactttttagcgattaatgcaggtaatgctgcaacagcaacgattttgcagttccttgggccggttttcatcttgctttatgtggcatttgcaactcaccaaatgccgcggcgaattgactttgtcagtatcactttggcgctaattggcacctatttgctggttacccgcggtcatctgacagggttaagtcttgcgccggccgctgttttctggggcattatggcaggtgtcagtcaggcgctatacacgttgcttccgcgcacgttactggccaaatatgacgctcgagcggtcaccggttggtccatgctcttggggagcttgccatttttaccgcaatacgtgctgcatcccaatccgctactaactttacccgattttggtgccattgccttcgtgatcgtattcggtacgatgttcgcttacttgctggtgttgggcagcctcaactacatctcgccagtcgccacgggcatgttgagtgccttcgaaccgttgactgccaccactctagccgtcacccgcttgcacatcgcgttcggaccggccgagtggctaggcggcatcttaatcattttgaacacactccttcaagcattgccgtttaacaaaattcaccacgttcagcaacgattaactcggcaattttcacagaaaactaaatcatagctaagtaaaaatggttccgaaacataagtcagccttatgtttcggaaccattttttggtgcacctccagcgccttactattccggcgcattcgtcaacaaccaagtagccgtggcctgatattggccagccttagcagtcgctgttggttcaatgcctaggtaggccgctacattaccggtttgagtgcctagcgaccaatctgtcccaccagccgccatatttttcaccggtgtcgcgttgttattatccttgatagccgcaatttgcgctgtctgatctgtcagaaccaaccttgccttgccgcctaatttgttcccattatcgcctagcacatagctattatcagttaatgtaaaaggcgatagttgcatcgtcaaatgccagccttgcttggttggccgcgtatctttcacgctcaacaccttgcctgtcgaattggtcggttcgcggccttgctgattcgtcagccactgatctgcattcgcctgatcccaattagtggtcgttggcgttggcagtccctttaccatctccatcacggtcggattacgataaccggtttgaccatttttcaattcgaagacaaaactcggcactttctccagcacgagttcacctgtttcgggatcaagaatataagcgagaaaatctttgcccgcaggtgtcttcagatcataagtctggccatcccctgtgatggtcccaattggtttgtcctgaaccggtgtcgtttccagaaggccatgatgtttgactttggccggcagtgaaaacttcaccgttgccgttgctccttttggaatctggggcatattggtgacagcaatctgattgccatccggttgaacttttccttgggcctgataatccgaattacctatcgtgactttgatgggcaacgtatcgcccggtttggcgggcgtcccatcagccttcagatagtcaaaatattttccttttggcacgttcatcgttgctgtcccgctttccggccagggtgcctgactggttgccttcacgttcacggtgtaatcatagtgcagcacatcgtccacttttagatgggtggtggcatccaccgtttccgctccgcgcatcaaggcgactgtaccattcacggtcgcggcttcaggcatggcgccgattgcgacgacatgcggttcgaaaacgtcacttgtcgtcccggtaaaccctagatacaattttctcggcgcgggatcggttgaaccttgagaaaagtatttttgaatatcatttttggtccacttgatgacctctgtggcgtagtctggcttactcgcgcgagtaatcgtcatttgtgccgttaatgtaccgccaccgagattatcttttttccaatcaagttgtagtttatgccatttgccattggctggcgtttcatacaaattcttctgtgttccaagtccaaagcggtattgttcagatggattgttgatcttaaaatacagccaagtcatccaataaggatagtcgatccgatacatatttgcttgtcccggataaccagtaccaaagtaataagactgaaaatcactcagttgttcataaccacccggatctcctgtaccattttttcgtgtatccaccaccattgcaaaactattgggtaacgctgtatcggcgacttcttgtggcttgctattaggcggaagatgatccaccccccaaacgcctaatgagccagtatcaatctttttcggcgccgctggtttcgcagcaagaacaaagcccatgccttcactactttttggcttgtttcccatataaaagtacatcgtatacgaactatccttatccaaatcaaacattggggccttgctccaaattgctcctgaccgatttgcttgatccttgttaatctcaagcccgactgcatgtccgctggtcggatccgtcaataaacttgagtcacccatcgttggtgaaaagaggccgtccacgtcaccaaatgacggcggtgctggatagccggaagtcgtcggccacgtgacggccgcgccaacactcgtcacaggcgccagcagggtacacaacagcatgccgagacaagctaacagatagcatcgttttttcatcagaacgcctcctttcgcaagtagtccggttgcaaggtgccattacccctaagcgcacttgaagttcaattgcaccgtattttttcgctacagacttcagcaagcaaccatgtccacccatctcacttctggctcctccaaaagttaatccttaccatggcctaaccttttggtgcattgctcagggtccaagtaatagcgccttgatacctgcctttggcaatagtgacgttggtgttcgttgcaactaacgtcaatgccgttctggtaccaattgtggtctggttattgccttgtccttgtcctgacttagtacccgtctcagcatcggcctgccaaacaacggttgaactcacagaggtgttgtctttggcaaaattcagccgcggcacattgctgccggcaggattaatcgggttgatatcgggattgctcgcggtaagctgtgacccaaccaaatcaacataccccgccaagaaatgccctttgccatccgtcagcgcgtccatttttgcttcaagccgccacccagccccggtgccccgataatcggcaatttgtaatagtccagtcgcattgccgtcattggcatttgttgccgtcttaatcggtcccggattcaccagattgcttttcaacggatgccgctgaaaggacccactcacgatttcatgaacagaaatgccaccaaaattcaaatccggcacctgctgaatcatgatattgccagcatcaaccgtcaattgagcactggacttttttggggctagatcatctgcggccataactgactggtgcggcccgacgaaacctgcaagcatcagggtgacaaaagcgatggcgaaattagtcacgattttcatcatcgtcccccctgtcttttcgtttaaaccgcagttgaagacgcaaactgctcatcatcaggagtgcaaaaccgatcagcggataccaggtttgtccgccttcgctggtctgtggcaaacgatcaacctgttggcgtggcggtaccgaaggctcttcctttggttttgatacttctgttcctggtgcattatgatccttgtcgggttttggccgatcgtcaatcacgacgacttcaccgatggaggttgccgctcgcacttggtgagcggccatgatcccttcaccgaggacgccgaacacaatgatcaaactgatcaaaaagcgccatatacttcgtgtcatcggtctcccccttttccctacgtttgtcattccgagaacttcatctgattaactcagtagtatcgcatcacccataactgacccaaaacgcttttcttcaaaaaggggtcagcgttcgatcgctgccccccctctttggtgatatgcgatccattaagctggtgcgttggtcagcgtccaagtgatagccgtttgatacttgccgccgtatgccgctgtattttgggaaagcttcaacacggtatctgccgaagtgaaaacacctgtgttgcggccttggccttgaccacttgcggcattccatacctgcaccccactgccttccaagaccaactcagcctgactaatagcagttggattattatcagtctcgtcggttttcgcaaccccagccagcaaaagactaccagccagtttttgtccagccgcattcttgagttcgcccgcctgagcttctaacttccaaccagcaccattgccgcgataatcagtgatatttaacaaaccttgattattcccatcgctggcatttcctgctggttcgttcttaaccggtttgtcagtaactgtattgcttgtgagcggcaatgtttgctgcccagttgccagttgctcaacactgacactcttgaacttcagatctggcaccttgaccaatgacaaaatatccttagacccatcaggattgtccggattgttaggatcaggattatctggatcaaccccaactcgaacttcaccaacagaggttttcttgattggttcgtctgcggcaaagacacttgtgattggcagcataaccccttcaagtgtcattgctattaaaccagcagacatgtagttaactattttcattattttatcctcctgcttttaaaatatgttttaattccttattaaaatactaataatatacgaatattttttatatatcaactatataatccgtatataaccacaattctctattaagtaaacgtattcaacgttatttttctcgtttctgtttcgttagatatgctatgcattccgacataacagatgatccaaattaataattactcgttatttacacagtgataataaattttcaaacggtggctccatctcaaaaatggccatttattaaacttataaatcacgattgcaagtcgcgtattatcagcctttaatcaataattcgaattaataatatgattttttgacctcatgggcgttttaggatagtatgctacttttttacagtttttcaggcttataagacttctagtttgcactgaaacatttgatctagacacgaaagattgaccatggcaagcaattttcctttgctttgctacttggacgatcttcacactcgcaactttattctgggcaaatcaaaaagccgcttctccgaaaagaagcgacttccttatatagctcattaaacagtcagctgacacctgttaatggcattagcctaatctgctgaatccggcgatcaaaacatgaattggcatctcggaaatcacggccaaaaccgctaccgccatggtgatgagtgtgtgcgaaaccatccgattcttcttcatcctaagacccctttgtctgtgctcatgactgacttgcctttaatctaagagataagcacatcatattctcatggttacttcatttcaaggagatcttgaattttttgacttatttcgctattactgcggggcgtttgctaacgtccatgttgcagtggaactgtacttgcccgcatgtacagaaggcgttctctgtacagacagcagtgcttgcgtactggatgcggcatcaccaagtgaccaatttggttcggtcgtccccgcctgcattaccttcacaacactatcttggttattatccttaatcctagtcacttcgaaatctgtttggctattgacatcaaacagcaccatctcagctttcccaccgcccttgtcgccattatcgccaagaacataatcatcagcatgtgtgaatggtgacagtttcatcgacaaacgccagcctggtttatctggacgtgtgtctttgacttcaaggtacttgccaggtgcagagacattctgtgagttattgatgagccatttatcgggtgctatttctgagctagaattcagtttgccttgaccaggaatacctgcaataacatctgctacttccggatcaactggctccggttcccccactttaagtttttgaaaataaaagtttggcacaactagtaaggacagttcgcccggatcaaaggcggcaatactatatttaacgctgtcggaattatcaaccgtgtttgttaatttgtaactattacttggtgcaccaccagtcagattacctgcagcatgagtcacatacttaatggtggtagcgttatgcttttgcacctgcacaggcaggctaaatttaacaagcgattctgtgttgttaggaaattcaggcatatcggtaataacggccgagagattgtcgctttgaacaatcgcatgtgctgtcttcgtctcagaaccgatcgtcacattaacgtccaaattatcgccgggttttgctggagctccgcctgaattcaagtaatcgagatattctccttttggcaaggcgatattagtagccttccacggacgaccatcaatattattcacatcaagcgcgtactcatacatcaacttatcgccgatgtttaagggtttatcaatagtgacaggatcattaccttgtttcaaggtaaccgttccgctaactgtattgaagtcagctaagctcttgatgccaacaacgtggggctctgatgcggcccccgtcgcgctcgtgaaacccaagaaaagtttcgtgctaccgaagattgattgaatctgtgcattcgtccaagttatcgagcgactaacagtcgtgagtccggtaccttttatctgataagttaaggtaccgccacttgatgtctttgcccaactaacaaccaaattttgccaatttccattagtgacacgagtgcttaagggatcagcaaaatttctgagtccagttccagaaccagtgaatactaactccgtctgccaatatgggattccgattttatacatgctagcctgactcggatagccagaaccgatatactgatcacttgagaagaaagcgggatagccaacatttttgtccatcccacttttgaatgcctcaacgctctttttagtatccaccacaatagcaaaactgtttagggttcctgttgcggcaacacctactgaactaccgccttgcatttctggcaagccccaaacccccaatgatgcaccaccatttcctgattttgtgggtttggtaccggccaacgcaaaagcaagcccgtctgcaccaccagttttattacctaaataaatttgcatgtccaatgtgaatttatctttgtttagatcaacaaaaggcgtcttgctccaaacagaaccgaccttgcttgcttgatccgcattcagttcaaagccgacttcatctgtgccgcttttaattgggctcgaatctgtagacacccgatcaaaaagaccattcaatcgggtaaaacttcctgttgctggagcgggatacgtgccactcggccaagttgcctccgctgcagccactgactgcagcggaccaagcaccatgccgaagatcaccgtgaggcaaatcatgataaaggttttctttttcattttttacctccctgccgtgatcggccgcgtagtaacacgatgcctaaaatgacaataatcagaagttcaaccccaatgaccacgtaccaaagttgaacagcattgccagtttgcggcagatagcctgtatgggttagcggcgtggcttgaccatgctgatcagtggtttgatgatcaaccggttctggcgttggtgtcggatcaggggttggcgttgggttaggatcagggttcgttgacggaagttcaccaacaagttcaacttgtgcaacagaagtgtctgcctgaacttgctgcgccttcgcgccaacgccgaccatgagattcattgtcatgagcagcatgatccaaaaactaggcttgtttcgtctcatcggtctccctccttttgcgtcgttggcgccaaattaaccacagcaggatcaagatcacaagcgccagtatgatcgcaatgataatccacagccaaggggtttgtggggcacgtcccagtttttcttcaatgacatccgcctgctgctgcgtaatcgtaaagttccggcgccaatgccaagttttgtcagcacctttgactgttaaatcaagcgtataggtgcccggtgccagtgcctctttggagaaaatggcgtagtcaaaatgcgagtttggcgcaaatgaccaccctttttccgaacgtgtcaggtaaggatcttttgagccttgccgataaactttgccatcaagtgtcatctcaccaaataaacgaggtttgatattctgaatggtggctaagacgctggcctgattatcctgagtgcccggtttgacatccatcagcttcaattctggtgccaccttggcctccgaagtctgcaaaacaactccgacaagcatggcgaacttgttgttaatcgccatgccactgccgccgcttttatgcaccgtgggatcttcaacgtataaactgccgagaatttgaccggtgaaacctttttcaggaatcttcacatcaaacgtgactggcacttgtgcctcagcaccaacatcaattgttttaggcgcttccgtcagcccggaagaagtgtactcagcggacttgtctgtgtgtttatttgggtaatagcctaacgtaccattactttgagtgaacgcactgaccgcactgaccttcaactttttagcactttttgttgtgttcttaacataaatcaacagccgctgggtctcgccgggttttaccagcaaattaaaataggttgattgatcaatttgattttgcggcaacgccgggctgatagtaaagccagcgccttcagctgcccgaacctgatgggcaccgccgaaccacaacaagctcagaattgccaacaggctgaaaatgattttctttttcatggttccgcccccacagtcatgaaaagggcagcgaatgaccgctgccccttagtttaggtgccatagattacttaggtgcgtcggctaaagtccaggtgatggccggttggtattgtcctgctgttggtgtcaaattctgtttcagtttaagggtcgtgccacccgcatttttgatgacagcagtgtttttcccctgtccctgaccatcgtctgtgccagtggcagcattagctttccagacagacactgcagcgccgccaatgactaattctggaagagcggcgcctgggttaatcgcattaaggcttacattatcagtcttaatatcggtccctttaaggatcattgaacccgccaatgccttaccacctgcatttttcatatcgccaagttgcgctgtcagctcccaaccaacgttcgtaccgcggttatcggtgacgcttaaatcaccggttgcattaccgtccttgggatcagcggcagttttaacgggaccaactggaacggtattatcaacaagcggttggctaacctcaccagcaattaacttatcaatctcaatagttccaaagtttagatcgggcacttgatctaaggtaattggtccaccctgaatgttaacttcagctacagatgttttgttaatatcagcagcgaaaacctgaccagttggcaacaggagcccagcaattgttaatgcggaaattccggctgcaatatagttaacttttttcatcactttttgcctccatatcgttattgaaattcatttatctctctctatactactcataatacaggattgagcgagaagaatcaatgaattagagctggcgtagatccctttaatatcgggctttgtctatgactcaccttcaactttctcctactgatagtattatggcatataaatagctctttatgcaccacattagctcttgtgatttactcagttatttatatagtgattgttagcggtttcacatttttgctttaatcactctgcgctttccattcaagtcatatttaaaattaaaaaatcatttttcttaaaaactcgttaactgacccaataatgatcaatataattaactcgataggcttgcaggtttcagctaatattgatttatcaaataagtttatttattcaatcagcttcaacattgtgaaaaaaacttcttgtgccattttttacgcaaatcggacaaaagctttttttgattaaatttcaattagttattgacaagaaaacaatccatgctaaactaaaaatcaaatataaatgcaacgcgaaagacaagtacccgtgtctgtgaatacagcgagcttcggttggtgtgaggaagcattcatgatatggcgaatatccctttcaagcaggacaccgaacttcagtaacgtgtcatgggggcacccattacagtgctagcatatcgtcattggaccgtatgcgatgaagaccaaggcgcagctggctttggtgaattaaggtggtaccgcgcaaagtcgcccttagaaaaatctaagggcgacttttttgtgtgagcgtgagtcagcccggttagaaaccggagtgtaagcggccttgggcgtgatggccgtactttggccattgcgaccaaggtccttacacgcggtttctgggctggcgagcgcgttatagcggagcgcgagcagaagcgcttccccaagcttgaattttcgcctagcaaacatgtaactcaaaccattgaaggatgtgatgcaattggaatctgacattagccacattagctgccaaattaatgaatcaatgatacatctaaaaacactggaggaactcaaatggaattatctgaaaagaagctcaaaacccgcgattatgtcgtcattgcatcacttttgttcggtctcttcttcggcgctggcaatttaatttttccactgcacctcggtcaactcgctggtgccaactggtttccagcaatgcttggcttcttagtcacagcggttgcattgccgctgctcggtgtgttggcgattgccgctacgcatgcagaaggtgtgtatgatattggtcgtccacttggccgttttttcgctcttgctttcatggttttaattcacgctaccattggcccgatgttcggtacaccgcggaccgcaaccgtgtcctttacaaccggcgtcttgccgatgctgccaaaagcgtgggcgcaggttggtctgctggtcttctcggccttattctttgccgccgcctttttcctatcctacaaggaacgcaaaatcacaacggctgttggcaaaattctcaatccagttttccttgtcttgctattcttcgtcttctttattggtttctcccatccaatgggaaatccagcaacccaaactgtcacagcagcttataaaaatgccagcttcatgaatggtttcctacaagggtacaacacgatggatgctttggctgccttagcctttggcgttaccgtggtcacagcagttcgcggtctcggcttaaaaaaagatgacgatgtggccaagtcgactgcaaaagccggcgtgatggcaactagctggattggtctgatctatgttgccttaatcctgctcggcagcatgtcattggctcacttcaaacttagccctgaaggtgggactgcttttaaccaagttgtaacctattactttggcgctgctggtcatgcggttctggcaacattgttgacgttgacctgcctcaccactgcagttggcttggttgctgcatttgcgcaagatttccatcgtcattttccaaaggtcagttatcgtgtctggttggcactgaccagttttctatccttcttaacggcgaactttggtttggagcaaatcatcgcttggtctgtcccgatgctgatgttcctctatcctttctcaatggtattgattctcctttccgttttcggcaaggcattccatcatgatccactggtgtatcggttcgtcgtcggcttcaccgcagtcccagccgtcctcgacatgttcgctgcctttccagcctttgtcagtcaaagtgcgcttggtctggcattgcacagtttccaattacatttcctgccgtttgctggcatgggccttggctggttagttccggctggtgttggtctggctgtcggcctcgtggcacacgcggtcaaagttcgaaaagccgttgctgtcgccaaattaggtgccgaagaaaattagaagtgaccaaaacaatagccgatcaacccaaaagccggaaatgcctgacaatcgcgcataccgcttgatcagctgttatttctgaaaagtctatgcctcttcgtgtttgtaacgaatactgaagagataggctttttttacggtcatcaagttttggggccattcaaaaaacgtgtcagtgccatcaaaaaacgggctcccctctgactaagaagaacccgttgacaaatttagtcgcctttcattcaccatcacggaactatttaagtaagttaatctgggaaaacaagatgtgtcaacaacacttgatcgatcaagttgatcatcttgccaaaaacctgattgaacggcgacaggctatctagttgaagggacttcccaaaaacaggcgaagaaaacgccttgctgagttcccttttcgttgcgataaatgtcgattgcacaaagtcaaaatttggctgcgccatccccagcactaaattttgaatcagatttgttgggcattgctgtcgcatctgaacagtctcaatcaacgcctgccaaataatctcaaaagcattctgcggctgcttatgggttgaaccgataaaagaagtcacactctccgggaccacagatattgtgtggcctgatttcacattatcatgtgttgccgcttgcgctgcagcaacaattgcctgttcatcccgctctttactcgtcggtgctttagacgagcttgcttctgtcgcattaacttcttgtgccgttttaatcattggttcagaaactgacgggtgtgcatcacgatcatcttgctgcgcggttgctgacgatgtaacattcccgtttgtgacaggtgcttgactgcccacagtttccgcacctgtgtccgatgttgctgccccattttgctgactcgatgaaaccgatgaactatccgcactgctggtattgcccgccttttgatcatcatcgcttgaaaccgtgacaattggtacttcaaccttgttgtcagcaatcggtggtacgatcgctgattgtgatgccccatgatccggcgcagaaccagtgtcgcatttcgatgtcgctgattgaatcacaatcggcactgttgctgcggaagctgatgcctgattagcaatcaccgctgatacacccaagccaagcctggcagctaacccgtatacccatgcttttttcatattgccctccttgaagccttaaagcgtttcaattattcactccgcgttaaatataccgcacttattttggaaagtcactggactttaggcggagagcgtaagcaggcgcggttagaaaccggagcataagtggcctcaagtgcgatgaccgtactttgtcattgtgcttgaggtccttatgtgcaggtttctgcgcctgtgcacgcgtttaaaagagcgcaagcaggcgcggttagaaaccttctacactcactattgacaacaatcattttttagcctaatgtgatgtcaatatcacacaggcgaaaagatgagtaaccagtcgaaggtccgcagcgagttgtcatttggtgaaagacaatgatcgggcactggcgaagatggtcttttgaagcattcagttgcgaacacatcttgcaagcaattgacgggcactcccgttactgagtcagggtataacgcaaacttgcgaagtacttagagagaatcgatttcgatcggttaatcaaggtggtaacgcggaaaatccgtccttgtctattgtcacaatagacttgggcggatttttttgtagagtgatcacaggcacgtttatggacaggtttctacgcctgtgatcgcatttctgagcacgatcagggacgcgcgcaacccacttcaatcaacctatcacgcctgtgtgagtcgattcaaggaggaaaaagtatgtggaaaattgttgccgatgccgttccacaaatggcggctgcgggaatcaaatacacgatcccaatcgcgctagtttcattcgcgattggcctcatcattgcattgatcacggcactgacgcgcatctcggtacgaaaaggcttttggatcacctttgcaaaaggcttcgcttcattttatgtttggcttttccgttcaaccccgttgctggtgcagttgttcattgtcttctttggactaccaagtctgatcattccgggcatttttcctcacggtatcaaactcgatcctgtgatcgcgggcatcatcacgttttcgttgaacacgggggcctattgtgctgaaacaattcgagcagcgctactgtcgattgatcacggtcaatgggaggctgcctactcagtcggcttgccgcggcgcttggttctgcgtgaaattatcattccgcaagcactacgcacggccgtcccgccactatcaaacagttttatcagtctcgtcaaggacacctcactggcggcttcgatcactatcgtcgaaatgtttcaggtgagtcagcagatcgctgctgagaactatcagccattattgatgtattcactggtcgctttgctttatgccgttgtctgcaccgtcttaacttggggacagcgctatcttgaaaaagtcacgtcacgctataccagcaatgtgcagacaacgcagctgtaacaaaaacaccattatggaaggaagattctaatgttaaagaaaaagttgtgggtcttattaccaattgttgcgctttccgcgttcattttgacagcttgctctagtagtaaagctgacagcagtaaaacaagcacggtcacgagcgaacttatcaataaaaatgagttgaccatcggcctcgaaggcacttatgcgcccttctcttatcgcaaagatggcaagctgcaaggcttcgaagtcgatcttggcaaggctctagccaagaaagtcggcgtcaaagccaagtttgttcctacccaatgggattccctgatcgctggccttggaagtcaaaagttcgacctcgtgctcaataacatcagtgaaacaccccagcgtaagaaagtttacaacttcaccacaccgtacatgtactcccgatatgctttgatcactcgcagcgatgaaacctcgattaagggtttgaacgacatcaaaggcaagacttttgttgaaggcactggcaccccaaatgctgccctagctaaaaaatacggtgccaacattacaccttctggcgacttcactgtttcgctcaatctggttaaggaaaatcgtgcagatggcaccatcaacgccaccgccgcctggtatgcctacgctaagagcaattccacaaccggtttaaagagccagacacttaaagatagcgatgtgaagcctgacgaagtggctggaatgatcagtaagaaatcgcctaacttgcagaaagccttatccaaaggcattcaggaacttagaagcgatggcactttaaagaaattgtctgagaaatactttggcgctgatttaaccactaaataatcgctttgcgttacccattaactattggctaaaagtcgcgactatatgtaggccgtgacgcgacataagttgtcaaccaatcatatgaggaggtcgggcatatgacccaattcaataccaaactagttcatggtccacaattgcaaacggataaagctggtgcgatcgtaccgccagtttatcaaagcgccacgtaccgctttgcgcctgatggtggcactagcgattggaactatgcccgcagcagcaatccaacccgcgactatcttgaacgtcaaatcgctactctcgagaatggcgatgcagggtttgccttttccagcggggttgcagcgattgcgacggttctcgcgattttcccggatggcagccactttattatcggtgattcactatacagcggaacagatcggttgctcaatcagtattttgctcaacatggcctgaccttcacaccggttgacccgcgcgatctaacggcagttgaagcagccattcggcctgagaccaaagcgattttcttcgagacgttctccaatccactgctcaaagtcagcagcgtcaaggctattagcgctcttgccaaagcccacaacctgctcacaatcgtcgataacacgttcctcaccccttattatcaacggccacttgatctcggtgccgacatcgtcctgcatagcgccacgaaatacatcggcggccacggcgacctcatcgctggcttagtggtctcagccagtccggaaatcagtgaaaagattggcttcttgcaaaataccatcggcgcgattcttgcaccgctcgactgtagtcttgtctgtcgcggcatcgccacgctcgctgtccggctggatcgcgaaaccagcaatgcccaggcggtcgctgaatttcttgaacaacatcccgacgtagcgcatgtttattaccccggcctcaaaagcgaccccggctatgccttagctcaacaagaaaccaccggtgccagcggcctcctatccatcaaactcgccgacaacattgatcccatcaagttcgtcaacagcaccaaggtcttcgacttcgccgactccctcggcaccgtctccagtttagtcaaattaccatggttcaaactgcccgaagaaaaacggtccacctcaggcctgacaccgcaacatgtccgaattgcgattgggttggaagatcagcaggatttgattgatgatctggcgcaggcattgacggctgcggagaaataatgagacaccaaaaaatcgttgcaagcatcatcgctgcaacgattttttgtgtcgggacgttctttaaagaatgcctccaccgggcataactgatagctatgtatcaacatttgaggtatccttgttccctttttgtcccctttgactgacaaatctagaagcatccagaagcaagttattaaatcgtgtttcaacggccttgctgtggctgataatttagcgcacaaaagcaatcaaaacgcaaaccccatccatataggatggggcggagttggcaaggaattgcttttatctggaagacccgccgaggggggcaggttcctaacagtatacagtccgtatgcgcgattattcttggggtgggtagcagcttagcttgccaactcctaaggagctttttactcctagctattggagttttgctccttcaccgtcagtatcgcatggctatgctgggtatgcaaacaatttgctcatagtaagttacctaatccggcatatgtaaaccttttgcctttttgagtcgattctgtcaactctgtgcacaaaaataagcctccctgagcaagggaggcagaacgacaaggtattacaggctgactaaaatatttagttgcttacgtatcttattttacagcattatgcccgtgcttcaaagcaacaaaaataagccctccacccgcgttagcgagcagaggacttttttgttacctgatgtacaggctctcgcccggatagatcaggctgtagattgacttgccattgttggcggctaacgtgtacatgctaatgccgtacttgttagcaatgctccagaagctgtcaccagagcggactgtataatacgtgtgcgaataggtttgcgcatttgaactgcgcgaaccatagctctcaccaccatttacgcccaaggcaacataatgatacctgcctgagtagctgagataacgcgcccaaacatatgtgccacggatatacacgtgatcataaatcacactttcaccgggtgcatagctaccaacggatgcatagccggtgccggcaccagtgcggatgttaacagtcgtggaaggcttgaaaacaccagtttgcgcataatcggtatcagtggctgcggttgattgcgctggtttgcttggtgctggggtgataggtgttactggctgcttcgagtatccattatcggtgacaccaagcagatcaatgttaccatcgaggccttgtgacaacccaaatgcactcgtgtactgccaaatagctaccccatccatacttggaaaataaccgtagtctggtttggtagttggcagataatcacggtaagcagctatccaaaggctgttaggaaattctttcagaatacgctgataatcgacgtgtgccaatgtatatggcttgtaactgtaatacatgggcgtgtagccttctgaacgaatgcgccgcatgccagctaaaatggcatccgtattagctgccatattgccagaagcaccatcttcgtagtccaaagcaacgatgcttccctttggtgtctgcgctttgatacgaggcatataacggtcaagtgcttctaatcccaactggctacttgcaccaacaccataccagatgtagctatgcacacgttttcttgctgcctttgcactggcaattggcaagaatgtcaatggtccggacaaaaattgtccggttctgccgaatgcgtatggttgtcacttaaattcacgcattatcagatcttttatcagcgtttaatcttgtttaggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggatgttttgtttgccaccaatcagatttaataattgctgagctaatcctgattcattcattcggccttccccctttagctacacttgcgattcccacagcgagtgatatggttcagtatcttgcatcacgatgactgcacttcgctgtctaatgttgcattctttcttaaacgcgatcgctagcctacttacactccggtttctatccgtgctagctcacgttctttctcaaaacgcgttcgctggcgcagaaacctgcacataaggacctgaagcctaaatggtccaagcccaaccatttaggcttcaggccgcttatgctccgatttctaaccgcgccagctcacgctctcacaaaaaaagccagaaagaccggacttgtggtgtacaagtcgtgtctttctggttttgcctaatccaatagttacaagccagatggttctgtattcgctttcaacgacaccatcttatcgtacgcattagcacgcgtcaacaacttttttcactccgtcaaactttttgctaagcgcgcaatatgcatggtgagatagatttgctcgtttttaggaatcgcaatcgctaacttctgttgcatgaatcggtcaacgtcttccatacagtgataagcacgggcataatcttgttgaagatgtttcaacaagacatagtcgtagtgttccatctttaacgacaaaggcgacggcgcagcagcatacatgcgttgtaggaaaaatttgaggtgaataactagtcgttgataatcaggtgttttgacgttcatgtccagccctagattgtaaaagattattttcgtgagactcgccagggtttgggtaaaggcgagtgagttgacggtttgctgatggttcagatcgttgctcacaaactttaacgcgatgaatcccgcctcatcttccggcaattgttcatgcaattgcgcggcgatttgatgcaatgcccattcgcccatctcgtattcttgggtgtaggcaacctgaatctcccatagcaatttgttgtgcaatacgatcttctcatgcagccgttgcaccgcaaaatgaacatgatcggctagctcaatcaacagataactgttgaacgtggtttgcaatcgcttttctgcctcctgaatgatcccagcggccaaatccaaataaacactgggcagactggcaatcgtcgccgtcgcgattttcagctttgcttgatcctctggcacatagactttcatactgtcgcgcaaggccatcttggcgtcttttttagcgcggaaaccgatcccacgctcgaccacgatcacctcgcgttgttgatgtctggccacgacagcattgttgttcagcacgttttgaataatcatggcgaccctcccccaaaggtattcgaatcttcactttgtcgtattctcaaaatagcgtaacaatgattttaaaaattgacaacgtgaacgactcagccgccgaaaatatcgacattcaggtgggatctttatgcctgttatttaggctcggtgctggcagctgaaacccgatgatccgcaaatcggtacagccgatcagcataagccgccgactctgcacgatgcgaaatcatgatcacgatgccgtgatagtaagccttgatagcgtccaaaattaatcgttcgttttcagtatcaagattgctcgttggttcatccagcaccaaaacgctgcttggatgtaacaaggctctggccaattccagccgttgttgttccccactagaaaattgtaattgtcctgatacgacattttcatcaagccccttttcggcctgacgcaaccgcgacgtcagcttgacttgatcaagcacggtccagatttgcgcatctgtgatcgtcgaatcgtgcaacgtgagattgtcacggaccgactcagagaaaaagactggcatttgtggcagataattcacctgcgcgcgcagtgatgctggatcaattttggtcaggttaatgccatcaattaaaattcggccttgggtgagcggataccaacccatgatcaatttggccaatgtactttttccagacccactggcgccgacaaaaccgacaatttcgccggcatgcaaggacaacgacacttgccgcaaaacggtctcgtcacggctaggatacttaaaggtgacgtgatcaacttgaatggtcgcgatttgattcagtgtttgggtagcgtcaatcgccgctgatgttgctggcgcctcttgcaaaagattcaataaattgcgagcagccgcaaaaccattcaatagcgaggctggcaaattggttaaagctaataacggtccgaacgtgagcggaaacacggccaataaagcttgttgcaatggctgcggctgagtccaaccgctcaaccacacaatgaatagccacgctaccagcatcaccaacgtagcactcatatttttcaataattgaccaaactgggattgttgaaaggcggtcgcctcatgatcaaatccctcattgcctgttttcatgcgcgcatcagcaacctctatctgacgcaaaaccgccatgccgcgaacggattcaagcaggtactgctgattaaccgctttttgacgatccgcagcctgagccttcgccgtcatctgctcgtgccgataatacggaattaacagcccgacagccgcatagctcaccaacacaacggccgccgccggatcatttaagctgctataaacggcaaccatcaagacaccataaataaggccaatcgcaaccggaacaatcgtatgtgcgtagaaaatttccattgcctcaatgtcactgccaatcagtttaagcaacttgccgctgccttggctatcaagtttagcaggcgccaactgcaccaattttcgataaaccgcaccgcgcaattcggccaagacgtgaaacgccacaaaatggccagcatattgttcaccaaaactacccagaccaacaatcaccaccgagatgatgccggggattaaaaggtgtgaggcattctggggatcgaacaacatcatcgcagccaaaactaaaacgacgacttttgttaattcggccaccaagccaatcagaaaactgatgataatagcccccgttaagtggtgggtgtaacgcagtaaacttctgatcatgatggctgaccttctttcaacattgcctcgggattatcaactaagtgacgatacgctggctgatcgcggtaaagctgtgcatgatccgcgctgattaactgatgatcgtgaataaaccaaacaacgtcagcttcggccatcgctgacagatcatgggaaataaacagcacaattttctgacggctcagtcgcttgatcgccgctaaaataatggcagcattcgcagcatcaatacttgatgtcatttcatcgagcaaatacaccgttttgtctgccagtaacatgcgcgcaaaggccaactgctgccgttgtcccggcgacagcaaccgcccaccttctccaacttcagtggcatagccatcttgcaaatcagtcacaaagtgcatcaatcccaattcgtcaagatgttgctgccactgatcaccaaattgattgcctaaaagcagattttccttgatagtgccggaaaaaatatagtcattggcagccacatacccaaacaccgccgcgcgttgtgcgttgctcaacgcagtgacgggcgtgttgtgcgttgctcaacgcagtgacgggcgtgttgtcagccataatcgtcccggataatggtgtcagttgccccaacaatgcctgtgtcaacgtactttttcctgtaccattttcgcctgctaacccatataacttacccggaacaagggtcgcattaatgtcggatacaagcggtgcgtccgcttcgtaaccgatagcaacatcttgcaaaaccaactgcttcagcggtcgattatccgtgattttgactgttgcaggtgtcgtcttagacttcgcaatggttgccaaaataccggctagtgccggaccgttcgacttaaccacatggaaaaagtagccaagttgacgggcattcaccatcatcatggccaatgcaaaccaagtggcaaatgccccggcagcaggcagttgacccgcagcaagttgcagtgccgtcacaaatccgccagcaaacactgtcaaataaacaaaaccattgataacaaacaatacttgcaattgcgtgcgcagcaaattcatggttgcctgccgaaaatactcactatcatcggcgaactttttagcataccgatccgctgcattgtacatcaccagtgtgttcataccgctcaaatcattcataaagcgaccacccatacgcagaaaaccggcaagatgcgccttgttttgcgctgacatctttttccccaaaaacatcatcgcaaagccgattaaaaaaacgcaggcaagtggcaaaaaagccagccatgaaccataccaaaccgacaagccaatcaacagcaaaaaggtaagacctgcttggattaaggttggaaataaggtgctataaaacatatctaaattattcaagccgccaagatcgcgctgaatcaccgcattatctgcagccgttgcatcccctgcattgttacgctgatacagcgcctcgaaatagtgatctcgcaactcacgcttagcactcatagcccatgcatgacgatgatgacgctcatagccaatcacataacccagccaaatcaacaccaagataactgtgatgaccagggcattccccggtcgctttgccgcaaagttcaacgctatcatgattggcaacagtgttggcaaccagtcaaaaacagtttcaatcaccccggcccaacgctggtcacggccatactttagtaatcctaacaatgatctgcctctttcttccttgcctcgacacatgtcgactttcatccgcaaatacggcaataatctttaaaaatttaaattgtttttttagtttaccacgagaactcaatcgtcttgcaaacatttttcgacaaccttcatcacataaaagaccgtcaccagctgacaacaggctagtgacggcccgggactctcattatgggtgaaccaagccaccagtgtcaccgctcgttcccgtacctgcttgtgctggcttgatctcaatcagcagtttatgcggcagacaaatactttgctgaccgacctgactgatccatcctgtatgaacagcgatttgatcaggtgaattgtcttccttatcccgaatgcgcgccccttgcacttcaatgatgttgtattggtcctttgccggatacaacgtgaactgctgatgacgcgtatgagtagtgagttgaatacgccgtttaacatgaccattgatcgaaatcacggccactttttgatttgtattcacgttcgcttccgtcaacgaaaaaatgccaaccggaagaaagcatgccacaaataagacgatgacaatcacataatcaaacggtcgaacatactttttcaaccagcgcactcgaatccccccttgtcgccgtctattttacacgtcatcaacatgcatcgtatgcacaggtgttgctatttttccggcaaatgaaaagcaaaaaagctacgaatctcataggactcgtagcctttttgatgttatcttcatcaacctaacttacttagcggcttttgcggcactgataatcgcggtcaaataacccgacgtatcagtaaacgttgcaccagaaacgacatcgctgactttctttttgcccttcaagtcactaacagctgtttccagttcagcaatcgtctttcctttagcaaattcgtcaatcgcatttgagttttcttgccaagtctgggtcgccttgccttttgacttcataattgctgaataagcctcggaattggcccgcttggaagctaacacggtgccagatttgattcccttgccaaaatcggcattggaattaggcacaccgccaaaatctttacttggcatatactggaattcatccaagaagacattcgcgatcttatccccttgcatggcgaccgtcacgattccaaatgattgggtaccatgcggcgcagcaagcacttgcccttccgtgatcgtgttgtctgttgtctgaattccttcagctaccatcccggttgttgcggcgtcatagatagcctgtaagtaaccagccgtgtcagcaaaagttgcaccagaaactacatcgctaaccttcttagtatctttaaccttggcaacatccgccttcaaatcttcaatctttttaccttttacaaaattcgtgatggctgtttcgttttcctcccaagtatgggtcgccttggcctctttcttcatcaatgcagagtacggcttgctattttccgccttggcaatcaaaaactggcctttaggataactcttgccaaagtccttgtttgaattcgggacaccagtccaatcggaactctttttgacatactggaactcatcaatcttagcagaaacaatcgtgtcgccattcagcgtcacatttacagcggcaaaggattgcttgccgtgcggtgcagcataaagctgacgcatcattaaggtgccggctgccggcaccttggcactcgcatcggcgccggtattaatcttcaccttagcattgctcgtctggctagtcgtgctgctgctcttgctcgaactagagctcgatccactactacatgcggccaaccccatgctgaccaaaagtgtggcactgagcactattagttttttcatgtcgttcttcctcctcgttgtgtaagcgatttcatatataatgaattctatcacaaatgaaggtagacatcactggtttttaattgatatatcacttttcacttcaatgattgtttgaatattattgatacagaatgtcttaaatcaagctactttttatatggaaaattcatggaaagtttgtcctttctttcacaataaaagttatatttttgatgtttttgaaccgtctttctttaaaagacatttattgattgccaccctctttgcagtttgttagttatttcaacatttatttgggcttctcatatttttgacaaatctaaaccatcaattttcctgtccatataaaaaaccgtcatcaccagccgataacatcactaccctaacatcactgccagccctatcatgacgtgcatcaaaataaatgcactcagcgtcaccaccaaaatgttacgcgaacgtcgatagacccagtatagtggcagctgtgcgaccaacccgctggcaatattgacaaagacatgcggtgcaagcggtgtagttgtcacaacagccgttacggccagcgccaagagataagttaaaaacaatgcccaacgccgatgtttaatcgccaatcgactaaataactgttgactagctaggaaaatcatcaccgccgttaattgcgttgcaagcgtcatgaaaaaggcgcggaaactaatgacgctaaaagcacctaagttaccaaactgggcggcctccagcgtattgacaaaatcaacgccaaaccgaattggcaccaagtcgccaagaatcccgccaagtgtggtcgcaatcaggtacaaaataccataagcgaaaacataccagatgtcccgccaacgaaaacttgcaaaaagctgactcaagccatcccagccggctgcccatacagcgccagcaaaaatgatggcacagtaaagaacgccgccgaacacgacaacggctcgagtccagccattagcaacattcagaaaagtggtgccggacatgttgaaaaatccgccaatcggattgcgtgtataaaagagcagataggtaaacaaaacaaccgagaagaacttcagccagttattgaacgtaaaatgcggttcagtttgactaaaaggaactggccattgtttgcgtttagctaattttgttgcttccaattatttctcctcctttaacacaagttgaacgaagccttccaagttcattgacaggacccggtctaattgattggtactgcgatgccgataagcatacgccgccgattcaaacatcatgtacatccgcccatcatgcgtgctgatctgttctaagtgcgaaggcatatcaaacgtgtcaatcgcatcactagcgcggaagatggtcttcttaggatcggttttaaagatatataacgtcgagttaccaccaccataagattgcgacagaatcgtataatccccataaaaggccatcccttggattttcgataaaatgtcttgatgcaaaacggattgtgttaacacgtcaaattgattcgagatgctggaggtgaggcttttcccaacaacctgcctcttatcatttaaaggataacgttgaatgttcccttttccggttggattaaagaagccgacgaacaacgcattttcgtaataggtgacaaaagaagctcgtctaatattgccaagttgggcgcgttgagaataagccacagccttggctttcttatcaacattgtaagtcaaggctgtttttagcttgattgcaaaaacttcagccgcattgttccggcgtccgcagatccaaatgttatcgtttttggcatcataagttaacccaccaacatggggacggccattcaataccactgtgttaagcaacttaccggttttcaaatcctgaatatacatcactgagttatgaaaaccgtcatgatcatatgctgtggttaataagtaatcaccggccaccgtaacgccttgtggggtcatggttgtacaaacttcaacttcgccggtttcagcattgagtgttttcgttgcctttagaccaggtactatcggctgactgctatatttaacattgaattcgtctggcgtatagttaaatgtcttagcatctttaaccgggcctaatcgaaccattaaatccaagcgtttgaactttttcagcgttttttcgaagcgactttctgaatataagctgtcagtgttggtctctgtccgtgacgtgttcggctcaacttggtaacgtttaaccgtcccaattccccagccaaaaccaccaataaaaatgataatgagtaccaaatcgacaatcaaaatcatgagattttggcgattcaattttttcttcccatccctattcaaaatacgttcacccttcacgttctataatcgttatatcaatgtcatcattatagcaaaccttgcttctgatccgcatcacatgaccttttgtttaacaaggtttccttataaggtaatcgagtcattttaatgttcgaatgaatgatgttattgttataatttatacaataagttgcatatacaccgtttgggaggggatatgaatatgaaaaaaatcttgattggtattggcatcttcattggcctcgtctttcttggtggtgcagggttttacgcttggtatactcaaagcaccccttattacacccagattacgacgacaggcaagaagtttgatgttatcgatgatgagaccggtgctgcgcgggatattgattatgcctatactcagatggcctatgatgaaaaaggccacgatacagaggttgatttcaacggtcacaaatctcggcctttgaaaatgcaagcttatctccgcctcgattacagcacgcgtcgaaaccaagtgattagttgggaagccgtaccaaaggaaaaggttcctaaagcagctttagcaaaattaaatcgctaattaaaaaaggtgcgctggcgcagtttgaaacctgcgccagcgaacacatttacaaggagatgtctattatgacgaatgaacacaaagttttacgcgggttgtcttatatctcggtcatttttgcccccattctctttccaattctcgtttggattttcaccccacaaggttccgtcacacgggacacagctaaacacgcactttggctgcatattattcccaccctattgagcatttttatctttatgatcatgggcggtgtcggtttcttcacaaacagcatcaacgcaacatccgccgtttcacttatcttgctacttgttgccatggtcgttgacattgggatggtagtctacaacatctacacaggcattaaaattatcacctcctgattaaccactcaacatcgcaaaaaaggggcgcctctcgtcatgagaagcaccctttttggtttatcaaaatttcaccgtagccccgcatccaaagcatacaagttctgataccgctcgtcgtgcttagccaagtgactaggggtatcattcatcgtcaaacggccatcttcaagaaaaatgacgcgatcagtttgattgacgccttgcaaatgatgcgtcacccaaagaatggttttgccttgcaatactgtgaacatcgtctccagcaaagcctgttccgtaattggatcaaggccgactgtcggttcgtccaacagcacaatcggcgcatcctgtaaaagaattcgagctagcgacaaacgttgccgttcaccacctgaaaaaccgaaacctgcttcctcgacactgctgttaataccattcggcaattgggctacgagctggtctaacttgactgccttaagagcagcggcaacatcagcatcgctggcctgctcattgcctaagcggacattgttgacaatcgacgtgttgaataaaaacggactttgatccaacactgcaaaaagattggtgcgatgctgctgataagtcaggacatcttgaccgtcgaccaacacgttgccagttgtcggcgttaggtcaccaagtaccagttgcaacaacgtggttttgcccatgccactgggtccgagaatcgcaattttctcgccgctgtgaacggttagatcaatatcggtaattaattcaggatcttttggcgtgtattgaaaactgagatgctgcaatgtcatctctttgaactgagtcggtactgcttgttgttgcggtaattgtcgcgtgaccggctgcaaatcgttgagatgacgaatcgcatcgcggtatgtcggccattcgccaaccccttgtgcgatgccggaaaacgcttgatcgagtgggaaaacaaccagtacaaacgccccaacccagttagcactcgcttgattaccggtccactcaaggtttgtccagatcaacatactaatgacaattaagacaaacagcagttggccgacaaagtctcggcgccattgaaaccgcttggacttcaccgtcgatgcggccaactttttaggcgccgccagactttgagacataaaatccttttcgcgatgagtaatgacccaatcggacaaaccgagcactgaatccgtcaatgagacataggcatcatgattcaattgcttttgttctgcctttcgaaaacgctcaactaccagtccccaccaaggcagaatcaatacttgaaacaacagcaacaacataatccatagtgcaaagccccagttgaaccaacctagcaacaaagtggcaataaccgttagaccagcgccgaccacagttgggaaaatcatccgcaagtatagattctgaatgtgaccaatgtcatcggcgagcaagcctagaatatcgccggtttgatgatgttcggacacaaaggcagcatcagtttccaacactttgtacaattttcgccgcatgtggctagtaatgcgcaacacccaattgtgactggtcaaccgttcaatgtattgaaacaccggtcgcccaatcccaaaagcgcgggtcaagacaaccgtgacataaatagctgcaaacaatggcttcgtggcacttttgtcaatcagaaaacctgacgtgaacatcaaggcaccagcaaagacaaaggtcataacccccagaattaacgaccagaagagtaagccgcgatagcgtttcaagtctgggcgaacccagtgctcatttttcaaccaatgcattgaattcacctcgcatttcgtgcacaagggcctgatacggcttagaatgtgccgccagctcacttggggtcccttcagcaatgatcttgccaccatcaaccacaatcacgcgatccatttgattgagccagtgtagccgatgggtcgcaaaaatcacgagccgatttttgaacagcggcacaagcgtttcttttaactcggcttcagtttcaatatccaaatgggcagttggttcgtcaaacaaccaaatcgagcgattcgtatcaatcaaagtccgcgccaacgcaattcgctgggcctgaccgccggaaataccacgaccgccttccccgattctcgttgcatagccgtctgccaaagtttcgatccaatgactcaaccccgccgcctcagctgcctgtttcacatcttcatctgacgcatccggccgataaaaccggatattggcagcgatcgtatccgcaaatagatacggatcttgtgggatataactcaaatgatcttgccaagctgcttgggtcatatgcggtaccttcgttcctcgaaccgtcatggcagctttttgcggctgcaagaaaccgccaatcaaattgagtaatgttgatttacctgacccgctagcaccgataatcgccactttttccgtgccggtaaactgcagattagcatcttgaatgcccgcgcgttcatttggataggtgaaatcgaggtggttaatggttaccgtatcctgagcctgccaccttgaaaaagccggtaacacattggtatcagtaggtaatggctgatcaatcacttgccaaatcgccttcatcgcatttttgccattcaaggtggcatggtagtcagtcccaaaatcacgaatcggcatgaaatattccggtgccaagatcagcgcaaccattgctggatagagtgggatcgcgccatccatcaatttgatcccgaggaaaaccgcaacaactgcaatcgacaaggtggtgaagaagtctagcgcaaacgttgagagcatcgcgatgcgcaagacgcccatggtttgttttcgatagtcttccgacacatcgtacacattattcgcgtattgccgactaatccccatcaactgcaaagtttttaaaccacgcaaggagtcaatgaaatgattgctcatcttttgaaacccagcatattggctttcagatttatcctgtgctgccaagccaagaatcaccatgaacaaaatgataattggaaacatgatcagcaaggtgaagccagttagccagttttcgtaccaaatataggcaactaaaacccacggaataatactcatgttcagtattttgttcaaaatcagttcaatataattttcggcttcgggaatgccatccagcgccatcgtgaccaaattaccggttccttccttggcaacggcagccggccccaacgcatacaagtgcttgagcaattgggcttgtagccaggccgaactagtcatggcaaatcgtgccccgatgcgattgcgcacccaaacaatgagctgacgaatcacaaaggcagtcgcaaaaagtcctaacggaagccataagcctgctaaactttgccggttccaagaatgaacgatcccttcagcaagaaattttccttgtaataaaataacaaaagcttgcacgagcgcaaacccggcaagcattgtcataattcgtttcattcccgaaaggcgcatgagcgtcttatcgatcattcactaaccgctccttttgcttgaatccgcttgtggaagaccacatagctccagatgaagtatgccaaggcaattggcagcagaatcacagcgacaatcgtcataatggtcagcgtcaacgggctagcactggcgtcttttgccaaaatggacatagccgcatcttgaccaatcataacgcgtgggaacaagccgttgaaaatcacaccgacaaccccgacaagccctagggcactgccaacaaatgacaacacttcattatctttaagcacgccaacatgagcggcaactgtcgagccaacaatcacaaccaaaatcaacaaagtgctgattgggcgttctttgaagaagtcggtcataaagaatagaaggacagcgaagacaacttcaccagcatacaacaagtagtacaacttgctgttccagtcacgcgcacgcttgcgcaagtcgccagtcgttttcagacgaataaagtttaaaccgtgcatgagcatcatcaaagtgaccgcaactccgccgacaattgtcaaaaggttgatttgattacctaaagtaggataaacatcaccagccttggtaattggtaacggttgaatgatcgcggtaaaaatcatccctaagatgaacggtgggattaaactgccgcaagccaaagcccaacgccagatatttcgacctcttttggtctcggcatgtgcagcaaattcaaacgacacgccgcgaacaatcaaaccgaacaacacaaggaagaacatgatgtaaaaccccgagaagaggctggcataccacattggataagaagcaaacatcgcgccaccagctgtgatcagccaaacttcgttcccatcccaatgtgggccgattgtggcaacgagttgatcttcttcgtcagagttacgcgccaatagcttggttgacataccaaccccgaagtcaaagccttcaaggacgaagaagccgctgaaaaggacaaacaataagaagaaccacaaaatctgtaaccagctcattttgcgaacgcctccttagcaaacggatcactgttgaccccgtagtcagtgttcagatcgccttcaggacccttcttaagcacgcgatgtgagtaataaatcatgacaccgccgagcaaggtgaagatcaagaagtagcaaatgttagtgaacagtaactgtccagctgtcgttgtcggcgaaaccgcatcggcaattgaatacaggccgtagacaacccatggataccgaccaagttcagtgataaaccaaccagccgtattaatgatgaatgggagccacagcgcaaagccgagaatatacaatagccaacgctgattaagcaaggtatctttcttcttccggctaaaccagagacctagaacgccgagcaggaacagaagaacgccaccgccagccatgacccggaagctccagaacaaggttttaaccggcacataatagtccctgtctttgccatatttagcttgaagctccttattagctgtctccatgcctttgactgcgccgttcattttatgatacgacagcaaacttaatagatatggcacttcaatattgccactggtcgtatgatctttagtattgattaattcgacaagcgtccatggtgctggatcactggtatctttataaattccttcagttgccgcaaacttcatcggctgatctttaatgatgaattgtgtctgcaaatcaccaaaaccgattgcgcatgcagaagcgatggtgccaacaatcaagccaactctaagagacttcttgtaaaagtcaacttgatcttttttaagcaaacgccatgcggccatgccagctacagcaaagccagccgtcgtaaaggcaccaaaaataacatgcggaaattcaacccacagttgcggattcgtgatcacggccccaaagtcgactagtttaacccgacccgttgcttgattaatcgcaaaaccggttggatgctgcatgaaggcattcgccgacagaatccaaatggctgacagcgtggtgcctagccatgtcatccaaataaagatagcgtgaacagccggtttgaaacgatcccacgtgaacatccacaaaccaatgaaagtcgattccatgaagaatgccagtaacgcttcaatcgccagtggcaccccaaagatgtcacccatgaaccgtgaataattagaccagttcatgccaaactgaaattcttgaataatacctgtaacgaccccaaccgcaaagctgagtaagaagatcttgccccagaacttggccatcttcttatatgtttcattctttttgcgcacatacatcgtttccataatggcggtaacaagccccataccaattgaaaacggcacaaagaagaaatggaaaacggtcgtcatcgcgaactgaaaacgagctagcgataatacgtccattgccaatagcatatgtttttcctcccttactagattgattccaatctaagtatacccctgagttttattttttaaaaaccaaaaacccaaaaaatagcattgaaataatgcttttcagcatcaacatcaagtcaaaactgttatgatatgcagctgtatgcttaattgacggcgtttcggccaccaaacaaatattagctaaaaccattttgaaaacacctttgaaaacgatggaagaatgaaaacgtatttaggggcgaatcacttcttgaatcaacggcgtttttttcggcgctttatcgccaatatgataagcgcttctgaccatgttgctgatagcgtcaacgttctcggtgtcggcatgcagcgtaaccaacgtatcgcctttggtcacaggtgtccccagttttttatgcaggacaagccctactgccaagtctaaaatatcatcttttttcgctcgaccgccaccaagttgcatcgctgccaaaccgagagcatttgtgtcaatttggtcaacaatgccagattcggcagctttcacagcaattcgatacttagcttgtggcagtttgcgtggatcatccactactgaagcatccccgccttgtgctgtgatcaattgcttgaaggcattcaacgcacgcccgtcacgcagcgcatcttcggctaagccgctggcaatctctagacttgccgccttgccgccaagcaccagcatctgtgctgccaacgcaacggtaagatcatggacatctttcggaccacgatttttaagaatggcaatagattccgcaatttccagactattaccaatcgtaatgcccagcggttggctcatgtctgtcaacaaagccacacttttaaccccagcggttttgctgatacccaccaaggctttggccaacgcccgcgcatcttcggtggtcttcataaatgcgccattgccgacttttacatcaaagaccaaggcattcgtaccactggctaactttttactcatgatcgaccccgcaatcaacggaatcgattcaaccgtacctgtgacatcgcgcaaagcgtaaatccgtcgatctgctggcgcaacctcgccgctcgcactgataatggcttcattgatttgctgtacctgctgcttgaattgggtttcgctttccgcaacattgaagccaggaatgctctcaagtttgtccaatgtaccgcccgtgtgaccaagaccgcgtccggaaatcatcggcaccggcacacctagacacgcaaccagcggcgccaacggaatactaattttgtcaccgacaccgccagtactgtgtttatcgactttaatacccggaatatcgctcaaatcaagtacgtcaccagaatgcagcattgcaaaagcaaaatggctgcgttcctctggcgtcataccattaaaataaaccgccatcagaaaagcactcatctgataatccggaattgcttttgccgtatactgttcaatcatccaagtgagctcttcattggttaaagctttgtgatcacgttttttcgtgattaaatcgaccatgcgcatctctcatcacccttttcccagttattcattccattgtaccgcgtcacgcgccgcctatgttaaactctaaacaatcagagcgtgaactggcgcgtttagaaaccgaagcataagtggcctcaagcctaaatagctgggctttggctatttaggcttgaggtccttatgtgcaggtttctgcgccagtgaacgcgtttaaaaagacgcgaaccaatcacccctcggtcatgccgaccactctttattgcctgcgaacttgtttaggaggaaaacttgatggactttcaaacattacatcaactaagcaaaaccgaactacattgtcatttagacggctcattgtcgttaagttgcattcgtcagctcgcgaaaatgatcgaccgaaaattaccggcgactgacgacgaactgcggcgactggttcaggcaccagcagattccgagaatttaggtgattatctcaaagccttcgacttcgtggcccccttgctgcaaaccaaaaaggccttgcaactcgcggcctacgatgtcgttgaacaagcggctgaagaaaacgtccgctatatcgaaattcgcttcgcgcccgtattttccctagcaggcggattatcgctggtcgaagcaacgcaagccgtcatcgaagtcttgcaccaaggcatggcaacatatgacatcatggcgaaggccttagtctgtggcatgcgacagttgcccaacaccgataaccaaacaatgtttaaaaccaccgccccgatacttggttcaacactcgtcggcggtgactttgccggcaacgaggctgattttccaacgaacgtgtgcgcgccggccattaaaactgctcaatcccttggcgtgccgcttacgtttcatgccggcgaatgtcattgcccgcaaaacattgctgaagcggtacgactcggcattccgcggattggccatgccaccgcttgttttgatcaaccggcactcattgagaaaattgttgaaactggcaccacagttgaactttgcctcacgagcaacctccaaacgaaagccgctcgtacactcgctgagtttccgtatcaggcgcttaaaaaagctggtgccaaaatcaccattaacactgataatcgaacagtctcgaataccacgttaacccaggaatatcagcgttatcagcaagcttttggtacaacagcagctgactttttagcattcaatttaaacgccattgatgcagctttcattcctgatgccgataagaaatcattacgcgaccggttacatcaagattacgcaacttattgttaactttccccaattaaaagacaagccatgatcacgactattgcttgtcttttttaatgcagttaaccaaggccttgctgatcaggcgcttaatcattgcttaatgaaagcgccacaacttcgtcacgaataaagcccaaattcaccgcacattcatcccgccaacgccacagccccttgttatgctggttttatcaacaaacgaaagaaggatgatgcatatgttgattaatcaaaccgatgtcatcgcaacccaattacaacaaattgcttacccatatattaacgccattactgaaaccggcgtcccgatcacaattacaaccaatcaaaaacagcgcgatgaccccgccttttggcagagcatcagcgctatcctgaaagctcgtttatgggtacccgtttcaaagaagtaccatgaattaaccgaccatgactggctggcgacaccagaaatgccctaactaagcttgataacttgaaaaggccgtcgcagcaagcaccaaggtcaacacagcatctggtgaaagtgccgcactgactgtctcaatatggccgctggttgcgactgcgccaatcacttcaagcccgtacttaacaatattcaagtcacgctgcggggtatacccaccgtcaaaaacgggttcatgattgtatgtaaaattcaactgatcatttttgattgagccatccacatggttgaccatgatacggtcatgggtggcggtcaatggcgcattgtcatctggcaagtttaacttgtgatcagattcagttgtataataatcggcctgcttcatatgcaagtatttctcagctggcttcttgagcaccttcaaataatccacaattgcgtatactttgttggggtcaagctgggttttcttggccatcaggtcatcattatgcgcctcaagccagtctgctaaattactgatactaaattgatccatgttgtgcctccatattcgttgctaattcttacgccagtatagcatggacttcaagtctggcgaagcgggattgtcataaacttgttacacatactgttatataatagtagtgggagatgaggatgatgctgagcaatcgtgagccatatccaattatcgattatttaggccgacctatcaagctgtcactgtttgtgacctatcgattacgcattaaaaacggctatatccttgcactgcgccgaaatcaacatcagcaagtgatcccaaacctcatggccaagaatgcgagctgattcggttgctgcaacagccactgatgaacggttactaattcgctaggatggtgtgtatcaatgcaccatccttttttgatggcgccagatgcggcctgatcgctcagtccggggagcgatcttccagcttcggtccatgcggcgtcgccattgccatcatggcgactgtcaaaataataataacgccacccaagatttccgcaaaccccatatgcatgtgtaagaaaacgactgaaacaaccgttgcacccaacggctcaaaggcgtctagcaacgtggctgccgtcggagaaatgaactgcaagctcgcaaggtaaaccgaataagcaatgatggtgccaaaaatcacaatgaaccagtaaccagtccaacctgcgtgatctaaatgcggtatttccttccaaaaaggatcaaatacatcaatcaacaaaccaccaatcaattgcgcccatgccgtgacgacaatcggcgagtggcggcgcaacaagcctgcaggcaataaggtatacgccgctgccgccaatgctgctatgataccccagaaaaaagcattcggcgaaatggccagatgagtaaaatgccccttggtaacaaccaaagccgtccccatcatggcaaagcaaatcgtcacaatatcaattcggcgcggcttttcgcgcaaacgcagcgctaagaatatcaacacaaccaccggtgacagatattgcaaaatcgtggcagttgcagcattggctactgcaactgccttaaagtaaatatactgcatcccgatcatgccaaacagaataaatagaattagctgcaaggcatcacgagtattccgccaaggtgctagaatcgctttacgctctttccaaaaagccacgagcatcaaaacaattccggcgataatcatcttcgaactaatcagccatgaaactttaatgccttgatcaaataaggcctcgctaattgggccagagattccccaaaagcttgaccctaaaattgctagaaagattccccacagtcggacgcgcttcaccagtcttgctccctcttgggccgattcggatcagtcctgcatcacaacatgatcatcaattaatccggcgccttgcaaataattatacacgattaccggccctacgaacgcaaagccgttatttttcaaatccttggcgattttgaccgataaggcacttttggtcggaatttccgcacgcgacttaggtcgattgaccaacggcttgccgttcacaaaatgccataaatagtgatcaaggctgccatactttgcctgaatttttaacacagctctggcattggtaattgttgcctcaagtttcttacgattgcgaatgatatcttgccgctgcaataactgctcgacgtcttcttcatccatagcagctacttgtttaatcgaaaaattatgaaaagcatcgttaaaagcagcgcgcttgccaatgactagttcccaattcaacccagcttggaaaatctcaagggataacaactcaaataacttttgatcatcatgaaccggcacgccccattcatgatcgtggtacgcgcgcatagctggtgacattttggcaacccaatccgtataacgcttacgttcctgataccgctgcaatgctgcttctgtcttggcttcttcagcgtgatcatttggttttaccattgtccagcacctccatagacttgcataggcttctcttttacggatacattacgccgcgctggcagggattgccagtgaagatgcttgcaaggcaagatcatgcgttcacctgtgcaacgctggacaggattgcattcattttaacgcgttcgcagccacagatgcctacatataagggccttgaaccgaactggccacttacactctgttttctagccgctcctgttcgcgcttaacaaaaaaaccgataacaagttttgtcatcggctcacaaacaatcacttacctatttagttttaacgatcaggacatcgcaaggtgccgtgcggttgacatattccgtgacagatccgacaaggacgcgttctacagcgttcaagccagttgcaccgatcacaatgagatcattgtgatggtcgtgcggaaaatcagttgcaattaccgtcttgggattgccaaaccgaatgtgaatatcaagatcatccagacctgcacttttggcttgatctttcaaattatctaagtattcctgtgcatcttgcgtcaactgataaaccgcatcgccggaaatcatgccgccgtaactgccaataaactgtttggtatcaagcacattcaaaacatccaagtgggctcggttggccagtgcaaccttaatggccttgttaaaagctaattctgcttccttcgagccatccaccggtacgagcaagcgatcatattcttgatccattccgctcacatccttactttctgattaacttaagcatagaacgccgaggaaacgaatacaagaaataaatttgaacacttaacatacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccggtgtctttttgcgttatccaaaaagggcctacacgttcagtgttgattatttctcaacaccagaaagtgtagaccccaaaaaactcgcagccagacactgcgagtttttttgtttagtcattcattaagtacccgtgaaaatttaagttcacagaatgccagcgttcttttgaagactgtgccaatcaagagaataccgatgatcggtccgatcatgattttgccgccaagcaacatgccactcaaaaaacagacaagatccatccccatacgtgtcttagcaacatcaatggcacatttttccgctagggccaagcttaaagcaatatacccttctttaccggtactggctgctgcggcgatgccggagccgatggcgattaaggcaacccccaagactagcatgctgacacgtatgcccatatggctatcgactaaaagatagcgaataacaagatcggtgacaagactggtaacgattggattgataatcgttcctaatcctaagtggcgacgattgatcccagccaccaaaccgatgcatgcgacggttaccacgagtgaggcttgaccgactgtaatggctaatctggttgcgatgccttcccaaagaacgcctaacgcatccgcgccaagtccagtcgtgacacacgtgcccacaccaagaccgacgatggcggcaccaatggcagcaatgatttgtcgtttgattgctgtcatcaactgagatcagtaccattttaggcgattacttttttgtaccagttgaaggaatctttcttaatgcgctggcatgtcttaggatcgtcatcggttcgatcaacataaatcaagccgtaacgtttgttgtagccattgcttgtagaaagtaaatctaaagccgaccatggcatgtagcctaaaacctgcacaccgagacccatggcgcgttgcgtggcggcaatatgctcgcgtaagtaagcaatccgatagtcatcatgcactttgccatcacttgtgagctcatcgcgtgcacctagcccgttttcggtaatcatgaacgggatgcggtagcgagtataaagatcgcgatagacaatctccaacccaatgggatcaatggcccagtcccaatcagttgtccgcagttcgggattaggacacatttggtaaaaaccaggatgcgtttcaaatcctgacatgtcaccttttttgccagttaagttataccctgaccaagcatgatcagcaccttcaggacaagcgtgagcgcactgactgtcataatagttgacagcaagaaaatcggagatattttgtgaaaagagggtttcatcgtcgtcaaagatttcgggtgccaactgatgttgcttcaaataattgaaggcagcatcggtgtaataacctttaaaatacacgtcaagataatagaaatttcggaggtcgttggcattcaaggccgccagctgatcctcaggcttgcaggtgcgagcgtaaactggcgcgtagcctaatgctgggcctgccaaaccaccgacctcgtggatatatttcacggctaatgcctgggcgaggttcatatgatgattgatctgataacgcaattggttttgattttgatacttttcgggtacataacacttctgggtccaatattggacgatgatgctctgttcattgattgtgatccagtacttcacatcatttttgaactcattgaccacaaacttggcaaaatagccaaagtcttcgacaacctcgcgagataaccagccttcatatttttcaaccaaagcccaaggcaggtcgtaatgatacaaagtagggatgggctcgatatcgtttgctttgagttcagcaatcaaatcgcgataaaattgtaaaccttcttcgttaacctgatgatcgccttttggaaaaatccgcgaccaagcaattgaaaaacgatagctagtaaaacccatttctttaaataagcggatatcttctttgaagtggtgatagtggtcactagcgatgcttgtatcggcaaagccaaacttttcagatcggttattgttaataaaatcttgttgcgaaaggcccttgccgtgggtgatcgcggcaccttcgacttggtaggcacttgttgaagcaccccaaaggaaattctctggaaaacgctgtttcatgtggtcacactcctttaatcagatagatgatggctggttcgacgaaacggcatcggtcaacacaacttcaaaaagttcaatcatgttctcggtcatactgatctcactggcaatggtcataagatgatcttgcgcgtgagtaaatagcagcgatggctcatagtgccgtcctgcggcttcgttttgaatgatttctgtttgtgcttgatgggcaagcgttatttctttctttgcagaagccagcgcttggtaagctgctgctaattgcttgttcttggcaagctgaaccgcttcgagtgctttgttgcgaccgttgcctgcataaatgataatttgcatggcaacgggaatgagaggactctcgttggtgtctttttgcgtcatcacttttctccttgtcatagtccgatatgcgaatgattaaactgccggttgtaactgattttcttcttggaggacttcccgttcgtaaactttgaaaaatggataccatgttgctagataaacgacaaaaagcagtacgtaccagatgatggcgcgaaaatcttgcaaaataataacactggaaattggtgcgggaatctgcgcaacttgcatcaaactagccggaatattcagcaagccgcctcgcatgaccgcccaaatgacacaactgccgataattgaattgagccacattgggatcatcagtataggattcatgacaacgggggtactgaagacaattggctcgttaatattgaatagcgatgggccaaggcagattctgccgatggttttcaatttggcgcttcttgagaaacacatcaggagattcaaggttaaagttgcaccagtcccacccatcatgatgagcccaaggctataaacggtttcgttggtgacaatgttgacggcgttgcaaccatttttaaccgccaaagcgtttgccgcgatgcctgcaatgaagatagggttctgcaaagctgtccataaccaagttgagatacccatagagtagaaaaaggcaggaatcaaaaccaacagaatcaagccgggaagtgattggccaaaattttgaattggctcaaaaagattcaaaatcacttggaagacgtcaatcttgaaggcgaagattaaggtcgcaaacaaggctagactgataaaaatggggatgatgttgttaatccaattagccacgaaatctggcaacgagctattttttagaaaattcagcttgctgtagaagtggaagatgacgccaatggcaacgccgaatagaacgccaatcaggatgcctgtcgggccaaccctacctaaatcgtagacaccttgtttctcgccgattggatgaagtgtcatcatcaaaacgcagattgacacgattcctgctgtggtggcgtattgtagatgtcgaaacttttccatgaattgatgaccaaccatgaaagccgcaaccaaaccaatcatgccgaacgaataattggagatattcgttaagtcaggcaactgcggaatataggaacgaaaaacgttgtagaagaagaccactgatccagttaaaataaaaggaatgagattctgcatcgcactttaaagtgcagcgatagcaggcatttgggtgaactttttggctttaggggcaaaaacgttagccaaccaatccatgaatattttcattattttcctcccggcagctttctttactctgccagccgatttgcaaaagcaatgaggccagcgccatcgagactgccgtagatgtcttgcggaatgacgtcgacgacaacattgaaaggttcggcctgtttcgcgagttcatcttttaacgaggcgtaatgcgggcctagtaataaaatgtcgatatcttgaaaatactgaccaatttcactttcactttttgcttcaatggagacagcctgccctttcttttgtgttgccttgcgagcacgctgagcaagaaatccgcttgacatgccagcgccgcagcataacatgatattaaccgctttcattttgaacactcctttcttgtgactttattatcgcgaatgaggagaaatcggctcaactaaaaaaatgcaccgtgacagtgcaaatggttgacgaattgttagcggttgcgtgcaagcaataggcttttttgaattttgggagaaccggttataaaaagaccggaagggagcaagatgctaaataacaaccagcaacggctattgcaactgttattcgaatccaatcaaccactgacggctaatcagttatcagagaagctcggttgttcagtgcgaactgccaaaacttatgttgcgcagattaatcgattagccgcggagccactgattctatcgtcacgacaaggttacgtggctttaaaaactgaggctaaacaattactaatttcaacaaacaatgcaagtgatatcccacaaacctttcgtgatcgtgctttttacatcatcaaacaaagcatgattcataaggcgcaattggatgtctttgacttggaggaaagcttatttgttagctatggaactttaaaaaatgatattcaaaagatcaatcagatgttttcgaaatctggcgttagggtagtcattcgcgataataaaattcaggttaccggaaatgaaaaagccaaacgccgactgatttcgcatttcattatggaggaagcacctcatcatttcgttgctcgatccttgctcacacaaaactttaatcgtaccgatgttgaacagatcgagcaaattatcaaagaagaattagcgccatcaacattaaaactcaatgattatgcattgataaatctcatgatgcatttattgattatgattcaatccttacatcacgacgatacattgctatcccgtgatgcctatagttcatggctaaacacgtatgatgcggctattgtcacgaaaattattaaacgtattgagaacgtttttaaccttattttaaataaacatgagcgtgaagagatccacatgttgtttcatgctaatgttgaccatttaccgctaagtgatcgtgacaagttaaccacaactgttggtgacaacattgtgcgagcgatgagctcattatttgcagaagtccaacacatatttgggattgatctagataacgattatttcgtttttccgttcagcttgcatctcaacaaattattttctcgcgccatgcagggatccagtctgaacagtccgctaaccgaatctttaaagcaggattttccggtagtttttgagctggcagtttttgtttcttttcggcttagtcaattgttgcacattccaatcacggaaggcgaacgagcatatattgcactgcatattggtgctgaattagatcgccaaaagcaacactctgaaaaaatcagaacagctattttttcaccgaactatatgaatttgaacacgcaactgtatcagcatgtttctaagcaatttgagcatgatttgaatgttgttgccttggtgaatgacccttctgagcttgataagctcgatgtttcgctgcttatcacgacagtacctcaggcttcatcgatggcttatcgagtcgtgacaatttcgcctttcatgacgagtaaagagaaaagcaccatcatggcgacaattgaggaacatcgtcgtaacgtacaaagggattttttaagacgctattttgatatctacttcggtgagcaattcttctttacattgcagccaatcatgcaacgggatcaagttgtgaccttgatgtgtgatcaactggagcaccgccatattgtgtctccaagttttcgacagcatgtttttgaacgtgaagaagcggctggtactgcttttgggacggtcgctctgccacattctgtgtacatggaagcaaggcagacaacttttagtgtcggcatagcgaaaaactcaattcgttggggagagcgacgtgtcaatattgtcgttcttgcagctattagtcaaaatgatcaacagcgctttatgcgtttgtatgaagccttaatcacgatgttcagtgaaccgcaagtggcgactgcgcttgcacgcgttaggaattttgaacaatttaaaaatgtcgtcaaaacaaacatgtgaggtggcttattgccctagtttttataacatgatgtgtcagcatactgggcctaaattaaaaagtggttgaccacattagcaacaagctaatgtggtcaaccactttttaattttagcgctaagaatcacatttcggccacagaacaatgctccgtacttaaatctcgaattctgcgtttaagggtagccgtgctaataccggtttctttggaaatttgttgatacgtcttaccgtgcatatgtgcatcgaaagctttcctaatttgttggtcactataaagctttttgcgaccttcatggtaattgggattatgtgctcgagcgtattttttcccttcttgtgtccgactaataatcaggtctcgttcaaattgggcgaaagccgagaaaacggtgaatatcagtttgccggtcggtgtctcgtcaatgagaccaacattcaggatgtgtatcccaacatgatgatcaaacaatgtctgcatgacatccaatgcttcacgcgtattccgcgcaaagcgatctaactttgtcacgaccaagatatcaccaaactgcaacttagataataactgtttaaaaaccggccgacccgtggtcgtgccggtgtatttttcctgataaatttcatcgacacctgctctacgcagttcttctatttgtgactcaagacgctggccttcagtgctgacgcgtgcatagccatatctcatcaaaacactcctatcatcaaggccgaattgtatcacaccttgaaagattagagccgaaagcaagaactcccaaaattatagcataaaaatgttttatggaaacaattagaattaaataactatcggtatttatcgttgaggctgtttcttatttgttattaagtggacaaaaagactggctcttaagtgtcgagttgtaagcgcaagaacaattgcaatgtcagtggctaaaagttcacctgagaggagggtaaaaatgtgacgaagatgacagctaaagtggcgagaactgggcatttgttcgcggtcttattgattttgatgagtatgttaacaggcttagtgacaagtggcagttcagttgtgacagccactgctaacattcgcccaacctatcaaaccgatgctaatggtacctatccgacaaattcgtggcaggtcacgggacaacaaaatgtaatcaatcaacgtggcggggatcaagtttcagggtgggataacaatacaatatggaatggtgatgcgactgataccacgaattcttacctgaaatttggtgaccccaataatccggattatcagattcgaaaatatgctaaagagacgaatacccccggattgtacgacgtttatttgaacgtcaaaggcaatacccagcaaaatgtgaagcctgtagatattgtcttagttgttgatatgtctgggtcaatggagtcaaaaaataatggcggcacagatcgtgctggtgccgttcgtactggcgttaagaatttcttgacttctattcaaaacgccggtctgggtgattacgtcaatgttggcttaattggtttttctagtcccggctatatcggtggcggcaataaaaccactggaccgggttatattcgcgttggattaggcaaagcaggaaataccagtcagcaacaagcgattaatagcgcattgagcccaacttttaatggtggtacgtatacgcagattggtttgcggcaaggatcagccatgctgaatgcggacaccagtggcaataaaaagatgatgattttgttaacagatggtgtgccgactttttctgataaggtaaaaaattcagtggtggaaaacggcacattgtatggcactaactttggaactaccagagatgaacccggctataccgcagaacttaaaaatccgtacatcgatagttcaggtgattatatatatgatacttggccagcaacattaggtgaggctaagaaggcaaaagatagcggtaatgaggtgcacgctttaggcattcaactggctggcgacgacggctactggtcggaaggctacatgtcagacgaagatgtgcgtcaaaatatggaacttattcccacttcaccagatctatacgaagatgccgatagtgccgatgccgttgaggcttatttgaataatcaggcaaaggacattgtcaaaaactttaatactatcattgacggcacgatcacagacccgattggtacgcaatttcaatatgcgaacaaccaggcgaccgttacgagtgtcggcaagcaaactgtgccagcaagtgagttaccaagtgcgacgatccaagatggtcaattgacggtgaatcacatgaacttgggtcaggatcagaaagttcaaatccattatcaagtacggatcaaaacagaggatgctggcttcaagcctgatttttggtaccaaatgaatggtgaaacattgttgacaccaaaagcgggcgctgccgctgttgactttgggattccttcaggcagggcaccagcaactacagtttatgtgcagaagcaatggcgccagttaagcaatcaatcgttaccggatacgctcaacgtcacggtgcagcgaaaagtggctgacggttcgcttgatccaaattggcaacagaccttagtccttaaaaaagctgataactggaaagctagctttacggcacctgcgtataacaatcagggtcaaagtttttcatatgtcgttaagagtgaagatgcctcgggaattgatttgagttcgtttatcagttctcaaaatatggatcagcaaacagcaacgttgactttgacaaatcagcagtatggttttcaatttcagaaaaaaacaaccgatggtactgatttatcagcagatcagttgaaggccatgcagtttaacttaacccagtacagcgataacagttttcagcaggcatccaaaaccaacgccatcacgtcaacggatctgcaggcactagcgccggggtattacggtattcaggaagctgcagcacctacaggttatcaacttgatgggacaacgtatctttttcagctaacgtctgatgggcaatggcaataccatggcacaaaggacaatgtgacatcagggagtgttattaatggccagcagactttgaatcctgttggtgataagtcagatgattatacggtgaccggggatcaccagcaaattctgacgctgacgaaatatgatgaaccaaagccatccatgactttgcgggtcatcaaacaggataatcaaagccaatatcttgcaggtgcagcgttcaccctgcaaccaagtgctggcgaagctgagacgataacatcatcggcgacatctgagggacaagcgtttgcgacaaaattaattgcagatggtacctatacgatgtcagaaacaaaagcaccagatggctatcaaagcaatcctgcaaagattgccattcaggtagctacgactggtaaagaggcaaccgtcacgattgacggtgaggcattgaagccgggcgaaagtaagaacggatacacattagcgattgatagcagcacgatcactttgcaggcgattaatcagccacttgcaattttgccgcatacaggtggtcagggctatcagcgattgcttggtatcgcactgggattgatcagcgcagcgttccttttattactggttgttttgataaagcgacgggtggtgaagcaacatgactaaatccttccgtccgttagtgattttgaccttttgcttggcactactagtcagtttggcaacgacaacgttgcagcagacacaggcggcaactgtgccgaccactgttgatgttgtgttgcataagctgttgtttaaagataccttgccaactcaacaagcaaataacgggacaacaaaacccgacttttcgcaggcagatgtgccgttaaacggtgtgacgttcacagtttatgacgtgaccgctgacttttggcagcttgtctccaaaaatggcggtgcgattgaagcagcacaaacgacgttgagtcaagatagctatcagcctgcgagctccagccttatcgcacaggttgtgacggctggtcagggagaagcgtactttggcgatttaccactccgacaggggcagcatgctgcggtttatctttttaaagaaacggcggcacctaagaatattgaagccagtcagaatcttgtggttgtcatgtcaagcaaccttcaacatgggaatcaatcacgcattgatttatttcctaagaacaaaatggtaagtcgtcacaccgacgccccaaaaaaagttccaaagaaaacacgtcaattgttgccacaaacgggtgatacagttgcagcttggctttcaacgctcgggttgataattttcgcgacagtacttgcttttaacatgaaaaaacaaaaaattgataattagggagaaaagaatgaaaaagacaattgccaagaaagtgctgacattaaccagcacgatcctaatgacattactgatggttctcgggtttaatggcactcgggttcaagcagatacgaatgatacgacaacacaaaacgttgtccttactaaatacggatttgaaaaagatgttactgccattgatcgtgcgactgatcaaatttggactggcgatggtgctaagcctttacaaggcgttgatttcaccatttacaacgtgacagccaattattgggcatcgcctaaggattataaaggcagttttgatagtgcttcggttgccgcaaccggtacgactaatgacgaggggcaactaacccaagcattgccaacccaatcaacagatgccagcggtaagactcgtgctgctgtctatcttttccatgaaaccaatccgcgagctggttataacacgtctgccgatttctggttaaccttaccagccaaggcagcagccgacgggaatgtctatgtctacccaaagaatgttcaaaagaccacctatgagcgcacttttgttaagaaagatgctgagactaaagaagtgcttgaaggagccggctttaagattagcaatagtgatggcaagtttttgaagttgacagataaagatggtcaaagcgtcagcatcggcgaaggatttatcgatgtattggccaataactatcgattgacgtgggttgctgaaagcgatgctactgttttcacgtctgataagagcggtaagtttggcttaaatggatttgctgataacaccacaacttacacggcagttgaaacaaacgtgccggatggttatgatgctgctgccaatacagactttaaagctgataattcgtctagcgacattctagatgcaccaagcggtattctgccacacactggtggtactggcacagtcatttttgcgattttgggcgttgccttaattgcatttggagcagttgcctatcgcaagcgccgcaatggtttctaaaaagttaataagataaatgagtcaagcaagagcgtcgatggcgctcttgttttgatatggcgaggtaatcagagtgacaaaacgaacacgtcgacctttaggcttgattgatattgtgattggatgccttcttttagcgggttttggtgttttatgctatccatttgcaagtgatgcttacgtttcttaccaaaatcagcaagtcatcgacaggtatcgacaacaagaagcgcggaagaatcagatggtgttgcggcgggaatataacgactatcagcaaaaaaataaacagttggcagcaagtcagcaagtgcccggcgttgccagttttaatcatgccgttaatgatcaaggaaccgcaaaaacagcggccaaacgcaatcagcaaatcttgactcgtcagacagttgctcagttgacgattcccaaaattggccttagtctgccggtttttgatcatacaagcgattggcttctacaatttggcgcctgtttattggatggtacaagttatccaactggtggtaaaaatacccatgctgtcatttcagcgcatcgtggtgtgccaaacgctgaactttttacccgagtaccagcgttaaaaaaaggcgacaagttttttattagcataggcaatcataaattggcttaccaagtctttaagcgccaggttattgagccaagtgatacccggcagctaagaattgtgccgggacaggatcttgtgaccttaatgacctgcacgccttatatgattaattctcatcgattgttgataacgggtcgccgaattccttacgttaaggcagatgacgaggcctcaagttgggcggtttggtggaacaaattaaagctaatagtcgcacttttaggcgcggtgatcattttaggcgtgatcggtttcgtaatgcgcagtttgatgcttggcggaaagcattatttgctggaagtaccggctgaagccacacaggtcgtggtgaaacgaggtcgacatatacattcttttaaatcagatcaaactggggtgactgacatcagcctgcctggtaatcattatcgagtcgcaattgtcacgccgcttggccggactaagtacaaggcttatgtcaaaaaaattcaggataaaaaattcacacttaaacgatcttgagcgtacctgtgtcattagatgactcagcaactggtctatttttggtatggtgggctttgacggtgagagcattcgctacagcaacttgtgaatgatttggtatactaaagaaaactttagtgatgccagatagcagcatatgaacgagatcgggttctgatatggggaacgcgttaagggggcgaacgctatgaaacaacttgagatcgcgcatttggacaaagcttttgatcagcaagttttgtttaaagatgccagtttcatgtttaatcaaggtaaaatatatggcttgttaggccgtaacggctccggaaagtcgactttatttaatatgattgtccgcaacttgccacatgatcacgggacgattgcggttgatgccgatgatggtcgtgggttaattactgactacgcagatacaagtgtggggatggtatacacgcaaccgcacttaccggtgtttatgacggggcttgaatttgttaactactttatgagcattaaccgaacgcgtcttgaacaagcacattcgtctgtgcaggcgaccgattttttcgaaatggctgggttgagtcaggctgatgcgaataagcttttacgcgactattctgagggaatgcggaacaagttgcagattgtggtatcgctcatgctaagaccgccagtactgttgttagatgaaccattgacaacagttgacgtggtggcggcccatgagatgcaacagttgattgtggcgatgaaggcggaatctgtggtcatcttttcaacccacattatgcagttagcccaagctatttgtgacgctgtggtgctgttgcataaccaacagttgacagagctttcaggcttggacaggcgtttgaggatgccgtgatcgcccggctcagtgacgaggtgcgggccgatggctgaagcgtggcgttactactggtttcaagcgcaagttgatgcaacgactatggtgaatgggctgatttattttatccggcggctcccaatattaggtaaaaagataccgactaagttatatcgtatgggtgccgtaaaaagtttgattgcgattatcatgagctgcttaatgttcatgatgaagccactgatcgcaatgcttttactagcgatggatttcttagtagccaatgcctacaacgattttatccatccgttaccgacaacgttcacatttcgtacgatggtggcagtgacgatctatacgctgggtggcctactgtttcggggactggtctttcgttatattccagttgatttaaaagcaattaaattagccgactattttgtgctcgatcggcttgcgttggctcgtgggctgacgcgcatacagcaagtgattggcatcgtccttggaccattcttaccgttttttggactaacgatgatcacccaaaattattggattttattcgttggtttgggcgtatccgtttttagttggttctggcgcgggtttatcccacgcttgacttggtcgaaccaccggctggggatgatcgcacaaattctgtattggtgcgggttagtgggcgtgccaatcgcgctcgtgttgagcggcaagcttacaccattcgtgactgggttgttttcgccaataggcttgatcatttgctggattggggttttcgggttgtggtggtatcagcaccgcttctcgaatgatatcccactgttaatggcatcgattcaacagtctgtcataactttgaacaaggtggcggcaacacagaagcaacaatttttggcaactggtaccgcgatgcagaaaaaattgacccttgatacgacggtttcggtcaaagtgaaccagcgacttggcaataactatctcaacgcattgctatttgcacgctaccgcagtcagttatggaaaaaattgcgtacccgcgtgttatggattagcggcattggcatcagcggcttgattcttttaaaattattcgcgattcactccgtaggggatttgaccccaatttacggcgccttgtttttcgtgatgtatctggcctcgctgggtggcccgattgttcagctactattcgttaactgtgattcggcaatgctcttttacccattttatcgacagcctaaagccgttttaagcgggtttttctatcgattttggcggatcgttcagtacaacgccgtgacaggtgcgttaatctatggcctgttacttgcccttcaattggtgacaccagtgccggatcacttgaatttctatttggttttattgttagaagtttgcgggatggtgttgttcttttcctttcatgatttgtttatctattacctgctacagccgtttacggaagatatggaagtcgtgtcgccgttatatcgtattttatattgggcgatgtattgggttgcgtgggtgttcactcaggtccatctttccggctacacttatgcgcttgccattggggtgatcacatgcatctatgtggtggcggacaccatcgtgatttatcgcgtggcgcctaaaacattccgtattcgctattaaacatcgctgttagattgatgctatcatcaatgtcaatctgagttgatgtgacaaagctaagcgggtactttcaatgccgatgagtcgagaaaaactgatttatcggtatttttgtgtgggtttttggccagtttgcacgggctacttttgatgagcctgacgccgacagctgtttgaacgtgttgcaggcgattccgccagcgggtacagtaggcataacgaaggaaaatattctttgaaaagaatgctaattagtttccatgaataaattgttgtcaacagggaggcaaagctgatgctaagtgatgaaaggcttcgcgggacagtgcttgcagtagatgatgatatcgatattctaaggatgttgaatcgttattttgctgcccgccttccgacgtttaacctaatcacggccgagtcaggcgccggtgcggtgcaacggctgaccaataatcctgatttgattttgcttgatgtcaacctacctgatactgacggcttttcgttggcggaacgaattcgggcgataacatcggtaccaattatttttctgaccgcacgggtgactgatgaggataaagttcgtggactcggtgcaggcggcgacgattatgtgacgaaaccgttcagtcttgctgaacttggtgctcgcattaaggcccactttagacgggaaagccaaccgcaaaaacgtgcacggatggcgatttttgatcagattctcatcgactaccgcgctaaacaagtgtcaattggcgatcaagttttaagtcttgaaaagaagcaatatcaactagttgagctgttaagcctgaatccggggcaagtctttagtcgtgaacagctttatgaaaaaatatggggttatgacgctcttggagatgatcgagtcattacggaacatatccgccgcattcgacttctttttgatcgatatcaagtaacctcaccaatcgaaaccgtttggggagtgggctataaatggacaagttaaagcagcgcctaacgcgtttgccaataaaaaaagctttgctgcatctgattctgatcggcacaattgccgctgcattggtggtgttggtctacttgctgatttggcatgtggtgatgatgccaattgcaactgccttggccaagcgctggttcattggcgggatgagcttatactttggtggggcaattattggtagttttgccatgctatacgcagtcatgaatgtcacagccagacttttttatcgtgtgaaattggggccgccgttggatcaactacaatatggtgttactcatatccaggcgcaggatctggacttcacgctacagccgacatctgatgatgaactcggtcaattagtagccgcgtttgaggaaatgcgccaagcattacgcaaggcgctcgaaaccgcatggcaattggctgatgatcaaaaacaagtcaacgccgcgtttgctcatgatctgcggacgccgctaactgtcttgcagggaaatctggaattgttaacgttcaatgaagaaggccagccaccagatcaacatttactagacgagatgcagcgacagcttgatcggatgaacaactttatcaaaacgatgagtcatgtgacctctattcaaaatattcggttgaatcatcatgcaatcacagaagcacaggttgaacaacagcttcgttcagaagtggataaattaccaacagctaagacgattggctggcaagttgatagcacacgattgacagacaacaagttatcggtttcgccagacgctatccttgaggtgtttgataaccagatcaataatgccctccggtttgctaagacaaaggtggggattcatctcaccttcaatgaccagcaaatcaccttgcaggtttgcaacgatggccggccattaacggcaactgagcaacgcaaggtcaaattgccttatttttcaaatgataaagcagcgcatcaccttggcgtgggcatgtatatctgcaatcaactatgtgcagcacatcgcggttactttaaaattcaaaaccgtgaacatgcggcgggtgtttgttcgacagcggttttcggctattttgacggcagcgccgaaagctaatgttaccaacgatgtcagaaaaatgctgaaaaaaagtattgttgtcaaaatcttgtgaattgcttgttaaggtctccttgtaagctaaaggaggcttttttcatggaaaagattaacatcgaagggctcaccaaacgctatcgcggcaaggcggcgccggcgcttgatcaagtatcgctagaaattgagacggggatgtacgggctgttaggcaaaaatggtgctggtaaatcaaccttgatgaaaattctgaccacgctggagcagccgacagcaggtacggttgaagtctgcggggtgccgatcaaagcggcaaaagcgattcgtcaacaaatcggctatttgccgcaaagattcggcttttacaccaacatgcgagtcgtcgatgccatgacttatcttgcggtattagccaatgtcccagcacgggatcaatctcagcgaattcaacatctgctcgaagaggttcatttagcagacaaggcccgcactaaaataaaagctttgtctggtggcatgttgcaacgtttggggattgcacaggcgctcgtcaatcgtccaaaagttttaatcgtcgatgagccaactgctggtttagatccagaagaacgcattcgcttccgaaatttgctgacagattttgcaaatgagcgcatcgttcttctatcgacgcatatcgtgtcagacattgaggcaacgaccaatacgatcggaattcttgatcaaggccggcttttgttcaatggcacaaccgatcaactcctattggcggcaaatggccacgtgtttgaaaaagaagtgccagttgcaaagttaaacgagtttaaacggcatcgtcggattactgagcaagtaacggatgggacaatggttaagttgagatttttagctgccagtcagatcaataccagtgcgcaagttctgccaacattggaggaggcttatctatatttgcagatgaagcatgaggaggccttcttatgaaattattttggatggaggtcaaacggcaaacaacgagcctgacttttacgatttacaccctattagtgatggcatttgtgttgttaaatatgtggccaatgctcgcacgaaacgtggcggcgttgccgacatcaactaatagctacgacgatatcacagcaaccgacttccagacgcgcaaaacaaacggcgttggccagttacgatacgactatcagcacaatacttacgtcacgtatcccttggggtttgcaaaaacagtgacactaccaaaggcagatcaggcccgtgttcgtagtttactgacacaagccaaccaagcagagacacaagccacattggtgaaagcactgggacaggtggacaggttgattggcggacaatcggcttatagttcacagaacattcaggggtttgcgtcgcgaccgatgacaaaagccgaggcacggcaagatcacaatctgattctcaaaaaagaccgtatcagtggtacctttgcacgactatttgccgattacgccggtattgtcatgggaattctacccaccgttgtcgtcatcgcttattgttatgctgatcgtcgaagtcgtgcaacgacaagtctgcaatcgaaaatgaccagtacttggcgactagtaggcagtcgatacttagcaagtctcgtgacacttttgatgccgatttttttgatgggaatcgtcttaaccattcaaatcgctttgcattatcaagggtatcaaattgattatctcgcgttcttcaaaatgaccggactgtggttattgccaacagtgatggttagcagcgcagtgggctttttaagtgatgcgctttttggcaattttctcggattcgtggtgcagattggttggtggttgagcacgatgatgattggtgcgcggcaagttgctggcaattatggctggttgctgataccgcgacataattcactgcataacgttgcctactatgaggctcatctaccagaattactgtttaatcgattaacctatgccgcgctcgccatgggttttatttgcttagctgtggtgttgttaaatcttcaacgaggaggaaaatttcatgccatcaactttgaaacgcttggtcgggttagaactcaaagccaacgagtgcaacactagtttgatcgtgcttgggtgtggcctgctcatgccggttgtttttacgatgacgccaagcaacttagcacaggccgccatgccgggcgagttgtttctgccactgctgaccatttttgcttttggcagtctgtttttaccagaacaaacggtcgagattggcgcagtcattaatagcaagcaaacgcaactatggtggctttatctgttgcgattcatttggtatgcggtggtactggcgatgctggccacagtattgatcggcgtttatgcttttttcaatgttggggtcaatctgctcatactttggttcgactttgtcgtcaaaattttgttagttgggagcatcacggttttgagttacagcttatcgcgatcgctggcagtcgcgtatctcttgccaacagcgtattttgcattgtgtatcggttatcgctatttaggcgcggtgaatatcatgacgttcatgcgtcatcggacagtgtctgacaactggattcagttgctgctagctgaactatttttggcgatcagttttctgagtttgaaaagtcgaccggttcggggatgacagggaaaagtttgacagctagttgatgctttagtgctcgagattagtggtggtaaggcggcgattggaaattgtgcgatagacaggcaaagagcttcatgccggttgctgctggcatgaagctctttgttagtgtttgttgattcggtgatttgtcctgacgctgctaactgactgattagttgcaattagtttttttcatgtttctttttgctcgtcaggccgatgcttagcgcaaagaccataccaaggagggcgatgcctagagcttgcaaccaatgactgttttgcatccccattggtggtagggctttggcagctgctttagttgaatggactgattttgccagtgttttttcttttgactctttttgtttgagagccgacgttttttgatccaaaggcgaggcgggttccgcatccttaaccgtttttgctttgagacctttttgaacaataaggattgtgtcatcctctttttcaactatattagatttcggatctttttgacgcgtcttgctgatggtttcctcgtcatcagtcactttggatttcggatttttctcgatagcagtcggattatcctggttatctttgtccgacttttggtcgattactttttgatcaacattcggttggacgggattgtcttcgattgaaggcgttggtttagttgcttcaatcgaaatagtaggttcgtcgggttgcgatgttgcgtctgttgacgaatccgtggtgtcagggtgattggttgcgtggtttgagctctcgacttcagttttagtcagcgtgttttggccagatgttgtcgttgcagtgccgaactccgccgtatcgtcgcttgttttagctggtgcgatgttctcagacgaaaccttcttgtcgtcagttgctggtgtcacggttgttttcgaggtgtcgatttggctgttttgctcactccccgttgtgagtgtttcgaccgttgatccagtggttgtgttgtcacttgatggggttgcctttggatcaactttggactcagcagcagaatctttgccagcctgtgagtcactgacggatgtttccccgatatcggggtgatggctctcggtgttttcgacatcgacgctttccgttgtggcttccggcgctttgtcagcagctggtgaggctgtcgctggcgtgatgtcggaattaacggcacgatctttgttaattgctgggtcagtgacaggtgactcggtatcagtggacttatggctttcgactttttcgactccggtagtttccgtgaccgtttcaatggccttgttatcaattggtgcgattgtcgttgcgtccatttccgacttaacggaattatcttcgcttgccttcgggtctgcggcaactgttgcaatggtaccagctgcagcctctcgattgtcttcggctttagcctcttccacggttgtttcatcgatgttgtcttcgtttggtgtgattgctgatgcgtttgattctgacttaatggcacgatcttcgtctgttttccggtctgaaacggttggttcgacatcatcggatttgttacttttatcatgttcacctttggcgtcttccgcgactgtttcaccgacctcggttttacttggcgtggttgcctctgattcaatttctgacttagtggcacgatctttaatcgatttcggatgagtgtccgttgtttcaaccacattgacttgattgtctttttcatcttcggttggtgtgttttcctttgttatttcagtggctgtggccgtgttgctgcttggcgcggttgccactgattcaatttctgatttaacggtaccttcattgtcatcttctgtgtcagtaacagctgattcaacagtatcggttttattacccttatcatctttgacatcggcattttccgttgcagtcccagaagatgtcgccgtgttatcacgtggcgcgatggctgttaaatctatttcggactttacaccactgtttttggccatagtcggggcgatattcgtttcagcagaatcagatttactgcctttatcattttcggctttgctatcttccatggctgcttcaacagctttgtcgttactttgcgaacttgcagttggatcgatttctgacttaacggcactatttttgtcagtcgttacatcagtgatagccggttgggtgttggcggattgatgaccttctttttcagcctcaattttcaagtcaagtgcaacgatgataacgaattcttgatagtggtctaggctgttacgccatgcatcggtagtaatcgcatgggcgaagatagttcagaatacgtctgggacgatggttcagtgcggctccaaattaaccagcgaccgcttaaaatactcgactggcaaacaccgtatcaggttatgctgacaaatttgtccaaaaattcggattaaatttgcaatctaccatttgacgagtggttgttcacgctcttatttcgtgataatgtgctcgcattcgccttgcatgtaaagaccttgaagtcgaatgaccaaaacttggccatttggcttcaaggccacttacactccggtttaaatgcgctcctgctcgcgctcacaaaaaaagacggccatcgccgcctttttttcactaacctattctagaataaaacgtgaatggattgattgctgttgatcagtttgatcgccttgccaagcattggaccgaccgagatctgatctaagccttcgaatttgtgcttaggatcgagcttaatggtatcagtgatgacgacccgcttgagtcccagatgcttgatgcgatcaacagcaccacgggagaatacgccgtgggtggctgccgcgtagacatcaagtgcacctgcttcactcagggctttgtaagagtccacgatgcgatcgccggtatcgattaggtcatcaatcacgatggcgtgcatgccggcaacgtccccgataaccccgatgtgctcttgatcgcgcttatcaacaatagcaattggcgtatgtaattcttcagccaatgcccgcgcttgcttggtaccactgtgatcaggcgcgatgacaacgacattatcgccaagatctagcttcttgaagtaatcaccgatcaagtggtgggccttgagatggtcaactgggatatcgaaaaagccttgaatctgatccgcatgaagttcaacagcaatgatccgattaacgccatccatctccagcatgttagcaacaagtttggctgtgattggctcacgggagcgcgccttgcgatcagcccgtgcgtagccataataaggaatcacgacattaatatggtgagcactcgcccgccgcaacgcatcaaccatgatcataagttccatgaagttctcattaaccggatcagagaccgactggatcacatatacatcagcgccacgaacactttccggtagttcaatttgaacttccccatcagcaaaatgattcactcgagctggcgacagcggtagcccgacctcttccgcaatcttttcagctaatggccggttcccattaagactgaataattttaattcgtgcatcgatttctccctttttcgtatttaacggtctgcaccgtcattatacgagaaaaggcaagaaattgcgactgattatccaatgcggtaaagtaatatcataacatttgcagattcataagcagcgctccagcaggcggcaccccggtctccgccgtgctttgccctgactgcaagacttggaaatgggaggcactgagtcatgaaacaaagccatttgatcggcctcgcaaccccactgttattatcggctggcacgttagcgaccgccgaaagcttttatcaatatgcatttcgccgcattaactatattccagacgcgcggcgttcgatgcaaaagtatgcggcttcatattatcgccatgtccactgggtagaaagtcaggccaatattgaggcatggcatatgacagccccggataatcaacgacttgaagctctttggttgccgcatcccggcagtaaaaaagcggtgattgtgggccacggttacaaaggtactgggattacgatgagcaactttgcccacatgttttacgatctaggcttcaatgtcctgctaccggatgatcgcgggcatggtgaatcggatggccaatacattagtttcggctggctggatcggctggattatttgggttggctgcaacgtatcattgatcgaatcggtgcagacagtcaactgctgttgtttggtaccagcatgggtggtgccacagtttcgttggtggcaggcgaacccagtttgcccaaacaagtgaaggctgtcattgaagactgcggctacactgatgttgaaaccgaattggcctacttactgaaaaagcagtttcacctgccaccaatgccgttggtgccactggcaagttttcttaactatcgccggttaggttatcctttacgcgttgtcaacgtccgccaagcactcacccgcaaccatttgccactattggttattcacggtgcggaagatgtctatgtgccaacgaaaatgggtcggcaaaattatgcggcttctgcgggtcctaaagccctctggatcgttccgggcgctgcgcacgcggaaagctactggatcaacccggaagcttatcaggcacacgtcaaacgttttctagatatctttttctaactgttgctttgtaaccatcacaaaaatggatcgtctgaatgatcaccaccattcaaacggtccattttaatgtctaatcaaaaacgcgcagcacagtctagaggtcatcctcatcatctgcttcagcctcatcgcgttgtttacttagcgcgtcgaattgacgcaacatggccaaatttgtctcgatactttccggccattcccaatgctgaacattaaaaacgtgcttgaggtgcggaccggcgctggctggccacaatttggtcgtataggtcaccttatcggcagcaaacacttctagcaaagcctgactttgcaaatagaagctgtcattttggccgccaatcagcatgaatggcggcaacttgaggtctttggcaacttgagaaaagttaaggtggtcagccaatgcagcatcgccaccgctcagcttatcaagataaaaagcggccatatcgctcatatcaccagcggcttctggcagtttgccaggttcagcgactgggcacaccaaggccaccaaagtgaaattgaaattaactcgatcaacgccaaagagttcttgcagctcttcgctttgctgaatgcaggccactagtgacgctagatggccgcctgccgagtcaccggtcaatagaacatgatcgagatcaaagccgcgctgtggaccaaaatgcgacaaccaacgtaagctagcaaagatgtcttgaatctgcccgcgcacatcgacatctggcagcaagcgataccccatgcccatcaccgcataaccttgactcgccaaatagcggcaataatttcggttgagattgcgatcgccataaaaccaaccgccgccatgaacatcaatcacagttggcaacgtcgcattgcggcgttttgccggataatataagttcaaggtctgctgcgggtcagcagagttttcataccggtattccgtttcccagtggacatcctctggcacccgttcatccgcatagcgtgccttatcgcgcgctgccgtctgcgcccagcctgcctgaatttttgctaaaatgtcatcatctgccattaccaaggcctccatttcaccatgttcaaatcgcattaaaagattaatcccatcttaacgcaaaaagactgccagtgagtcaactgacagtctaatcgtatgaattaaccttatctattaacgatctttggacttaacgctagcttcgacttcatcaatcaagccagcatctttcaaaccggtcacttctttgatgacatccaccagcggctgatccttcagcatcgcttgcaacttcacagcttcggcatcattaggttcaacataatggaacatcatgccaacggtgtccatcaaaacgctgtaattcaaaccgcgttccttcaattcgcgaattgggcgaataaagcgttcgtcgtaacctagtttgcggattggtgtccgggcaactcgagaaatatcatctgagatgtacggattctggaaacgttgcaacacccgattttgatagttttcgaggtctttttcgtcaaaattcttgaactctgacaacaacaacgaacgggtttcggccagcgcaccctttgcctgattgaagactttaggatccttgatggcgtcgccaattgttgtatagccaaggcacttgccggtgtaagccgtggtagcgtgaccagtgttgacggagaagagtttccgttcgatataaggttccaggtcgggcacatagtctacagtcttgagtttcagatccttgttcttcatctgactctcgtcaacaacccattccttgaaatcttcaacactaacggccaagggatcatcgtgcttttgttgtggcacgattcgatcaaccgcggcgttagggaagccaacgtacgtatcagcaaaggtcttgccggcgtcatcgagatgctcgtagacactcttcttaagtgactgagagccaccgatcatattttcacatgcaatcacatctaatgcctgatgattgttggctgcatcacgtgcctgcaagccttgggcaattaggggtgcaatgattggcagaatcttcggaccaatggcggtggtcaccagatcagcctgcgcaattgccttcacaactgcctcgggatccttggcattgttcaacccgtcaacattgtccacatgaatcttcttctcaccgggcgctgctaaggtgatcgtatattcgccgcgttggtttaacgcattgatgatcgtctcgttaacatcgacaaaattgattttgaaaccgttagcggcaagtgtttcaccgataaatccgcgaccaatattacctgcaccaaaatgtactgcttccatcataatttattcaacttccttcagtaaattgacgatttcctccggcgtttgggcgtcggcaagtttctgaacattttcaacatcactgcaataaagcgcaatttgcgacaacaatttgagatgttcgccatttaagccagcaatcccaaaaacaaccgtgaccaagttctcatcagccggatcatccgaccagtcaacaccccatggatattgcacaatcgaaatagccgtcgacttaatatatttcatcccggcctcagtgccgtggggaatagcaatgaagttacccatataaacagaaacatcgcgattccgatcaagcatcgaatcaatataagctggttcgacattaccattgtcgaccaagagttggccggcctgacgaatggcttcttccttggtctttgcttcctgaccaagtttgatcgttttaacgtctagtcctttcatcatgtcaccttcgatcaatttttttgatttcattcataaatacttctgtgatgatttgatacaactggctataatgccctttttcaaaaagttgtaaattcgttgttgacgcaatcagctttgcgctgacagcgctcaatagcgtcagtgtttcctgagcaactgggttcggtgtcaaaaggagcaatacccgatgcaacatgatcgtgcccatatccatggctggaagcgacagcggcgtttttaaatcgaatgcgccgatgtaaggcactgtcacaccttggctactggtatgaatcatggcgagtccggtatcgggaatcccaactggcgctaattctagtcgctttagcaaggcgtctttgacgaccggcgcttctgccaccacgtctggtaaatgtgctagcatgacatcgattgtcgctcctgaggttgtcaccgcttcggtgatctctgtcacagcgaagtgctgtaacatgtcatcagctgctaataccatggttttgagactttcaaacgccgtcacagtctgatctaatgacggttgtctttgctgggtcgcttctttcggcttgacctgttgcaataatcgtctgatttcactaatctcatcacgcgccaagattggcgtgatgacaagatactgatgcttgaatcccggcaatggcatcgtcgcaagaatcaaaccgtaatgtgccagattctggttcggcagatcactaacctgaatgatcttgatctctcgaatttccggcacctgtacacgtagcttcccagcaatcagattgccggtccccggaccatcgctcgtaatcagcaagacagctgctggcacttcggtgtgggtatggtccaagactgaagcaaagtacaacaccagatacccgagcgcatttccagtaaaggcatcgcgaccaaaaacatcgtcagccgcttgttgaactgcgtggtaaagttcaggataatcgtcgcgcagatgagccagcactggattcgtcatcgtgacgtctggcagccaatcaccgccagcggttcgttggacatgagccaacagcgatgagtaaagctgcgtattcccggaaaatttcccgggaaatgatctggcaacttcacgaatcaattcctgcacttcaaggttaaccgttaaatcaaacggatcaactggttctccagccaagccaccgcgaatggtactgagctcaacggcaagaaactgataatcgccaacgcggactttctggcgaatcgcggagtccatctccgccagaaactcgagagccaattgttggtcctggaaaagccgttcctggtcgaaatggcgttgcgcttcaacatgctgatcttctcgcaatcggcgggtattaactgctactgtcagtaacaccgctttgcgctggttgtcgctgagatccgccaacgccttgatgcgcagcaaagccgcgtttgctgccagtaactcttcctgcggtaatcgttcaaaaaaataatgtgtgactggatcgaatgtctgctgaggatcacggagaaagcggaagaaaacgtacggattaatctcagcattcaacacgcctaccaatactcggcgaatatcgccttccgcaccatcaatccagataccggcagctttttggcgatttaattgcagatgatattcattcaaagcgggttcaagaatatccagatcttgcttaatggtggtgacactcacgtcaaccgctgccgctaacgccgtcattgtttccggaccgttggcattcagcaaccgtaatgttaaagcactttgtcgttggctaggatcaaatgtcaccacctgatcctgttttgccaaagtcgcggttaaggtagccaaatcattggtatccccgaccaaccgatacgtgctgccagtgcctttatcgagttttaaacagattgtggcgatgtcactttccaattgcgaaagctcacggtaaatggtccgacggctgacacccagctgccgttccagctcatctcggctaacaccggcgggctgactcatcatgagtctgatcatttcctgttcacgattcgttagtaacatatttttcgcctcaagcggccgcaacaccgaccgaacttatttcatcttctcaataagcttatcatagttcgttgcgttcaagaggccatcaacggtgtagacctgaacattggcaaactgcaatttaacgcgacgtgctgtttctttcgaagcaataatcagcacattgtccttgtcatcaatctcgccgattgcgacattacgaactttcacgtctttattcagtttccgtaattcagcacggaatgttgcctgtgccatggttgcggaaccaatgttttgatcatgatgcaggaagtcaacttcggtaatcttatcgagatcaagttcctttaattcgtcttccggtgtttcttgtttagctttagacgtctcagttgctggcattgcctggtcagtaccgccaactgcttcagccttcaaacttgcgatgatttcatcatacttcggactgttcaggaaattatcaaccgcaatatgagcggcatcaggtgtcttgtccttagcccgatcagctaattcttcttgtgtcacaaccagcagtcctggcttgtcttgcaggttactgattgctgtgttggtaaccgaaagatccagacctgccttctttaccttgtcgcgcaagatggaagcacccatggcactggaacccatgccggcatcgcaagcaaagataatctgcttaatgcccttggcggctgacatcacatctttagctgccgcaacattttgctgacccttagcttcagccttcatggacttcattttggcttcgctttcggctaattcgtcaccgcttgcgctcttatcgcggcgtaaaatgacagccgagatcaggaaagaaacaagtgtagcacctgtgacaccaacaattaaaccaatataattcccaatgttaaccggtgacattgcgaataatgcgaagatagaacctggagatggcgagctcttcaaaccaacattgaagatggagaaaagtgtcgtcccagtaacaccaccagccataacagacaggaacagtgctggcttcatcaaaacatatgggaaatagatttcgtgaatcccgccaaggaagtgaatgatgatggcggaaggtgcggaacctttagcagatcccttaccaaacagcgcaaatgctaacaaaacaccaaggcctggacctggatcaggttccagtaagaacaggattgacttaccatgttcggctgccgcctgaatcccaagcggtgtcaaaatcccctgattgatcgcattatttaggaacaaaatctttgcgggttcaataaagacgtttgctacccacaacaacccgtgattgataatccaatcaaccccagttgccatgccgttagtcaacgtagagataattggacccattaggaagaagccaacgattgctagcaacatcccaataatgccggcactaaagttattgaccaacatttcaaagccttgtttgatcttatcttgaaaacggtcgtcccacttcttaatacaccagccaccaagtggacccatcaccattgcgccaataaacattggcacatcagtaccgacgatgacccccatggcagcaatcgcaccaacaacgccgccacgatgacctgccaccatcgaaccgcctgaaaaagcgatcagtaatggtaacagataagttaccattggcgaaatcatttttgcgagctgagcgtttggataccaaccacctttaaggaagatggctgtaataagaccccaagcaataaaggcaccgatgtttggcaacaccatgccagaaagcttggttccgaatgattgcataccggctttcagattaaatttctttttttctgctgccggcgtgtttgctgtttttgcacccaaggcaaacacactcctttcccttatttacaagtattattgtaaccgcttcatgtaatcgctgacaaaagcttctttggcacagttgtctgtgccaaacattcaggttgaatccccagctaacagtttactgaggaaagcatctggtttaaaaccataacagtgtacgttaactgtttcacaagttatggaaaacgctaccgctgtctacttttttgctcgcatcatactgaggacgctgttatctgatgttgttatctactatatgtcagttgtgcctgacgccctatcgactcagcataaacacagaaaatcaaaattttcggcattacggtatagaccactattgacatggaggttttttgatgctacattggactagaccagatagggggatatcaatgatggatgtaaaaatttttgataacgatacagaagcaggcaagtacgcatttgatttgatcaagcaaggtatggataacggtgccaaagtgctcggcttggctaccggcagcacaccagtcaccatgtacaaagcaatggttaatagtgatgttgatttcagcaacatgacttccattaacttggatgaatatgttgggttggctccagacaatgaccagagctaccgttacttcatgcagagtaacctcttcgacaaaaagccattcaaggaaacctttgttccaaacggcttggctaaggatcctgaagaagaaaccacgcgttacaacaaagtaatcgccgaccatccgatcaacatccaagtacttggcattggccgtaacggtcacattggcttcaacgaacccggttcaccatttgacgcagaaacccgcaaagtaccgctgacccaaagcactattgacgctaacgcccggttctttgcaagtgaagatgacgtacctcgctacgcctactccatggggatcggctcaatcttgaagagcaagaagattttgctgttagcctttggcgaaaacaaggcagatgctgtcaaaaaaatgattgaaggccctgtcaccaacgatgtgccagcgtccgcactgcaaaagcattcagatgttgttgtcatcttggacaaagcagctgcaagcaagctgagcaagaaataagctatttctttcaatcagctgagatgaaacaggccgatgctcatcggcctgtttttttatggaagtgtagcttaacccagttagaaaacggcgtgtaagcagccttggctgtgatgaccgggttttggccatgaccccgcgctccttgcaagcaggtttccgggctgacaagcgtgtgaatccctttcaacccagtagtatccgtcttttcctgtaagcgtttcgatttcttgccctctgccgtacgtattccatggtagaatgaggccatcacaacatttagtaacggaggaaattatgtacaaagctgtcgttttttttgatttagatcaaacgctgctcaatgatgacaaacaggtgccacccgaaaatgttgctgcgctcaaagcccttgaagccaaccagattctgccggtcattgcgactggcagaaattactacgaactggctgacattatggcagcaactggggtccgcagtgcaattgctgctaatggtggtgacatttttcttgacggcgatcacatttttcaaagtgtgattggcgagccgcaactcacccgttttctcaatacgagtgcagcacaagacattcaagttgccatgtacaacagtgaagcatcggcgctgaccggccataatcagctcacaaccgataactatgcgcaggtgcggcaaacaccgccgccggtcaagccatctttctacgagcatgaagcaatctgtatgatgttaatgtttgtaccatggaccgatgcaggtgaccagattgggaaacaattcatccaagatttcccagaaatgacgttctaccgcaactcgcattatacgtttgatgttgtcaatcatggcatttccaaaggcagtggcatggccatcctgttaaatcagccatccttacgtggtctgccaacctacgcatttggcgacggttataatgacattccgttgttgcaagcagctgacaccggaattgcgatggggaacgcttatccaaaagttgcggctgttgcggattatcaaacggacgattatcgcgaaaacggtattccaaatgcacttgcacattttaacttgatttaatttttaatgcgtaaaaacacatcaatactagcctattggtgtgctttttttatggcgcttatccagcagcattttccgctaaatttcggttgactttgcaaacgtatgttcccataataataagtgtgaactgtgaacttaaaaatttaattttaggtgcaaaaacactgtcatattaaggtttgtaacacttgctataccgtgttggccaattaaagtcaagaccgcggcagcgcaaattttctgctatactcaaagcatgctgtgcgttatttgggcgtggtcgaaacaccgatcaataatcgtacaacagcgcaaaatctgctgatggaggggtctctcatgttagaacaatcgacaatgcatccggtggtttggatcaatcaacatacttatatcagtatcgtcaaaaatgcggattataatttagaagtctgggagattaccgacgaaaatcggcagcatcggatggcccggatgaattacaaatatcaccgtgataactttgccggattcatctatcgactcttcccacagatcgacttgattcagattcacaacattcaaaagaagatcaacccgtatttcgacttagaggtttaggggtgtacacatggatagtctggttattcagcttctgatcatggtcgttgttgctttgctggtaacactgctcgtcatttttgcagaatggcgcgctaaaaattttaaaccttggcaactcggtgttcaatcggttgtcgccgtggtcctactgggcgttggtattagcttgctaacagttagatgaggcaacttggtaaaacagccaagtctgttctgaggctggcacacttgagctttcaacatgttgcaggatttaaaaaaattattattcactatatagttggccgctttgcgttataaagcggccttttcgtttggttccacgtggaacaaaaggccttcttctcgtctaatatggcccaacaaccgcaatataatggattttatttttggcatcggatgattggccttcacagttgatgccattgatcactacttttcttcaaaattaaatgacttggctgatgccctccctctttatgcaacaccctttagcaaataaaacgcgcaaaatacagcattcgaattccttgaagacgacccaagatgttaaaattcaacatcgcatttgtcgcaaaattgaacattttgatgtattagaatccgaatacccgcgaattgaagcaattttaagcctgtcaaaataaggaaacttttccgccaaatagcgtttttattaatggacgtcatccaattctatccgtatacttgcaccaacaaagcgattagggaagcactttcaggaggggcaagtatgaataaaggacgatcaaagggtaaacgtatttcgcaacgcatggtgatcattgggattggtgcattagccatgattggcgtcaccgttttttcctagtcacatccaaaaaaccgacatcattacccgcaccgacaacgatagccaccttccaagtgaagaagcatgagttacgagtgccgggacaggtacaggccgtacgtacgcaaaaaatcgacattcctgaaggcaccgtccaaaacatgacggttaaaaatggcgatagtgtgacggctgatcaacagcttttgacagtttacaagcctgacgtacaaaccaaggttgatgaagcttcgcgggcacttgaaaaactgcaacgcagtcaagccacacttgatcagcaaatcagccaaatcaaagctactttaagtaagaccgccgccgatgatccacagaagtccgccttgcagacacaacttgatgaggcgcagaataatcgccaagattcggctgatgccatcacccaatcgaatcaggatatcgctaaattaaagcaaagtctgaatacggtggttaaggctccctttgcaggtcggctgtacattgactatcaagcaaatggcagtcagaccatcacggaaacctcggctgaagttgaagccgttggtgaggtctccgaatttgattattcaagtgttaaaatcggtcaatctgcaaccgtacaggcgctggcaagcaaaacaaagcaagcgacagacatcaattttattagcagtgatccggctaaatccagcaagccgaatctcgccaagtatgaactcacgacgaaattacgtgacggctttttaaacggccaatccatcaccatcacgattcccctaagcggtttgttaattcccaaagaagcggttaaggacggggccgttttcaaaatcgtcaataaacgcgccatccgaactaaagtaacctatgtggcaaaagacgatatgtatgaagtctcagatggcctcagcagcggcgaccgcattcttcaaaaacccgacaaaacaatcaaagacggggcgaaggtgaacgttgatgattgatttacggcatgtcaacaaaagctatctgcaaggcgacacagccttcccagtgcttaaagatatcaacttacacattgatgaaggcgagttcgtcgcaattatgggcccgtctggctctggcaaaaccacattaatcaatattattggcttccttgatacagcttttgagggcgactacctttttcaaaacgaaaatgtcgccgcctttaatcgcgccactgcgtcaaaaatgcgaaatcagcatgtcggctttgtctttcaaaatttcagcctaatcaataacttaaacatttttgaaaatgttcttattcctctgagttatggtggcaatcgacgaagtgatgttaaagaaaaaatcactgagttgctgcattctgttggcctagtcgatgttgaaacgaaattaccgcgcaatttatctggcggtcagcagcagcgggtggcaatcgctcgtgcccttgcaaattcgccgcaattcttaattgccgatgaaccgaccggcgccttagacagcaatacttcggcagagatcatgcgactctttaaaacactccatcaacaaggcgtgaccatcattatggtgacgcatgatgaacacgtggcgctacaaagtgatcgcatgattaaagtattagacgggcagatcatcagtgacacggaggttagccatgcgaataactgaattaattcgattttccttccgtgcgctaactgctaacaaacgccgcagcctcctaaccatgcttggcattgtcatcggtatcacttctgttgtaaccatcatggcactcggtaacggtatcaaagctgccacactcaaaaatttgcaaactgatcaatctggccaacaaacggctgaaatcaccttccttcctgaaagtagcactgcctccactgctggttttaaggaagatgatgtggatctcgcctatcaaaccgctccagacaaaatcaaaaaagtgactatcaaacatgaaaaagaacgcctacaactgaatggtcagttagccaatcaagatacgatgctatctgccacacttgttacatctatgcctaaagtgcaacttgcagctgggcataaactaaaccctgattctttacaaacagatggacatgatgtgcttttgtcgaaaaagttagctaaaaaggtctttcatggtaatgcggccgcgttgacgtcatctgtttttatcgggaagcgaagctacaacattgttggtattttcaacacacctaaagagtcctattcagctttagatgttgacgttttaattcctgaaaaggcttataccgctggccagttaaacccaggagggcaaaaattggccatcaccttccaacgtggcagtgacatttcccagttggcaaacgccatcgttcgtcagttgaagaaatctggtactgaacgccgcaatggctcgtaccaatattttgattatggtgaattactaaagggtatcggtgatgtgatcagcggtttaacgttgttcgtcggggccattgcgggtatttcgctactgatcgcaggtgtcggtgtcatgaacatgatgtacatttccgcctccgaacgttcacaggaaattggcatcagaatggccgttggcgctaccccagcagaaattatgaaacagtttctgttagagtcagtcatgctgacattaaccggcggcgttgtgggtcttgttctcggtggcttgattgcctggatgatcacagcgttcttgccatttaaacccgtcataacgcttggttccatcatcggcacctttgcaatttccagcattgtcggcattgtttttggcattctgccagctaaaagtgctgccaataagaacctgatcgatattctgaaatcataaaaatgctcccatctaagtggcagcatgcagctttctatttctacattgaaagttcttgaaccaacgaaaaaacggttagatctgcgagatctaaccgttttttatacgctattactgctactgcttttagccaaaagccgtcattgctgaagacatcattccgagcgcttcttattgcgaacccctgctaacccaaacaagctcgctatgctagtcaagatcagcccaacaatagacaaatcattcgccgatctatcacctgtttgcggtagctgatgagtcgttttcacaggtgtttgctgattaattgactgactaggtcgaccagtaacactcggcactttgcctgtctcatgaccagtactcgtaccggtatttgtgccagtgccggtatctgtaccagtacctgtatcaggaagcggccctgatttcgcaacgatttcaaagaccgcttgctgggtatcgacattttcaagcagataatttggcagcaacgcttggatacgcttgaggccgcctgcgctaagtgtcacggcgtaacgaccaacaacaattggggcaataccatcagcaaaagccaagtcactgtcttcaagtatgatgtgactaccatccgtaaaaatcaattcgaaatgttgagcattcagttctccaggttggccatcatagattttttgctgcatgccgctgagctgtcctgacaaaaccgcgggtgtgatagtaatggtaccattcattgttgtgtcgttaatttgataattaggaccaagtgcaaccatcactttagcaatgccactagcacttaatcgatacgtgtaggtgccaacattaacgctatcattggcaacatctatatctgcattcgttaaggcgactgtttgtgcaccagttggtagttgaactgttaccagtaatccactagcttggcttgctcgggtaaccccgtcatactggaaatgaccattattaacggtggccacgactgtcagtggcgtgatggtgatcgtgccggtcaatgcgttcaaatcggtttcattaagtgcatagttggtgccggctgctgctttcaacttcgctattcctgaatgactaagatgataatgatacgtgccagttgtcgtgttatcgccgtcaacaacaatgtcctgcgtcgtcaatgcaacagttagcctagcagtcccgcgcgagaggtaaacgacgccattgagacctgacgcttcacttgcctttgtacgaccatcataaacaaatgtcgtatcatttaccgttgcagttccttcagctggggtgatcgtaataatacccattaatgctgctagatcatctgctttcaattgataatttggtccagctacttgttgcagtttcgtgatggcgtcagtacttagccggtagtggtaactgccaacattgacaccatcatcagcaaccacgatatctgaagcgtctaacttaattgatgttgtatcgtcgccaagttcaaccactgctgttaacccttgagcctgactcgcctttgtttggccatcatacataaatgaaccatcattcgaatcagcggttgttgttgccggtgtaatgttaatgttgcccgtcaattttgctaattctgaaactgttaactgatagttgctgccgactgcctgttgtagttttgctataccggtggcggtcagcgtgtactggtaactcccaacattcacaccatcattgccaacaacaaagtcaactgacgtcaaggttaccggcaccgttgcactgccaactgtgccgtttgcagtcaagccttgtgcctgaccggctttcgtcttcccatcataaacaaacgaagtattggtcagagttgcggtgcttgctgcaggcgtaattgtgattgtaccaatcaactttgccagctcagaagcatttaactgatagttgctgccgactgcctgttgtagctttgcgataccaatgtttgtaaggctgtactgataacttccaacattcacaccatcattgacaacaacaaagtcaactgacgtcaaggttaccggcaccgttgcactgccaactgtgacgtttgcagtcaagccttgtgcctgacttgccttcgtcttcccatcataaacaaacgatgtgtcactgagatttacggcaccttcagctggcgtaatcgtgatcgtaccagtcagttttgccagttcagaagcgtttaactgatagttattaccgacggcctgttgtagttttgctataccggtggcggtcagcgtgtactggtaactcccaacattcacaccatcattggcaacaacaaagtcggctgacgtcaagatcaccggcaccgtgacattgccaattgtgacatcgccggtcaaaccttgtacctgacttgcctccgtctgcccgtcataaataaatgagtcatcacgcaactccgcagtgccttgtgctggtgcaatcgtaatcgtgcctgttaagctgcccagcaagtcacttggcaactgataattggcattcaacgcctgctcgactttcgctacaccactctgactcagttgatattgataatcaccgacattgacgctgtccgatcccaccacaatatcagtcgagctaagatcaacaactgtcgtgccagaaccggccgttaatgttaactgcaatcctgaagcctgactagcagtcgttttgccatcatatacaaattgtgtcccattaacagttgcagttgcagtagcaggtgtgatcgtgataacccctgggtgagtattgatatctgtctgatcaatcgtgacttcatcacccaaaatcgcttgaatacgtgtcaatccactaccattaagaagatatcgatacgtacctacatctggtgagtctgcttcaacaagtgaaatatctgtcgaagtcaaatcaatggcttgctgtgagccatcactcaaagtcacattaagaaccagttttggcgcctgactggccaatgtcgtgccatcataagtgaacccactattattcaactgacctgtagctgtgcgaccgatgataagttgtgccgtactcgtaccggtaaaattatagttagccgctgactcaccagcatcatttgtcaattcagcaatccgcgcccatgccgcctttgaaagttcaacacggtagacacccgttttcgtcaatgcatcagcagcaatctggttgccagatgcatcaaaaaaattaaggtcactcagttgtaaagcaccagcattgaagccatccccaagactcagagaaaaggccgtcagatccaccgtaatcggttgacccgtcgcagttgccgtttgagtaccagtcaacgaatatgacgccgccagccgttgattataaaaaattttagctgagccactttcagccccatacgcgtaagtgactgtataccaagtcacctgatcactaggcacactgcctgtgacaacaccgtctctatctttagaggcgatcacagccccgttctggtccgttacagtccaagtcaaatcgctaagtggtatctcaatgatctcagtgccattctttttcacggcgccgccaaagttcagttctggtttccaaacctgacccgtgaaaaggttaatgtcatgggcatggataacggggtcattcagatgaaccttgtaaagaccagtgtacgttgtgccatctgccgcctttaatgaccaattaaaactgaattgttcagttcccgcaggcatcgtaaaggattttgtcgcggtattaaaggccacgccggttccctgaatattcgaaaccacaatttgatcctgactgacacctgaaatcgccacactaaatagatcacgcaaactaacatgagcagaatctgtataggcgtcggcattttgatttagagcatccggggttgtcggtacagccgtcgcggcatgcaaaactgtgatccggttattggaaaacgcctcttgatcaattgtcggtgtcccagcaatcgccacttcaggaatcagattagcattaaaagctttagcaccaatggcagtcacactcgctgggatattgagcgcatttaagatggtgtttgcttcaaacgcctcttggcctattgtctgcagacctgtccccaaggttaagttgctaattgagttatagacaaacgcatatttgccaatcgcggtgacactacccggcacagccaaaccattttgaatcttattgtagccaaaagcactgtcgccaattgtctgtaacccgtcatttaaagttagtgccgggatcttgttgccgacaaacgccgcatttttaattatcttcaaatttggtggcaacacaattgcattgttaatcgtattataggcaaaagcactgtcaccaatcgattccagcgctgttgcccgactgaagtcaacattttgcaacggtccaaactcagtaaaagctagatcaccaattgtctggagattaggaccaaatgctacttggatgaggtgtccaccgtaaaaagcttgatccccaatttgttcaagtgagtctggtaaattaatcgccatcgcactggaaaatgcgaatgcctgaaagcccaatgttgtcagccgactattgtctgcgattgcaaccgttcctagttttgacccataaaaagccgatccatcaattacgctgatgttcgccggtattgtcagcgtcggaatttgattgctaggattatcctgaccattaatgttaggcaaatccttcatgttttggataaattgaaaagcgccgcctgtaatcgtctgaacatcaggaccaaacatcagattatccgtgaagagatggaagaaggcttggttgctaatcgttgctgcatcgacggtcacattcgtaatgcgtgcatagccaaaagcagtttcagcaagcgttgttgccttgccgcccagcgtcagcgatgtagccttagtaccgtaaaaggcattcttaccgatcgtcgctgatcctgccacattaatcgtgtcattaatggtttcgtaggcaaacgccgcttcgccaatattagcaacttcatcatccaacgtcagcgactcggccttaagcccataaaaagcattttgaccgattgttgccggacctgcgacactgaccgcaccagtaatcgtggcataggcaaaagacgactcaccaatgttccctgcaccgttcaatgtaatcgcactcgcattgacaccggcaaaagcctctttatcaataacagccgcattatcgacggtgatcccaccagtgaatttactataggcaaaggctgaagcaccaattgtcgtgaccgtagaggcaacatgtaagctagtcaaattactcaagttaaagaatgcaacatcctgaatcgcattcaccgtataagcttgaccattatacgagacagttggcccaatattaatgtcggtaagcgttgcaccagagtcatgacccgtaacggttgccgttttggttgtctcatcaaaactgtaagttaaaccgtcaaccgttgcgtcagtggtcgtggtattggctgttactgtaggttgagcagcagctgtcgcaaccggttgggcttgactactggccgactactgtgcactggaagcttggctgctcgcagctgaagatgctgctgtttcactagcagtggcagcctgtgtagcagcttggtctgcagccgcggctgattgagccgctccacagaccccgaggccacctgtgccgaggttgctgaggctacctgtgacgcatcagttgtctgttcagggacagccgcctgactcgtaagtgtttgcgctgctgatgaactggatgtttgactgctagccgcgctcgccgcagatgaagccttgacagcctcgccggagttagtagcattcacagcattgcttgatgttgtcgcttgatcactagtcaccgcactttgagatgtcgctggctccgctgcctgtgacgttgccgttacttgtgtctgtggcgagcttgtatccgccttaacttcatgacctggttgaaaaaaggctggtataaacagtaaagcagctccggcaataagccaccgcttttttgctttatacatccgaaaacggacatgaaccgtctgttccgcctgtcgagccaattgaatccgtttagaatctagtttcaagatcatgatcctcctacagccatgttaatagcgattcccgtcacgacgcttaacgaaccatctcagatacgatgattcacttggaaacagtaagcgtgtagaatctgtttttcattatatggtagattgtaaaattaatccgaacgctgttcggacaaaaaagatcagcttcctttaaaatggtgtttaccacaaaattgttagcggcataggctacaaccactaaacacagtcactttgatctacgcttaaattcaactttgcaccagaaccttgcgctggctcgtgatcatcctcttcaccgcgggggctgcctgcttctgctacccttttgcggcgacggcgatcaatgaagtcatcatgaccagccgtcgtgctgaagccgatcgcgaagcagccaaaaatgccgcagcccaagatgcacaacgcgcttctgagaatcgcgcgctcgccgaaaccggcctgcgacccggccaagacccctttaacagtgagcaaaaagtcaagcaggcttatgttaaaaagcatttaattgggcgaattgcgattccgaaaatagaagtcgacttgccactatttgataccaccaacaacaccttacttgatcaaggcgccgttgttttaccgggtactagttatccgcgcggcggtaaaaatacgcacacagtgatttcggctcatggcggcttgccaaccaagcgctacttagaagctcaagaaaggtcagcagtttctgattgaagttaacggcaagaaactagcatacaaggtctttcgcattcaaactgtgaaaccagatcagactgtaagcttgcagattgaatcaggtcaggatttagcaacgctcatgacgtgcacgccatacatgatcaactcgcatcgcttgttggtcactggtaaacgcgagccctatacggaatcgttgggacaagcagcaaaatccgctgatcaatggcgcttttggaaaagcgctgcaattatcggcggtgtgctactgctagctgtgctgattgtctggttagctcgccgttacttgcgccgacagcgcaggtcatgaaaggtcaggaagacaagttcgattgaccaattttgtgaaaaagagggtgcatcataattccaacgtaggactcgtgatgcattaaactccgaataatcgcagggagatgcttggctaaaatttccttgccgtgccaaactccgcaatctccggccagctggggctggaacgctgtgacggcgctttgagcccgcaaagcccgcggtctcgaagtcgcctaacaacatcagcgacaaagaccggtcgctgtgttgtttgcacggctgagccccatctggcctacgattgctccgccttggcactccggtctttaaaatcataatgaataacctatgagcaggcaaaagcgaacaaatttcctttaagtagaaatttgttcgcttttattttgccgactgagaaagatgtcctgacctgttttccgtgacatggccaaaagttattcctgaagtagcattcgacaaaaaagtaatacggtttttcaagaacgatcaaggccgccttttgcttttttctggcaattaccgggtaatataatcgcgtggttaattcaagtatattataattctgatatgaaggagtgtatgcatgttgaaaaaacgggtttgggtgacggtattgtcagtcatcggtatcgttgcacttggctttggcggctgggcgttgattgatcattatcagtacagccagttagttgatcagccaagtgatgttaaaaaatgggaagctgatccgcggccgttgcagtccaaaagcgcggcaattaagcaaattaaagctatcgggcaatcagatccgcttgaaaaacgcgcggccaccgatgccaaattagtggtgattcctggacttcgcggtgcttggtcgatcaatgctaaaaccaaaaaagcgggttttggcaataactgggtgcctcagggggtcacccagtccaaagatgcgatctatatgagcttgtatgatggtaatcacaaactgaattcaatcattgttcaggtgaacaagcataatgctaagtacaataaaactttaattttaaggagtaaatcgcacgttggtggtatcacttacgacatcgaccatcagcggctgctttggtctgatgatgccgcgcagacaacaggtgctggtatcagttatgtgtcacagcgcgaaatcgatgcctattcggctaaagcaacgcaacaaccgataaagtcaacccggattgaacttcatttggcaagacggacctcagcgattgccctgtataacaatcaattggtttttgttaaatatggtcagaacaaaaagaaccgttcgatccttgccttaccgctcaatgcaaatgggccgccagcacccatcacgatgaagcaaatgaaagcatgggctttggaacttgcaccaaagtttgccggcaaaacactcgatcaagaagttaacatggtctttaaatcgctgattcaaaagaaagtcattaattcgtataacaatggctgggatcggcttcaaggcattgccattgccaaaagtgggctgacgttgctcagtcagtcaaatggcagcgcaccaggcaaaatctggattcgggttccgggcaataaaagctggaccaagctagacttcaccgcaccaaagtcagggtctaaaattattaatgtcccaaactcggttgaagaaatcagccttgatccttctgagaagcacatttcgatgatctttgaaagtggtgccaaagcttatcgtgaagcaggctccttcatgcatcgtccgagttacatggatcgggtcattattttgccagtgttggttaaaaaaggccaagtccagtaattgcgtggcttgacagtaagagagaagccaaaagcaggttttgcaatcagaaggtgattgcggaaactgctttttgtttgcctcagaaactagcaattttaataacacttgttttgttcgcacatcgtttggccaaaatgataaagttattattacaatattaattgacttattttgggggtgtggggatgcgtcaatatgggataaaaggactggcggcgcttggcatgctgctggtgatgttgggcatgccaagcggctcagcggaaagtgagccgacgccattaaaagccaatcatgttgccgcagtttatgaggccaagaaggttagaccactctttcaacaactagccgtctttccggatggcacgcagcaaccacttgctggcggcatctttgctttttatcgattcgacagttcaggccgccgccgctatcgaacaacggatggtcattggcggtcagttgggaatccattaacttctaaagaagcctataaggtaaaagcagatcggcacggtattgttgccatcgccaagaacctaccagttgggactttttacagtgagcgcctacttttgccgcgaccatatgcgaccaaaatgccgctgcctgtcaagattcacgtgaagcgcactggcatcacggccaatggtcaggccattcatacaggagaggaactgcctagaatttacgcttttcgggtggcggtgacgcgtcagtgagcgattgttgacactgcttatgcctagtttatatttttcgtccttatttcagtaaatggttggctggcttgatgcggaaaagagtttttaatccccgctgaatttcggttgtcgagatagcagtgacacacgattatcggcgaaaatacaacgtttatttttgaacccgcttagatgcttccttgtacgatacaatgtttttgaaagcattgtgtcgttttaaaatcttttgcagttcttggaggtatgattgatgcgcgcgaaaaagaaacaaaacaaaatgacaaatacgttgcttttaaccgtgagttttatcgtggtggcttgctacctgcttttctttaaaggggttagccaaccttttcagtttatcttagtttgtggtagtctcagtgggttcttggttcttctaggggcacatcttagacaattatttgctcggagttgagtaacgataaggcgtgcgtataagtggtaatcaacgcttcggaatacctgcgcttgacttttcgtcattgtccgcatacaattcacttcatcaagtcatagtagcgcctcacagagatcaggacaatcgctgaaagtcctgaaatgcgcgcgaatccaagcttgtatgatgagtctcacaaaacttaaataacgataaaagcgcaaagcattgctttgaacgagaatggtaccgccttaacgggtgtctcgatcaaggcggtgctttttttgatagattagatttctcgacaagtatgcattcagcggaggtagcaatggcaaaacgggcggtgcaatgtaaacgattagtagtgaagattggcacgagtagcctgattcatccaaatggtaaagtcaatttgcaaaccatcgatcgactggcctatgctttgacggcgctgaataatcaaggctatgagctggtgttagtcacctctggcgcaattggcgtgggaatggcggaactgggcatgtcgaagcgaccagctgtcattgccgagcaacaagcgcttgctgcgattggccagtcggaattgatgaccttgtacacacagcggtttagtgattatggtgcgaaaattggccaattgctgctaacacatgatgtatttgattatccgatgaatcgtcagcatgtgctggacacgattgatgcgttattggctcagcaagtgattccggtgatcaacgaaaatgacagtgtagcggttgacgagttggatcatcgcacgacatttggtgataatgaccaattgtcggcgttagtggctaagcaaattggcgctgatttgttggtcgtcctttcagatattgacgggttgtatgaccgtgacccgaatcgccatccggatgctgcgctcatgccgacgattacgcagctatctgccaaagtgctggcagctgcaggcggcagttcgacgcgcttcgggaccggcggcatggtgacaaaactgaaggccgccaagacgatgatgcgtgctggcaaacaaatggtgcttgccagtggtcgtgatccgcggattgttttacaaatcttggccggcgacccagtcggtacctggttcggtcagcccaaacaagcagcaagtgtcagtcaaagttttcaatagtaggttttagtagcacttttaaacggctcatatcacgttggcagacgcagaagcttgctcgcgtgcactaaaaaaggagaccgatgatatggacgcaacgacaattgatcttgaacagatggggcgggcagccaaaaccgcggcgatgacgcttggccaattgacgacactaccgaaaaataccggcttgttagcgatggcggctgcgctggagacgcatgccgataccatcttggcggcaaataaggctgatcttgcagctgcgagcgctttgccggaaaagtttgttgatcggctcgcgttaacgaaggcacgcattgccgacatggcagctggggtacgacaggttgccacactggatgatccgactgcgcaaacggacagggcgtgggtgaacgaagccggcttgacgattgctcaaaaacgcgtgccattgggtgttgttggcatgatttacgaagcgcggccaaatgtgacggtggatgcagctgccttgacctttaaaagcggcaatgcggtcattttacgcggtggcaaggaagcattacacagcaatcttgcgttggcgacagttttacaagatgcgctggcagcaaaagggttaccgcgtgatgccgtgcaattgatcaccgatcctagccgtgccgttgccacccagatgatgcacttaaacggctacattgatgtgctgattccgcgtggcggcaaagggttgattaaagcggtggttgaacaggcaacggttccggtgatcgaaaccggagctggcaattgtcacatttatgttgatgctcatgcccaattgcaaatggcggtggcgattgttgtcaatgccaaggtgcaacggccatctgtctgcaatgcagccgagaagcttttgattcacgctgatgtggcaaatgaacagttgccagtcattgctaaagccttgcaagatcatggcgttgaattacgcggcgatgaacgtgcccgcgccatcgtgccgagtatgcacgctgctaccgctgaagactgggatacggaatacaatgacctgattatggccgttaaggtcgttgactcagaagaagaagccattcaacacatcaatgcgcataatacaaagcacagtgaggcgattatcacagacaattaccaaaatagtcagcagttcttacagcaggtggatgccgccgtggtttacgtgaatgcctcgacccgcttcacggatggctatgaatttggttttggcgccgaaatcggcatcagcacacaaaaattgcatgctcgtgggccaatgggattagccgcactgaccacgattaagtatcaggttttgggcaatgggcagatccggaaaaattgaaagtttattttgaatagcaatggcgttggcacaatctatcgatcacagatagtttgtgtcaacgccattttttacggtctaagcatggagccaatgcttaactgttgtttgatggctaagcaggatcggtatggttaacagcaacgccaacaaaccacaggaaggaaacccccacaggccgccagccatgtccattaaaccaccgacgtataaactgccaatgggcgtagagccttggttgagcagaacgtagacgctcatgatccggccacgcaactcattggggatagagaactgaaaagcagcattggattgattcaagaaaaccatgttgcaaaatccaatgacaaccataaaaatcatcgccaaccaataaacgtgaacaaaaatcatcagcgattgaaccaaggccgtccctaatgccactagaaggtataaatcgcggcgtaggccaaaccgagccagataactcatgaggaacgctgcaatcagtgagccaatccctgttgctgatagcagattggcatagccttgtgcaccacggcctaaaacttcctgcgcatagatggggatgatgacattattgttaaagttcagtgtgcaaataatcatcattaattcggcacttaatttaacgttgtcatggtggacgatgtaagcaagcccttctttgacatcagcaatgatgtggcgcggtgtgtgactggcaacaggatgctgctgatgaatcatcaataaaccaataataatggcaatgtaactcaaggtgtcaactagaaaacacggcgccactcctatggtgaccatgagcaccccggctagggaaggacccgcaatttttgccaaattgaaaatggaagagttcaatgaaataccgttcatgaggtcttttttgccaacaagttcaataacataggattgtcgagttggcgtatcaaaactttgaagaatgccatagcctaaggcaattaccagaatttgccagtattgaacaatttttagaaaagtgatgatcgtcatggcagcacccaagactagaaaaccaaattgggtcatcaaaagaatccgtcgtttggggtagcgatcaatgagcgtaccggcgattaaggtgagtgccatgataggaacaaattgagccgctgcgagcaagccaaccagaaatgcagatttggtcatttgatagaccaaccatgtttgcgttgttcgttggatccaagtgcccatgacagagatacattggccaatccagaagcggcggaaattggttgaccgcagtgaagagaaagttgcaccaaaaatgtgcctatccatgaaaatcatcgccttgtttggagtctattgtttcttatcgttggctttttcagtgaagatgtcaatactgaagcagggcgccttttgcaagtggtatcgacttttcaatcgatgaaagcaacacttttcagtaaaaagaggcggttgacttgtcaatattttgagaacttttttaattaaagtcaaaaaataaaagcgcattcaactgccttttggcgggattgtgacgaaattatgaaaatttatatataattgatcatttatgttgacgataaaactttcggcctgttaaccttagctcaacacataacaagggggaacttaatcatgaagcaggcaaaagaaggcatggtcgttttatgtcgtgcgaatggcaatatggaacatgattttgttggtcgcattcagaaatgctatgaaaattctgcattggtcgaaattcttgattatgcgccgcaggatcaagtaaacgtacaggatttaattggtcgcacagtcattgcattcaatcgcatgaaacgcagtcaaacgacgcagttagcaacaacacaaaatcaagttaaagaaagtgtcgggtagctaacgacgaagttagttgcatggcctctaaaatgaggattacagcatcgagtgctgccgtaaaaagccgcaagatcaaggccaccagcgttgtcaatagcagtttataaacttttttcttagaatagttgaaactgatgcctctagggtgtataaatgcttcttgtgatacaaaaacgtgtgccgactcatggtacaattaataaaggtggtcaagaggaatcatgttatttgcagcacatcttcgtgattatgaagtcgttggtcagtatacggataaatgggggcatcggcacgattcttcccgggtctgtcatcagatgactaagcgagaagcgcgcgacgctatgcagcgctatttgttgcaacatttcagtgattcggttgacttggatgcaccgatcaaagtgaaagtgcaggccatcaagtaagcacttacccgccagcaagttaagcccgcacggcgaatttgctggcgaatgcctttaaggaggtttttctgtgtcacaagaaatcgttattggtgataaagtatcagttcgtaaagcaaaagatgtgccattgagtttcaaaggcacggttgaaaagctctatgccaacgcggcaatgctgacaatcgacagtttttcgcctgatgatgcctcactggttgaagatatgaagaataagacggtcgtgaactacaagcatattaaaaaaggcggcaaagcggttatcccgccagcgcctgaagaaaaacgaccgggtgcacgtcactagcgtgaaatgaaaaggactgtacgccgattgtacagacttttttattttccttagaggttgcgtgagccccaaactggcatggcataatgtcaacttggtatccttaaattaagcaaagaaggaggaaatcatatgacagattatgatgcagcaaaagacaaggttagcggcaaggttaaagaaaccgctggtaaattaactggtgatgaatcaaccgaagctaagggtaaggcccaacagattgctggcgacgtgaaagaaaaacttggcgaagcaaaagataaagttgccgagaagttcaatgacgttgtagataagactaagaaaaaagaggactaaatcgggggatgtagctccgattggtcaaaccagagagaacgccgacagatggcgttctttttttgtaggaacaaagccgcactataatcacttacaaaaaattagcaaaatccctttacttactaattataagtgatacacttatttgtgttctgataagtaagcaattttgggaggctttttacacatgacagttgttaatggttacgaacaaagcgatgcagaaaagaaattgaacattttgaacttgccgtcattggcagatgaagcaaagaagattattcctactggcggttatggttatatcgtcgggggttctgaagatgagtggactttggccgagaatacaaaggcgtttaatcacgctcagattgttcctaaggcattgtccaacattgattctccagatctgtccaccaacttcttgggcattgatctcaagacgccaattatgatggcaccgactgctgcgcaaggtttggctcatagccaaggcgaaaaagatactgcgcggggcgttgcagccgttggcgggttgatggctcagagtacctacagctcaacatccatcgctgatacagccgcggccggcaatggcgcaccgcagttgttccaactgtacatgagtaaggattgggacttcaacaagagcttgctcgatgaggctaagaagtccggtgtgaagggcatcattttgacggttgatgccactgttgatggttatcgtgaagaagatatcattaacaacttccagtttccaattccaatgccgaacttggaaaagtattcagccggtgacggtaaaggcaaaggaattggcgagatttatgcctctgctgctcaaaagatcagtgaagacgatgttcgtcgaattgccgaatacaccgatctgccagtcatcgtcaaaggggttcagtctcctgaagatgctttgcgcgcaattggtgccggtgcagccgcgatttatgtttccaaccatggcggccgtcagttgaacggtggtccggcatccttcgacgttttgccagcgatcgcaaaggcagttaacaagcgcgttccaatcatctttgattccggtgttcggcgcggcagtcacgccttcaaagcgttagcagccggtgctgatctagttgcctttggtcggccagtgatctatggcttggctttgggtgttgcagaaggtgttcaaagcgtgttcgagcagatcgatcacaaacttgaaatcatcatgcaacttgctggcactaagacgattgctgatgtgaagcacgcaccattaacacacttcaactatgctgactaattcagccagaagcgtgctttaaaaatataaaatcatgacctccgcgactttgctgttgcggaggattttttgtctttgtgccatttcaattgcttttaaaggcaatgacaatcagctttatctgctaacgatcccatcaaaaaagccccgctgccatttgaaatggcaacaaggcttagcggcaattaggtcacagcccgatttgacttaatgtgtacatggcattacgaaattcatctcggcgattagcctttttttcgacatcactaggtaattcagtcatgtcaatacgaacaacggcgcgccgcaaaaggctgaccattgttttgtcgttcattttgatgtagaggtgatcggcgtcaaatcgctcaaccgcgtcctcccagacccgggcgttttcgtggtcgctttccacgttgcgcttaatcagcgacttgccatcgacggtgttgaatgtgacatcatatgttgtcatatgaattctcccttcattgatcactttcattatacaacgggtcgttgggatggagaatgaattgccaaagatataaggtattggccagcaaatacgcagttaagcctagcataaatggcaatggcatagccgccgtcatgaagctgtataccccaaaaatcatgagtgaaaaccctaaataaaaccaacgcttgaagccgatgtcgatcttgctggttggataggcgcgcaaatagccaatcaggctaaaatagtaaacagctaaagccaaggtaatcgccgcggcaaaccaacgcggatctaattcccgagtcaaccacaggtggataaacgtgctgatgctaaggatggccgctaataacgggtaatgaagatgaatagctgccaaaccgcctgtttttatctggcggttaaggccgttatcataaactagctgataagccacaaaaagcaatataacaacaaagaaaaacaaaccggcctgcagcgataagccgctataaaccgtatcggccacgccaataaccgcttctccgaaaatcagcaggaccagtagcgagtaacgctcactcaaatgactaaaatccaccggggcagcattgatcgttcgccagaaaagcagcgggacaaagctggcccccacaacgcccaaaaagaagaccgtgaatgacagcgagtatggggttaggaaaggcgatacaagtgccagcgcgccagcaattgttaaggtcagaccaaagattttgggtaaagcagcatgtttttgccgccagatcaggccatattgaatcgcaacactcaaaaacaaaatggcggtgctcaattgaaaggaccattttgttttaacgaaatcaacgttgatggcggtactcaagacgatgacccagaacatattaaaaagagtaaagagactttgggctagttggttgttaaagtaccggttggctaagacagtttggtaagtccaaatcacccagaaaacaagtagcatcatcaaaaactcaccaagcatacgcggagcaataaaaccatgcgtcggcagtgcaagcgcttgcaccatacggccaacggcataggcaaaaattaaatcatagaacagctcgaccatcgtaaccgatttatgcgactgggtcatgagcatccttctttctaaaggcaaagagacaagccttcgccgatctcgtatatatagtagcctatcattttccagcttttccggcaaaaatgcagagcgcgaaaaggcccagttagaagctggaacgtaagcgacctcaagcctaaatggctgggctttgggaggcgcccttaggtggagcccttaggtggaggcttctgggcctgttcgcgtgtttcggtgagaaaatggggatggttcgggttctagttctcttctaatgagcttgttccggaagcccgagctggttagagtggtggggcacaatttcgagctaatgtgaaaggccaacgccgtctcgccgctaggtattagtcaaagcgaagaaaactgcttcgctttgaccattgagtccattgctattccgctggtttacatcaatgaagtagaatgacaaacatgaaactaagcaaagcagcactatttgatgcgtttaccactcgcccgcgcagtctggtatactagttgggttaaggaggccgttttgtggttaaattagtcctgttaaggcatggcgagagcatcgccaatcagaagaatacttataccggctggtcggatgtgggtttaaccgcagagggtaaggcacaggctgagacagctggggaaaaaatcgcgtccacggggatcttgtttgatcatgttcatacgagcgtgctatcgcgggcaatcatgacggcatacatcgtgcaagataagatcggccagaactacctgccgatcacgaaaagttggcggcttaatgagcggcattacggtgccttacgtggtattaacaaggacttgacgcgcaagctgtttggaccggatcaggttgcaagttggcggcggagtttttccgcacatccgccattacttgctaatcctagtcgaacccggcggtaccaccgttatccagccacgatcatcccgcgcggcgagagccttgccgatgcgagtcaacggttgttaccgtattggacagctgaactggcaccgcgccttttgtccgggaaaaatcagctcattgtcgctcacggctctactttgcgcgccttggtgaagtttatggaagacatcagcgatgctggcatcaacaaggtcgaaattggaaatgcgcaaccaattgtttacaccttggatgacaagctaaccattctggataagcaaactttataaaattatggaggctgagccataattcccttgcaagacttgtgattcattaaattccgaataatcgtagaaagtcgctaggctaaaactttttttccgtgccaaactccgcaatctccggccagctggggctggaacgctgtgacggcgcttcgagcccgcaaagcccgcggtctcgaagtcgcctaacaacatcagtgacaaagcccggtcgctgtgttgtttgcacggctgagccccatctggcctacgattgctccgccttggcactacggtctttaaaatcgcaataaataatccatgagaagtcaaaaacgaacggttttccaataacggaaaaccgttcgtttttaatagctgactaagaattatgacccagccactttattttgctagtattcagcctccccaaataagttgccaaacttttcgcgacgaaatatcacgtcatatatcgcaaaaatgttataattaacattaatgaataggaggtggccgtcacgcaactgacccagcgccaaaataaaatcattcagctactgaaagcggaaagtccgatgacaggggaaacgttggcgactaagctcaacattagtttggcgacaattcgcgctgatttacggctgttgacaacaattggaatcttagatgcgcgacctaaagtcggctatgcgtatcaaggcgagaatctgttgcaaatggatagccaaaagttctttcagaccactattgctgctatcttactgccgccgacggagattaaattgacaacatcgatggaagaagccgtcaccaaactgtttttagccgacgttggttcattgtacgtattggatgatgatggtgctttagttggcctcatctcgcgtaaagatttgttacgggcaagctttactaatcgcggtacaacgttaccagcgagcatcgtcatgacccgcatgccgaatgtgattaccgtcaccgctgatacatcgatcatcgcggccagcaaactgctccttaaacacaatgttgattcgctgccggtagtccaaaatgctggcgatacccatgtgattggaaaaattactaaaaaccgaatttttaaatatctcattgaaacccttgtcccataagctgttcgtacattgttgcgagcggcttttttgttgtcattaatgattcaacaaataattaggccaattttaggtgtaaacgcttgcattttgtcttcaaaaataatacattataaatcgaacatatatcacgtcacattaaacgaaaggaagactttatgatgaaacagatttatgcatttgctgaaggcaacatggagatgcgcgcacttttaggtggcaaaggtgctaatttggccgaaatgacgaatcttgatctgccggtgccgccgggattcacgattaccaccgctgcatgccacagctatcaaaccaatcacggtctctcagatgatttgttgcaagaattagatacacacttgacggccttggagcaggcaactggcaagcagctcgatgatcagacatccccgttgctcgtgtcggttcgttccggcgcgccgatttcaatgccggggatgatggatacaatcctaaacatcggcttgaatgatcaaaccgttgtggctttggcaaaactcacgaatgatccgcgatttgcgtatgacagttatcgccgcttgcttgcgatgttcggcaatgtggtctacggcctttcggaaaaagcgtttgatgacgttctaacgaccatgaaacgtgataagggctatgcttcagatttggatctgacaacgactgatttgcaggcaatcattgcatcatttaagcaactgtatgagcaggcaggcaaaacgttcccacaggcgcctaaggatcagatgttagcggcgattgcagccgtctttgagtcatggaataaccacagagccgtgatttatcgtcaggaaaatcaaatccctgaagatcttgggactgcggtgaacattcagaccatggttttcgggaatgctggtgaagattctgggaccggggttgcctttacacgtgatccggcaactggcgaacgcgccttgttcggcgaatatctattgaacgcacaaggtgaggatgtggtttccggtgtgcggacgccgcagccagtcgccgttttgcaggcacaaatgccagcagtttatgatcagctggcaaccatcgctacgaaactggagcaacattatcgtgatatgcaggatttggagttcacaatcgaacacggtcatttttatctgttgcaggcgcgtaatgggaaaagaacgccagccgcggcggtgaaaatcgcggttgatttagttaatgaaggactgatcaatcagcatgaggctattctgcgggtggcacctaaatcgatcagtgacatgctgcatccggaatttgatcctgaagtgctggccgcgcatactgttttggcaactggtttgccagcttcaccgggagcggcttctggtgaagtttacttcactgccgctgatgccaaaacggcgcacgatgccggccatcaagttattttgatgcggcaagatacctcgcctgaagatattgaaggtatgattgtcagtcaggcaattgtgacggcgcgtggcgggatgacgtcacatgcagcggttgtagctcgcggcatgggtgcgactggggttgtcggcatgcacgcactaagcgttgatgaacacgccaaaaccgctacggttgggtcaaccgttctccacgaaggcgattgggtatcggttgacggtaccactggcaatttgtatcgtggtcaaatcaccacaacggcggcgatggtcaaagaaagcttagccactttattgacgtgggcaaaagatgcaagtcgcatggccgtgtttaccaatgcagatactcctaaggatttggagcaagcactggcatttggtgctgatggcatcggcttaacccggactgaacacatgtttttccaaccagaacgactgttgcagatgcgccgattgattttggccaaagatgcggctggtcgcaagacgccgctacaagcgctagaaaaaatgcaggagcaggatttttacgagctatatcggcttgcgaatggtaaagcagtgacgattcgcctcttggatcctccgctgcatgagttcttgccacatgatagccgagaaatcagtgaagttgcgcaagatcttggcctggagcaaaatcagctacgcgaacggatggccgccctcaaggaagtcaatccaatgttggggcatcgtggtgatcgattagctgtgaccttcccggatatttatgagatgcaggttcgggccatgatgcatgcggtattccggcttgccgacgaaggcatgaaggtcaccccgcacatcatgattccactgaccaactccgagactgaattgatctgggttcggaaattggtgacagatcaaatcgagcaactagtcgcaacaaaagggatcaaagtcgattacgaagtcggcaccatgatcgaaaccccacgtgcttgcatcacggccgataagattgcgaatgctgccgatttcttcagttttgggactaatgacctgacgcagttgacctttggctattcccgtgatgatgttggctcgttcttgccggactatttgagtaaaggcattttaccagcagatccattccaaaccgttgatacggaaggtgttggggccttcatgcagatggctgtcgagaaaggccgggcgacaaagccgcagctggccattggcgtctgtggtgaagtcggtggcgatcctgactctgtgaccttctttaaccaaattggcgtcagctacgtttcgtgctcgccatatcgggtgccggttgctcgtctcgctgctgctcaggcaacgttgcgtgcagaaaaacagacgaagcagccttcataaagccgcttgcagtaaaaagtttcgaaaaagttcgattttctggtccacatgacaagtttacaaaaaaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgagctagacaacatgacactcgcaacgctccaaacgttgctttcagaccggccagatgcgatttcatgtccccaataccgaggtgaataatccaggttaaagtaagtatgttgacgccttgttagcatcttgtgtataattaagtcgttgaaaagaggccatcgggtggcggcccgatgacctcaacgcggttcagatgactatttgggtaaaagctaatccttgcggttagcttttttgattatcgcatacgctttggcgatactggtaaccagtatgcttagcgcgatgataaccgacgccacatccagcgcggcgaacccctttcgtctcctgattttagcatggccctcacctccgcgtctcaagaatgttgaggggtgtgtgccatccaatccgctagacgaagaaaacagggtaattagtcctctctctaagcctacggtctgtctatggatttaaatgtatgtggtcaataagtattctttgattgaaagttgcgtttgctggctttcttaaaaaacgaaaaattgttttgattaaattttgttcagtgacgatttatttatatgtcgcttcttgcaaaacaaagaaaaagccacgaatcgtgcaattagtttagattgcatgattcgtggctttttgtatttaaaaaacatcactcggcaacctcaccaagcaaaatcttccatatcctcagcattcagaattcttacctgcttacctgaacgttcaatgagtttttcctcggcgagtcgtttcaaagtgcgcgagaccgtttccggcgttgttccgagataatcggccaattgtgtccatgccatcgggaccgtgacggtgtcttggcccgccgcggtacgcaagtccagtaggtagtgggtgagccgaacgttgatcgaatcgttacccaaatagccggcctgtttttccagcgcctgcattttacgggcgttttcagtcaggagttggagactgatttgcggctgcttgagaagcaattgttgaaagtcagtggcactgatggtgcagacagttgccgccgtcagggtttcggtatagacattcggattagcgatattgagtaagccggcttcaccttcatactcaccaataccatcaacccgtagtagctgttccttgccattggtggccaactggtaagttttgagtttgccgtgcgcaaccaccaacaaatgggccgccgtatcagggctgatcaaaacagttcctttttcaacctggcgttcgtgcgtcaacgcgtcaatggcggcacgcgcctcatcatttaaatttttgaataacggcactaccgccgtacaactatgcgccatgttgccgcctcctaaacgcgcctgctcacgctctgtcaacaagcttgatcaatcgtcatcttcatcctcgtcaagcaatgcccgccccgccgtcacttggcggccaagtcgagtttgcaagcgcagaatgctttgttcatgccagcgctgcaattgtaacatatctgctgccaatacagccttgttctccttgttggccagcggaatcgcccgactgacaaacaactggcaggtatcgatatcattgacaacggcgtccaatttcatatcattcgtccaaaaacgaaacgccgggtcttccttgagcatcgtgtattcaccaaactccgctgtcgttgtcggaaaatcttcgccttgggcagctaaatcagccacaaggtcgtcaaaatggtcttgtgcttgttgcattagctgatctaacagttgccgatcgatttcactggccacacctcgtaaggtcacccgaaactgcgtcagcttgcggatcagcacctgcaagttcgccaacacgtggccactcatcgcaccagcagttggcacatgatggtcatggtcagcctgtttagcagcagctgcttgttgttctttaacttgatcagcggtaatacttttcattcctgtcgttacactcatgttcttctcctcttaaccgcgcttatttatttttaaaagcgttctatagcatcgaaacctcctccataaggaccttgtgggtaattggctcagccaccacacccaaggctgcttatgctccggtttctaaccgcgccagttctcgctctatgcttcttgactgcgcacgttcacaacggtataacccaagtccgtgatcgtctttttcaaaacatcggcgttggtcacgcttggatcaatctgagccttgaccttgctactgttaaacaaggctttcactgttttgacaccggcttgctggcctaatgcgccttcaattttctgcaagcaacttgggcaggttaaaccatctaattgataaactaattttgtcatgttaaaaatcctttcttgtttatttaccttcattattaacagtttgtgctgcggcgtccttgatcgtcgtcaagttttgtaacttccggggggtgtgccgtaaccgtaaggcattcgcgatgaccaacagaatcgaaatttcgtggaacagcatcccgctggccatatcaactaacccaatgagcaagccgcttaacagtaaagcaacagttccgatcgcaatgacaagattctgtttaatattgttgtccatccgtttagccagatcgaaaagaacgccgagattcgtcaggcgactgctggttaaaatgacatcagcagtatcaatggccacatccatccctgagcccatggctaccccaacatctgcttgcgccagtgcaggcccgtcgttgatcccgtcaccgacaaacatcaccttttcaccgcgcgcttgcgccgttttgatcgccgtgaccttgtcgactggcaataagccgccgtgggtctggctcagtggcaaatccgccatcatgtgttcaaccgccgcctgcgagtcgcctgaaagcacaaccgtctttttaccgttatcttgaagagtcgccaacatgcctggggtatcggtccgcaactgatcgcgtaagccgtaaactgcagcaagtttgccgtcaatcgtcgccacgaccaacgaagcaccgcttttaattacgttttgaatagcggcttgctgagcggtggtcagtggctgcgtcagactcttttggttcccaatactaacggtatggccagccacttgcgcctgcacgccaatgccccgcgtgactttcacgtcggtcacagccggtgttgtttgcggctttaggtaggcgaccaatgcctgccccaacggatgcgccgttgcttgctcgaccgccgccaccagctcggcaactttggcgtcatcgttcgcccaatattgtgccgttgcaacgctgattttgccttgggttaaggtgccggttttatcaaacataaccgtgtcaatctgatccaatttggtggccacatccccgcctttgatcaaaatgccgtgcttcgcgccaaagcctaagccgacaacattgctgacgggggcgccaatcaccaatgcacccgggcagcctaataccaaaatcgtaatggctagtcggacattttggctgatcaaaccaacgagcaaagcaatgatcaataccagcggcgtataccaccgcgcaaacttctggataaaagtggcgactggtgactgtgcgtcctgagcatcttcaatcaaatcaatgatctgttgataaaccgtgttgtagccggttttctcaacttcaatagccaccgtaccatcactcacctgcgtgccggaataaaccgttgcgccggcctgcttgctttttgcatccggctcaccagtgatcgcggcttcaacaacattcgcctgcccactgatcactttgccatcagctggcaccgtttcgccggccagtacacggacttgatccccaaccgccaagtcaccaaccggaatcatggtgccatccagtcgccgcgcggttttcggtgccgcagccgccaagccttgaatcgccgaacgcgtcttcgccaaactgcgctgctctaaccagtcaccgaataaaaatagaaaactgaccacagcactttcaaccggctcaccaatcaacaccgcgccaaccagggcaatcgtcaccagcaactcaatactaatctgcttataccgtagcgccgccaatgcattgatcgcaatcggcaagcccgccaccaaactcgccaacaccagcacccatgcctgactaaaaatcagaccgcctgctgtcagcacaccgccagcaatcatcgcttcttgtttatgcgtctgaataaaatgcatcgctaatccctccatttgagaccagtgtaccgagggatgaagaatgctgccttgacggtgatcaactttatggatttgccacacgattattctgcaaccagcatgtttatgacgaaaaaagctgaaaacacgacgtttatttttaaactgacgaagcatcatcagtttcagttacaattaatttgcttggtcttgaaggcatcttggttgttgggggcttaatcgctgtcctatcgaatttcctgtaaggtttcattggtatacataatagatatttgagtagtggtcttctagtatgaccaatcctcagccatgatgatgcgttaattggaagataatactaaaatgaatcgcgataaaaaagtttggggtgcattgctgatagtgctctttaaccgtagcatcttcagatatatcgaagctctctggacgaacaatatgatattcgggaatgtgctcaaggggttaagcgctatcgtaacctgcgcggcaatctatgtattaataagatgtttgcatgaaaagtatgcgtctaatccaaagcttcatgccagcaagcatcagtagcgacaagactatcaccagcgcatgatgctacctgtttcttaagcttctacaaattggagaaatgtttgaataaactaaagcagctagttatcgggatcattctatttataccattcttattccttgcctctggagtctccctagttgactgcttttttgaaggtgtcttattaaactggctatttattgttattgcggccagtatctcaataccatcactgctattcattgatcgtcatataaagccttcttcaacgcaacaacttaatcagccactcaaagcacgttatttttatatggcggtcatttggaccattttcattgttgttttaacaataacactcaataatctgccatttctcccggctccaactgacaatgtgttgcagtcgtcaactgcaaaagtattaactggcccatcgcgctggccaatgattatctctctgtgtttcttaaccccgatatgcgaggaactcggatttagaggcgttatccaagattatttaacaaatatttttggctattggccatcagttctcataacctcgctcatttttgtttctctccacggattggagattgttgctgcattgtgcttacttctttgtgcaattggttttagtcttctcaatcgggcttctggaacaataaaaacaagcattgtatcacacatgacttataacattatcgtgacaatactagtcatgctgcgattgtgaatctcggaaaagtaaaaagaaacttccgtcgcagacacacttgaagtcagtctcttgggaacgccggttgcttacgggaacgcggttaggccataattcacagccaccaaataaaggacaaacaatttctaaaagtgcggaaattgtttgtcctttcatttgggtagtctattggaattttaaagataccagtgccaaggcggagcaatcgtaggccagatggggctcagccgtgcaaacaacacagcgaccgggcttggagctgatgttgttaggcgacttcgaggctggtttttgggctcgaagcgccgtctccgctctagctcctcatcgccagccccatctggccggagattgcggagtttggcacggcaaaggattctttagcttaaatctttcccagattattcggaatctaatgaatcatcagtccaatacgggaattatgacccatcctttttccgagaggtggatttttttagttccgctaaatcctctgatcactttaaatgagctagctaacaaaacactcctgcaaacacccgttcccaaatatattaaaatctgattaaccccatgtggtaatatagaagtattcaaataaaggaggacgcgtcagatgccagaagaacaaccaatggtcctatttaaggacgttgagaaagtttatcgaggcggaaatgtcgcggtcgaacatatcaaccttgagatccataagggggattttgtctgtctcatcgggacgtctggttccgggaagacaacgaccatgcggatgatcaaccgaatgctggagcccagcggcggccagatcctgtttaacggcaaagacattcataaaatcgatgccgttaaactacgtcggcaaatcggttatgtcatccagaatatcggcctcatgccacacatgacgatctatgaaaatatcaccatcgtgccaaagctgttaaagtggcccgaagaaaaacgccgggaaaaagccaaggaactgctcgatttagttgaacttccagaagactatcttgatcgctatccttccgaactttctggcggtcaacaacagcgtatcggggttatccgcgcgttagcagccaatcaggatctgattctgatggacgaaccatatggcgccttggaccccatcactcgtgaagctttgcaggaactgattaagaacttgcaagaaaaactcggtaaaaccgtggtttttgtcacccatgacatggacgaagctttgaaactcgcaactaaaatcgtggtcatggatcatgggcatattattcaaaactcgacaccgacagaactcttaacccatccggccaacaaattcgtcgaaaatcttgtcgggcaagaccgacttgttcaagcgcgggccgatgtcaccaccgttgaacaaatcatgcttaaaaacccagccgccatcacaccaggcaaatctttggctgaagcgattctgctgatgcgcaaacgccgcgttgatacgctgctggtcacagatgacgagaatcatcttaaaggtttcattgatcttgaatcccttgagacgcgttatcaaagtgccactagtgttggcgatatcattaaaaccagtattttctacgtgaataaagactcactgttgcgtgataccgctgatcgcattctcaaacgtgggcttaaatatgtccctgttgtcgatcattataagaaacttgtcggcattgtcacccgagcggccttggtcgatgttgtttacgacactatctggggcgacaacgataacaagtctgacgataacgacagtgaccaagcggatagcgataccgaaaataccgcttcagcaactgctgcttcggaagcgcctgctaacagtgacacgcctaaggaggtgtgaccatgttcgcatttctaaacgcacatggcagcgagctaatcaccaagacttgggagcagctctacatttccgccatcgcactgggtcttggcgtgctggtagccgtaccgctgggcattgtgctgacacgttttcctaaaacggcgaaagttgtcatcggtctagccagcatgttacaaacggtgccatcgctggcgttgttggccttaatgattccaatttttgggatcggcaagttgccggccattgtagcgctgttcatctactcgctgctaccgattctgcgtaatacttatattggcatggaagatgtcgatccggttttgattgatgctgctaaaggcatgggcatgacggccttgcaatcaattcggcaagtcgaagtgccgctggcgatgccggtcatcatggccggtgtgcgcctatccgccatttatgtcatcgcttgggcaaccctcgcatcgtacatcggtgctggcggccttggagatctcattttcaacggcttgaacctcttccagccggacttaatcattggcgggacgattccggttaccatcttggcactcttggttgattggctgctgggccggctagaacatcggctgaccccagtaagcgaacaggcctaggaggtggcgagatgaagacattcagaaaaatgctcctatcgctgttcctcatccctgtcttgctattaggcggctgcggctttcccggactgggcggctctggtaatgacggtactgtgcggatcgcttcgcaaaccagtactgaatcgcagatcatggcaaatatcattgccgaactcattaatcatgaactcggctacaaaacgactttggtcaacaacctgggttctggtaccgtggttcatcaagcgatgattcgtaacgatgctgacattagtgctactcgttacactgggaccgacattaccggtaccttaggcatgaatcccgtcaaggatcctgccgaagctacggcgattgttaagcgcgaattcaaaaagcgttacgaccagacttggtacccgtcttatggtttttccgacacttatgctttcatggtgacccaacaggaagccaaaaaggacggtttgagcaccatttccgatttgaagaaagtcgcttcgcgttacaacgcgggcgtagattccagttggatgaaccgcaaaggcgacggttatagcgacttcaccaaaatgtatgggttcgatttcaaacgagtctacccgatgcagatcggactggtttacgacgcggtcgaagccaacaagatgcagacggtcttaggttactcaacagacggccgcattcgcagttacaacttgaaagtgctgaaggatgacaaaaagttcttcccaccttatcaatgttcactcgtcgtcaacaacagctttttgaaaaaatacccgaaactcaagccgctgttacatcggttagatggcaaaatcaacctgaagacgatgcaagagctgaattatcaagtcgatgatcaactgcttgaaccgaacgtggtcgcgcaaaagtttcttgccaaacacaactatttcaaaggaagtgacgactaatggccaacatggatacctggcagcaattctggtactatcttgccaataatggctcgtatgtgctgagtcagtttgctcgccattttctgatctcaatttatggggtgttaatcgccgccatcatagggattccgatcgggctggcaattgcgcggcaccggacattaagtagcacggtgattggcatcgctaacgtcattcagacaattcctagtctggcgatgttatcgatcatcatgcttggcctcgggctgggtgtgaataccgtcatcgtgactgttttcctctactcgctgctgccgatcatcaagaatacttacacaggcatgcaaaatgtcgacaagaacttgatggatgcggctaaaggcatgggcatgacccgttggcaatcgctgtacatggttgaaattcctttgagcatgtctgtcattatggccggcattcgcaacgcgctggtcgtggccattgggatcaccgccattggtgccttcgtcggtgccggtggtctgggcgacatcattgttcgcggcaccaacgcaaccaacggcggcgccatcatccttgccggcgcattgccaaccgcgttaatggcgatcatctctgatttggtactgggcttcttggagcgccgcttggaaccaaaaggcaaagcagaatcttaaaatcgtcatgaaccttatttaaccctaaagacggccattgctggtcgtctttttttacggcccttaaaggttcctttagcaaaaagccatgttttcatcgtcctttttcaacaaaaccgccactgagtcggtacgaatccgtctcatcccttcggtaagcttttgctattggctgttatgaaagcagtcaaatgatcgaagggagtcttacttatgagtatcacttttttggccatcgccgccagcctcttaacagccgggaatccgcaaccggccaaaccgtcgacgtctgccgttcccatctcgaccagtcaggtccaaccgctggcagctccaacccctgattcttggcaggcggccatcacgccacaccatgccacaccagtgcacgaggaacctgccagcttaccggaacaaaatctggatcagaaagtcaaaacttcacgggtaaaaccgagccgttattcaaagtgagtctcgttaagaacatcgtgacagtctgttgtaaaaattaacctagttacctttccttccaccatcaagattttgatggtggttttttttgaaaatgatagccacctgccacctttgtattgcttcttttatagacattgtgccagttacaacatcgtagacgctccctgttaattttcaatatgctcttgacaagaatattcacaacttctaatatatgcgaatgaacgttcattccggaggagaaaaaatgaaacccatcgccaccccagatccaatcatcgcccaagcagtcaagctgtttgccgaacgcggctacgcggaaaccaatttaccgtcaatcgccaaagctgccaatgtagcggttggcacaatttatcgtcactttaagggtaaagaggatatccttaacaccgcgtttactgacatcatggattattttcacgactcactggctgacgctgccaattgcaacgtcagtgatcccgaatcaactttcagccacctctttgatgccgctgcactgaccatgcaacattacccaactgaactgcattttattgaacaaaatgtgtttaatgaagcgctacgcccagagagtcgtgctgctcgcgaccgtgttaccacattgattagcaatatgctgatggaaggtcaggaacacggtgtcattgtgaaagctgatgttcgcacccagttagctattttatacggcagcatcgtcagcatgattgacatcgtttgggtccaacaacaacttcaaggccatgtgcccgatcaagatcagttagcccttgagctaaaaaatcagatctggaacggcttaacctgtgaaaggagtatctttcaatgaaaaatcttcgtcatcgtcacataccggcccttattttctggctaatcgtcatcatcatgactttaatcaccatgccagatgtttccggcatcgtccgagacaaaggcgccttatcgctgccgaaaaacgaagagagtcaaattgccgcaaacattgaaaagaaggccaacaataatcagaaggttcgctcttatgcactggttttcaacaatggtgacaaaaaactgactgcctcgcaaaaacaagccattcatcaaactctcaagaaccttaagagtaccggtgctgtcaaaattatcaacgtcacacaagcatctgacaacgccgaaactaagaaacagctagacgccaaagacggtacgactcagatggcgttggtcgatgtgaaagcccaagggcaagtcggaccgcaaacgcgcaatttagaaaaacaaatcaaaactagcaacgtcaaaacctatgtaactggcagtgatgtcttgaacgacgactttgcgaccgtcactgaaaaagggattcagaaaacagaaatcattgcggcaatcttcattttcattgtgctcatcattgtcttccgttccccgatcgtcccgctcgtgtcgctgctcaccgttgccatttccttcatgacttccttgaacatcatcatgaatttggcggacaagtttaactttccaatctcaaactttactcaagtcttcctagtggttgtccttttcggaattggaaccgattataatattttgctatacgacgacttcaaagcagccctttcacaaggcattccacgaacgaaagctgccggggttgccagacgttttggtgggcgaacgatcctgtactctggcctctcagttctaatcggcttctccgtgctcggccttgccaatttcaagttctatcgttccgcagttggcgtggccattggtgttttgatcctcttgaccgtgctgctcacgctcaacatgttcttcatggccactttaggcgaaaagctcttttggccaagtaagaatctcaacggtcatagcaccagccgactgtggcacggcctgtccaaaatgggcatcgctcgaccgctcatcacactcgggatcattggcatcatcgcagtgccgtttttgctgaatgccaaccaaaccttgaatttcaacaacgcggatgaactgccggaaacgttacaatccaaggtcggttataagctgattcaggatcattattcaaaaggtatggcctcaccaacaaccatctatattcaaagtaagcaaccgttgaatacacaaacggttcttggtacgattgatgacctcacaacctacctgcaaaaggagaacggcgttaagacagttgcctctgtgacacaaccaggcggcggtcagattaagtcgctctatctcgacaatcaactccaaacgattaatgcgggcctgacagacagcgtgaaagggttgaagcaggtgcaagcaggccttagctcagccaatacgcaaattacaaatgctgatgtcgccggcagcacgcaacaagtgcagacccttgctaatggcaccaacaccctttcatccggcgcctccagtcttaacagcgggatcggccagtatacttccggcgttgcatcgttaaacaccgggattggccaattaagcagccagctgccggccctgagttcaggggtgaacaccttaagcacgagttcgacccaattagctaagggcatggatcagcttagcgggaatagtacgctactcgccagcgggatgaatcaacttagcgacaaatctggtgagttgactagcgggatgaacaagctcgccagccaagttcagaacttgaccggcagtgctcagcaaatcgttaccttaattaaccaacttcccaatggcagtcaactgacacagtcaattctagaagaaatcgccaagttttcaggtggtgtgcaacagctgacgaacggtaccagttcgcttggcgatggcatcaaaacgctgaacaatggtacgacagccttaaacagcggcatcagtacgctcaccagtggcacccaccaactgagtagtgggattggttccttaaacagccaagtaccgagtcttgtttccggtgtcaaccaactcaacacggggtcctcacagctcgccgggcaaaatggcaccctcaatagtggcgcggcacaagttgccagtggtgccgatcagatcaataccggtgtccaaaccctgaacacaaaagtgaaggcaatctccgaacaagtcaccaccatgcaaagcggcttaacctcggcagacaaagcactcggcacgattgcagacggcagcaccagcatgaaacaatacctgaccgagctgcaaaagtcgtatctggggaagaagttctatatccctaacgccactttaaagagtaaaaccttcaagcctgcgttaacgacctacatgtctgatggcaacaagattaccaaattgaccgttgttctaaagggagatcccagcacagatgctgccgccaaacagatcgaagcgattaaaactgacatgacggccaaattaaagcacacgccgctagccgatgcaacagtcgcggttggtggccaaacttcacaaaccgccgacctgcaaaaactggctaatggcgactttgaacgaaccgccgcgatcatgattatcggtatcggcatcgccctcattttcgtcacccggtccttgattcaacctatcagcattatctcaacgttgctgttggcctacgtcacctcgttaggcctcaccaaactgttctcaacttacgtgcttggtcgcgacatgctgacgtggaatacaccgttcttcaccttcatcatgctcgttgccctcggcgttgactacagtatcttcctcatggtgcgctaccgtgataacgccctcgaaggcggcaccatgacgcatcggattgccaaagccgctagcgtcatcggtgcggttgtcatctccgctgccatcatcctaagtggtacctttgccgcgatgatcccatccggcattacaaccctgattcaggtcgcgctggccgtcatcatcggcctgatcttcctcgtcttcctgctcccactggtcatgtccagtgtcatcagcctgactgacaagcagatgaacaaaaataatcatccgcaaggccccggcccacatgacgacaatgatcatgcgtcaccaaaaagccctaaaacaccaacgcctaatggcccaaactcaagccattcagcaacaccggcggaaccgcgcacgtcacagaaaccgcgtgttcatttagcggctgtcccacctgattcaaaaaaataaacgggttgcacgcacactctctccgttgagacctaacacctgtagtttccaagactgcaggtgtttttgtatctgtttagaaagctatatgactcggttgttgccatgaatctgatgctgttataagccgaggccatctcgacagtggtttaataaagataacactaggggatgtcgatcatgcgctcaaacaaatcaggcaaactactatcattaaccatacttttcatttttgccttttttctgctttctgttgtgtggaccttgcgctcagatacaaagatagcaagaattgtccctctcatccttgtcctcattttgactatcttaagcttcttacactacgcacccgctccaaaaacaaaacagcaaccgttgttcgtcccaaaaaagtttggcattggcattagtgttaaccccaataacccaacaggacggttattctggtatctcgttttcacagttatgacgatcctgatcatagtggtggctttcagtaactaacggaaccatttcttagcatccaaattgtttattaagcagttatatgtagactgtactttgctttaaatgaaaccgtttgcctttgcatcatttttttgaatctgctatcgtcagcagtgacctgttgatacatgatccatgtgtatcaggttaaatgatagaaatgaaggcactcccatgacaacttcaccagtttcacatcgcacgcaattggctattttatcagcaggattactgacgtttgtcggtattctggttgagacttccatgaacgttacctttccaacgcttatcaaaacgctgcatgtttcattgtcgacagtgcaatggctcacatcaggttatttgctgatggttaccttggtcatgagcacaaccgcttttttattgcgacgatttgatacacggcgcttgtttcgaactgccattctttgcagcctggccggaaccttattgtgtatctgggcaccgagttttccaattttgtttgctggccgtttgttgcaggccctggcaactggggtctcgaccccgttgatgtttcatttgattctgaccatgatcccgcaagtccacctcgggatttacgtggggatggccagtgttgtgacgtcactggcccctgcgcttgggccaacttatggcggtttactgacatattatgcctcatggcggatgattttttggctggtactgccagttatcctgctcgtctggtccttgggcgaagccacgattcgcgttaaagcgcagacgacgactgattgttttgactttctaggtttgctgctgcttggacttggtctgttctcactcatcgaagtgctggatcaattcacagcatctgggctgactgctggcttttggggctatgtcgcggctttggctgtcgctattgttgggatgagctatcacctaaaacatacagccacaccgctgcttaacttttcgcttttcaaaaaggctggtattcgggcacgcgccattaacttctttattttacaattcagcaatattggcattgctttcgttattccaattttcgccgaaaacgtcctgcataccaatgcttctgtggccggcctgattttgctgcccggttcattgatcggtgcggcggtttcacccattggcggcgccttgtatgatcggttcggcgcacgtcgcctgctcctgacaagtaataccgccatgttcgtcggggcgctatcttgctcggcatcctcacccaccagctgagcatccccttgattgtcggcttttatatcattttccgcatgggcttcaacctcggcttcggcaacaccatgtcagacgccagcaccatggtaaccggctcagccaaagcagacatcaacgccttgttcaataccattcagcaatacgccggctcactaggcactgccagcttatcagccatcatcaccttgcaacaccgcctctctccagtgggcgccgacgcgacagggagtcaaatcgacttcatcgtgctcgcggtacttgctgtgttgacctttgttgtgcaatggcggttgcgggcggatcagcagtaagcagcgtctaaaagagcgtctaggatgttcgcgccgttatgatgccataaagaccctacttgtaagaaactgtctgacaatttttcattcagcgaaacagaaaaagctctttgggatgacgttttttcattcaaacaattaggaaactacggttgggtcgcaagcgaataatctacactcttagtttccttgttaaagagtgaaaaccaaatagcaacagaaattcccgagaaatcgggaattttttggtacaaaacaaaaacccgggacattgaaagaatcagttccgagtactttttgaaacatttgttcgatcaagtctggcaacatgccaagtcatgcgcctaaattgatcacttgatcgtatgcccccttcaactgcgcatcaaggtgatgactcacctcaatcaaggtcatatcagggtcattcaaaaattgcttggtaacttgtctagcagtttctgcgtctaacgcagatgtgccttcgtcaacaaatgcaattggttttggtgagtagaaaaatcttgctaatgctaagcgttgtttttgaccgccagacaaattttggccgttctcttcaatcatttgatctgatgacttaacgaaatctacctttgcctttaatagtgcctgttgcaaactgtccccagatttttgcttgtttgcccaaagcgacgtgttgttcgccactgaatcattgaataaatagacattttgatcaacgtattgagaaatttttgttaatgctgtcattgtcatcgtccgcaaatcttggtcgtcaatataaacatgtccagtataatccgtgatttgaccatctaaaattttcaataaggtactcttcccgacaccgcttcgaccaacgatcgcatattttcctcctcgttcaaatgtgaggttcaagtgatcaagtatctcgttcccattaatcgaatagctaagatcaaccacctttaaagcgtgctgaaatgctggttcttgggtgctttcgtttgccattgccgacttagaagatccttgaatgactttatcaaataatgggtgcgttgctttaatctgcacgacatcgttgctaaggctagacaaagaattaaaaatactagcagcaatactgccggttgaactaattgccccaagtggaatagcaccaaggatggccaaaatactggtcataatatcgaccatgacctgacagaagatacttaaagccctagattgcataattaaagttaccacccagaaaatgtgaaaaaagacctgtccgttcttgctaaaatggtgtttgcataacataccatctagagagaaggacaggtcccatggccattataaccttaattgaacgatctcagatagagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggaagtatcttggcaatgactttgcttcttgctgccccttgccaaagtcctccaacaaatggtgctagataaaaagcgatcgtcgccagtaaaatcaagataactatgatgatacttattatcttatccatttgtatttcctcttccttttgcacaaatagactaatttgaaatcgatctttgactaagacaagaaaaagtgagcactaccaaggtgttagttatattgaacagttgcgataggagctaaccgtctttgtccaatattaggctgggtgaatgtaattagtgctgagacacaaggataatcctattgcagcgcctgcaacagttgtaaatggatttaatccagctgcccctgctaccgctcccccgatcgtggacacaatacacccactaggtttattgcgtcgcttggctcctccttggattaagaccaaatcatgctgttttaaagtaatgcccacttctttacttatcattgcatcccatctcctaagcatttaatagctgacccaaccgctcctaagtttccaccaactacggcgccgccgattatcccaaaaggaccaccagctaggccagtaatcgttcctgatccaataccagccgtgatgccagtaacaaatgtagcagcacaatcaaatttctttttcccacctgaaacccctgacaactgaaaatcgtcaagctggcgataattataagacataattttccttctttcttcaaaaagcaacaagctattttgtgtaaggtcgactttactgtctttaacatacattaattatttgtgtaaaatgccaaaattttttaaacgtaggaaatttccagtttaacgtcgtctttacacttttattgttcagttgcgctttaaaagtcaaaaattcttaacgtttaaatctccttgcttggtaaaaacttcaattttttgcaaaaaaaatcgtctcagcaatttgagacaattttttcatatcatcaacttacggcaagtcattccccgccgcaaagtaaatgtcataccattcctgtcgggtcaacgtgatgtccgcgccttccgcactttccttgatatgttcaggattcatagagccgagaatcacttgcacaccgactggatggcgtaatagccaagcgactgcgattgcatttttattggtatggtagtggtcagcgactttctgcagttcatcattcaacgccttaaacttcgggctatcgatgaaggtaccttcaaacatgccgtattggaatggcgaccaggcttgtaaggtcatgtgtttgcgttgcaagtatggtagcaggctgccgtcatgatcgacagaagccgcgtcggccatgttggtgtgcatccccgcattgaccataccagtgtgcgcaacggagaactgaacttggtcgatcagcaaaggctgccgaatgccgctttcaagcaacgcaagttgttcagggttaaagttggagacgccaaaatgccgaaccttgccgctttgttccaatgcatcaaaggccgccgcaacgtcatcgacttccattaacggatctggccgatgcagcaagaccgaatcaaggtaatcaacctgcaaccgtttcaaaatgtgatcaaccgctgacagtaagtgatcttttgaaaagtcgtaccgtttgccgaataccaaactgccatgagagcgttttggatcaacgacgatcccgactttcgattgaatgaataactgatcgcgggaaacgctggcttgcttcaaggcttcaccaaaaacttcttcggatttgccttggccataaatgtcggccgagtcgataaagttgatgccgtcattgtacgcactatccagcacattggccgctttgtcgggggccagcacattcatccgcatgatgcccaaggccacacttgacgcctgccaattgaatccgcctaatcgaacttgtttcataaacacaaaactcccttcgatacgtcatttcaaattatgttactgacgacaagttaagtgtagcccctaaagtccacttgaggtcaagccaatattagaatttcaataaaacagcttgcatggtgctgagctgcgcggtaggttaagctgtgtctgttacttattttttcttagcaggataagcccataatggaggccgtgattttgacagttaaagataaagtggttgtaatcacaggtgcatcgagcgggattggcgcggcaacggtacaagtgttggccgaggctggtgcaaaactagtcatcggtgcgcggcgcacagaacggttggctgaattggcggccagctttacggacggtcaggtgctttatcaacaaaccgatgtgaccgaccagcagcaagtgaaagcgctgattgatttggcgttggataagtttggtcatgtggatgttttgtataacaacgctggcctgatgccactttctgaaatggccgaactcaaagtcaacgaatgggaacgtatgattgacgtcaacattaaaggcgtcttgtatgggatcgccgcggttttaccgcctatgattgctcaacacagtggccaaattatcacaacagactcggtcgccggtcacattgttcaccctggaaccgccgtttactccggtaccaagtgggctatccaggcgatcatggacggcctgcgacaagaacaagcggctaatcatattaaaacgaccatgatctcgcccggtgccgtgaatactgagcttttcagcacaattaccgatcctaagcgccgtgaagctgttgaagccgatgaaaaaaacaatggcctcagcgcctcggatgttgccaaggcagttttgtatgccattgatcaaccggccaatgttgccatcaatgaagtgctcttacggccagtcacgcaagaacgttaattttcgtctaaaggagtgtgattgcatgtcgggttatcattttttaaaacggttcaccttcaagcaccaaaccatcacgttgaaaaatcgcattgtcattccgccgatgacaacgcgcctgtcgtttgaagacggcactgtgacgcgggacgaaatcaggtattaccagcagcgggccggtggcgtcggcatgtttattaccggtaccgccaatgtcaatgcgcttggcaaaggattcgaaggtgagctaagtgtcgctgatgatcgattcatccccggtttgagcaaactcgccgctgcgatgaaaacaggcggcaccaaggctattttgcaaatcttcagcgctggccgcatgagcaatagcaagattctgcgcggtgagcagccagtcagtgccagtgcggttgctgcgccacgggagggttacgaaacaccgcgcgcattgacatcggcagaaatcgaggccactattcacgattttggtcaggctgtgcgccgcgccatccttgctggttttgatggcatcgaactgcatggtgccaacacctgtctgatacagcaattctattcgccaaactctaatcgccgaaccgatgaatggggcggtgaccgcgataagcggatgcgttttccgttggcagtcgttcatgaagcagaaaaagtgattgccacaattgctgaccggccatttttgttaggctaccgcatttcgccggaagagttggaacagcctggcattaccttggatgataccttggccttaatcgacgctttgaaacaaaccaagattgattacctgcatgtctcccaaagtgacgtttggcgaacctcattgcgcaaccctgaggacacagccatcatgaatgaacaaattcgtgaccacgtcgccggtgcttttccagtgattgtggttggtggtctgaaaacgccagccgatgctgagaaagcggcagattcctttgacttggtcgccattggtcacgaaatgattcgcgagccgcactgggttcagaaggtcttagaccatgacgaaaaggcgatccgttaccagatcgcccctgctgatcttgaagaacttggcattgcgccgaccttcctcgattttatcgaaagtatttccggtggggcaaaaggtgtcccgttaacaactgcgcagtctatgacatcaagcaacgtgcctcaagattaatctagcatttcaaatcatcgtgcgagtcgagctgtaaaaagctcggcttttttcttgccgtcttcaacttacgcgatggtgcctggagctaccagtgatttataagttttaaatcaaggtgtgatcatcacctgctcacgctctgatttaaacgcgttcaccagcgcagctcggctatgcgaagaacagtgacacagatggtccaaagcccagaccatctgtgtcactgccacttcgctacgccgagctaaccgcgccagctcacgctcttgtcatttttaacgggtcgacccatttatcaaactgcgctgctgtgacgtcgccgcttttgatggcggctgcttttagatcgaggttttcttgctcagccaattgcgcgatggcggcacttttttcgtagccgatgtggggtgcgagggcggtgaccagcatgagcgaatgatcaacgagtgctctcatatgcggtgcgtggatggtcaagccggcagctaatttttcagtgaaactcgtgactgttttggttagtagatcagctgactctaaaaaggtactgatgataaccggcttgtagacgttcaattcaaaattgccttgtgacgcggccaccgtgatcgtcgtatcgttgcccatgactcgaacagcggccatggttagcgcttcggcctgtgtgggattcactttgcccggcatgatggaactaccaggctcattggccggaatgcgcaactcgccgtatccagcacgtggaccactggcaaggaagcgaatgtcattggcgattttaagcagatcagccgctagcgttttaacggcaccatgaacaacgctaatttctgagtgagccgctaaagcagcaaacttattggttttcgccgaaagtggtaattgataaacatcgctcaatcggcccgccacaatcttgccaaaattagggtcagcgttaagccccgttccgactgctgttccgccaatggctaagtaaaaaagattgggctgaagctgctttaaagcaatctgatcatgctccatcatggccacccatccgctgatttcttggccaaacgttagcggcgttgcatcctgtaaatgagttcgaccgattttaacaacacgagcgtaagtgacggcttttgaatataaaacactgcacagttggttgacagcgtgcagcaactgattcactgcaatagccgccgtaatattcatcacagttggaaaagtatcattggagctttggctgtgattcacatcatcattcggtaagatcggcaagtcggggttgagttttgcagcttggtggctaatgacttcgttcacattcatatttgtttgtgtgcctgacccggtttgataaacatgcagtggaaaatctttttgcagtttttcgtctggcaaggccaacaaggcatcgactgctcgcgtgattaattggccttttggtgccggtaaaacatcagcggccacatttgctcgcgctgccgcttttttgagttgcagcaaggccctaatcactggcatcggcatcaatggaccagcctgaaaattatgccggctgcgctctgtttgcggtccccacaaagcgtttgccggaatttcaactggtcctaatgtgtccgtttctgttcgatatttgctcatgtttacctccgtcatcaccatcagaaaaattcaaccaacatgcctatttgcatagacctattttacacgaattcgccgacggttaaacaactcaagtaaaacaaaaagccacccagcacggctaatcgccgtttagtgcaatattgtttcgacaagttgtgccgcttcggtttgagctttgatagaaccagtggtcagtaatgacaagtagagatggatcggatctgcctgtggtgtcgatataccaccatgcagccgacgactcaccgtagccggatcaactgaccatgtttgaatgatgactgcgcgaccatcatcgacacgatgcttgctattggcaatttttaaggttaattccgccttcagtaaacgatcataagcagcctgcgagacagcataaatcaacggttggttactgccaaatatcgctgccttaattagaacggtgccagccgcctccaaaggaaagttttcactgaagtcaccgctgattttcagcaactgctcaaactcatcagcagtgtatgtgcgggttgctagaattggcgatgtcattagaccgttatattgcttgaaaagcgtccatggatcatttgccagttgataatgcttatgagttcgatggcgatcggccaataaagcgccagatacctgtagttctaatctagcgcgcttcatgattgttcgactgccaatacctgctaattggccaaaatcttcaaaaaactgccgcccgccgcgaaacgacagacgcttcttgctgccgcttgcctgagaacccagacgatcagcatacataagactgatcagcaaatccgttgcatgttgcgacaacatggctggtgtttctaataactgtgttgacgtgcttgtttcttctccctgtgccatcccatcactcgctttctatattgtttgcctattcatgagactatgaaactttagttcctatgctttctgtcatgacgtgcgccggcttgtacttaaaaaagccgctttgatcaacaaacagatgatcaaagcggctttactagggaaactgacaacgataatgattatttggttgaatgcgtagccgtcttagattgcatatgatctaacccaagaatggcgaatagccaaggatcgtaccccacagattcctcgatcccatcgcaactcatggccaaagattcaaacaaatcattgttcgtcaacatctgccttcgcctctttttcatcggctacagctgcaagatgtgcttcataacgttgattgcctttatacagatcccagatcgtccaagcgagtaacgcgaggatagctacgatcagaacaatggcaatgatgttggccatgttggtttgtgtagccgttggatgatcgccgaagaatccggcgattgaatctggcaggcctttaaggttcagtccagtcaagccgagaacggaaatccaaccgagcactttgacccaaccagtgttcttgaaccgatcgcccatttcgactttactgtttgtgaacatcaacagtggcaacattgagaatggtaacgcaaacgctagaaagacctgtgaattgttcatcaaggtatttaacgcctcatgttgctgaattggcgtgtctctagccgtcaacataacacagacgataactggaatgacggaaataatccgggtaaccaaccgtcgtgcccacagaggcattttcatatggacaaagccttccatgatgacctgacctgttaaggtaccggtgatagtggagttttgacctgatgccaataacgcaaccgcgaacagaattgacagaataccagatttagcaacggcaattaaaacaccattacttaaagttgaagaatctgacaaagcttggaacaagccgaagaatgatggatctttaacggcaccactcttgaagactgcgacccccataaccaacagcaagcagttaacaacaaaggcgaatgacagctgaatgttagaatcccatgctgagaatttaacagcctgtgccacatcatctgggttcttgtaatcaattttccgcgtttgcgaaatggcactgtgcagataaaggttatgcggcataaccgtcgcaccaataatgccaagtgcaccttggataggactcatgccgttaatcgaaggtgaactagcgaatgtttcaccggttggaatgaatcccttcagcaaagcacccatgttcggatcggacaaagcaacctgataaacgaagaccagtaaaatgacaagaataagagcaacaacaatggcttcgatctttcggaacccgatcttggtcaacagcagcagcaccagcacatcaagcaccgttaccagaacggcgatgactagtggaatgtgaaacaacagataaagcgcaatggcagcaccgataacttcagcgatatcagtcgccataatggccaactcagtcaggatccacagcacaattcctaacttcttcgacgtccgtgcgcgaatagcctgtgcaaggtccatttggctaacaatgccaagtttagctgccatgtattgcaatagcatcgcaatcaaacttgacatcaggataacggaaatcagtaagtactggaagttttgcccacctgtgatggacgttgaccaattcccgggatccatgtaaccaacggcaaccaacgcccctggcccggaataagcaaaaagcgtgcgccaaaaccctttcccgtgcggcacctcaacagtaccgttaatttcttccaatgacggcccattcgcgtattgaatgagcttaattggatggcgcttcttgtgatcatcactcacaataactctcccctttcgtttgaaaaaagttaagtccctggggaacaaggccttttaggtctccctaacttaatcctttcttaggatatgcctgtactgatatatcgtcaaccgttttatgaaaataatttgtgtttttaaaggaaaaattgtgaatatagccatacaagttattactcagaattgccgttattgttaaaaagtcactagtgtgaggatgttcaaacgtcttttcggaaaatttatcgacccatcaggtttttcaacttttctgcaaatgctagtgtccccataaccgccattaacaaattgtttgcaaccggtttaggcataccatattatatagttagcaacaaaaaatttatattatgaaatgaggaatcatgcatggaagaagttcctgactcgcaaccacctgcgtctgcacacagtatcaaggacctgcagcaatcgttgcaggtcccgtcccttgaccacggcctttctaaagaagaagccgctaaacgcctgaaggcaaatggaccgaactcaatcgagtcgcatccaacgccaaaatggctaatttttctgcgtcagtttaacaatctgatcatctatatcctgatcattgccgcgattttgacaaccgtgataggtgatgtgaccgatacctcagttatcgttttggtcattatcatcaatgccatcatcggctactatcaggaaagtaacgccagcgattccttggaaaaaatcaagaaaatgctggctcctgaagccacagtttaccgtgacggcgaacggcttgatatccctagtgccaatcttgtggtcggtgatgtcgtcttccttgaagcaggcgataatgtcccggctgatttgcgcttagttgatattgataatctcaccattcaggaagctgtcctcactggcgaagccaattccgtcatcaaaaccaccgcaacattgccagctgacacgccattagctgaccaaagcaatattgcgttcgcctccactgccgttgctggtggcagtggcatcggcatcgtggttgccactggtcatcaaaccgaattcggtaaaatttcccaagcggtatcggatgtccgcaaaggccgttcaccgatgatgcgtgaaattgacggcattggcaaaggcatctcctatgcgatcattgccgctgccgtgctgctgttcattttcggcctcgtcattggcaaatacagtttgcccgtcctcgccttggccattgtcacgatggtcgtcggctctatgccagaaggcttgccagccaccacctcggtcatattggccatgggcgtgtccaacatggccaaaaagcagcatgtcattgtgaaaaccttgccagctgctgaaacgcttggctcagttgatgtcatctgtaccgacaaaactggcacactcaccaaaaacgagatgacgattaccaccatcgtgacaccgcaagcaacctacgatgtcagcggtaccggttatgcgccgactggtgacttttcaatggctggaaaagtgatcgatccagctgaacatgccgatttatcagcattactgactgctggatttgaagccaacgacacggaattgcaccaagaagacggtcgttatgtcattaatggcgaacccacagatggctcgtttctgactgcctactacaaggctttcaaacaggaaccggcgaacaccgagcgcgatctgatgccatttgattccaacaaccggtacatggcgaagttagcaaaatgtgtcgatggccaaacgagactatttgtcaaaggttcccctgataaaattctaccgttagtcgccacagcccatcctgattttgatcaagaccgctacttgaaactcaccagccagttcagtgtccaaggccaacgggtcattgcagttgccgaaaaggtagtgccaaacgccacaaccgaaattacccctgaactgctcagcgaaggccttgattttctcggcatcaccgcgattatcgacccgccgcgtgagtctgtcatcacggccatcaaacaaatgcgccgcgctggcgtgaaggtgaaaatgattactggtgatcatccagaaactgccatcgcgattgccaaaaaactcggactggctgattccccagaagcggtcgccggtgcgcaattggcgggcctatcagatgaaaaacgtcgacaattgattcttaatgctgatgtttttgcccgaacgacccctaaagacaagctgactatcgtctctgtgctgcaagaagcaggcaatgtcacggcaatggtcggtgatggtgtcaacgatgcgccagcccttaaaaaagccgatgtcggcgttgctatgggccagtctggtactgatgttgccaaggatgcagcggatatggtgctgactgatgatcgctttgctcgcatggaaactgccatcgcgcaagggcggcggatttaccagaatatcaaaaaaagtattctgttcctgctgccgacttcgtttgctgaaggtttggtcatcgtgttcacgattctgacgcaacaagaaatgccattgcgtgccagtcaactcctgtggatcaacatggtcagtgctattacgatccaatttgccttcattttcgaacctgcggaagccggcaccatggatcgaccaccacgtaagaagaacgccgcgatgatgcataaacatgatgttttccaaattgcttatgttgccatgttaattgcaggcatcggcttgtgggcgtttgactggttaaccgccaatcatctaaccgaccgagtaacagccagcaccatgatggtcaatatgattgttttagggaaaattttctatctgtttaacatccgcaccaatacattggcactttcgaaaaatttgttcagcaatcccatggccttcgccatcattgggatcatgcttgcattgcaatgcttcctggcctatgtgccgtttatgcaagacattttccaaaccgcaccgatgtcttggcgtgaatggggattggcgatacttgccggctcaatcattctcattgtgaccgaaattgacaaaatcattcagattcgccgtcagcgtatgcgcgggcatggtgcctttcgctcagcatccaaaacacaaggataatgtttggcctccctaaattttttcttccatttttggattgatcatggtaatactataagtaaggtttccctaacaaaccttatgcgtatttagaaggcctgacagccagatcgaccatcactcaagctgtcaggctttttgaataccttttttcttttaaataaaggcattatcagttgagcagtcccgaatcctgcttagtcacatcactaaaaattatttcaggctcccctaatatttctcttttaaatatcatcataactgctatactaaaagtgaaaagaagaggagtgatcgttttgaaattgtatcaaagccttacccaagtccaaatcaacgaacaattcgctggtcaagctagcggctacaagctcaccacgacccttgataaaccgctgaactatgatccgacgattctctatcagtatttggataccgtcctgaaaccgggcagtcgccacgacgaaaacaacttgcgctacgtgactgatccgggctatatcggcgaaaactttaattaccaaagcgtcccgtttacttcgcacatgaccgaattcgacgagaagatggccttcgcacgcaaactggtggccgaccttaatcgtcatttatctgtcaacatcaaaccagaagatgaaactatcgaactggtctttgttgactaaagcaaccgtgttaccctcctttcctagtcgcgatgcttctctcctgatcatttgcggctaagtacccagtcaagcatgcttagttgcaacaaaaatgaccgtctactttttggtaggcggtcatttttgtagatgcaaagcacgaattcgcagctatgccgctttcttcgcgacttcctttggtaacgtcaacgccagcaacaagccaatcaggcccacgccagcaaacacagcgaaggtaacagcaaaaccgccagcatgacttcgcagcgtggtttgcatgccatccaacaacactgtggcgaacatgacaccggcagaaccgaataactgacgagccgtcgttgtaaccgcagttccgtctgccacgagctcattcggcaaagcattcgcgccagccgtcactgaaggcatcatcacaaaggcattgccggcttcagtcgccatcgccaacataattgccccaatcagtggtaaatgatgggcaaagactgccagcaagccaaaaccgccagtaatcaatagcatgccaatcatggccacgacacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaaccaaccacgccaacagttaagccttttttcgacaaaacacccaaggcataaagtagaattggaaaacttgcggataaaaggaaggacacccagtccagttgcgtcggttgcaatggcatgacagacgcaatggtcaccgttgaaacggccagcacaagcagcgaaacgaccaagaagaacaagaataatgcctgccaagggaaccatgtcagcaaaacaccggaaataatcggaccgactgccaaggctgaacccatgaccaatcctgccgtgcccatcacccgaccacgctcactatgcggcgtaatcgtcagcaacacggtctggaaactcgggaaaataatcccgaccgcaatcgcttcaagcaaccggccaatcatgagcacggtaaaactcggtgcccagatacataagcctgtcccaatggcaaaaatgagttcaatcgcttggaaaagccgttggaaaggaacattatgcaacagccatggactaaccggaatcatcaaggtcatcaccaacataaagccggttgtcagccaagcaactgtatccgctcctaaaccaaaagctttcataaaagcaggataagcggtgcttaaagaagactgagaaattgacatcgaaaaggtacctgtcagtaacgtggcgacaaaagccccgcgatgtttggtcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaatgtttcaatctgtgccatcatgccgccatcttcgtgctcaatgatatggcagtgatacatataaacccctggcagatcaaagcgaaccagcagccgaactgtttccccaggattcacgccaacggtatctttgaaaccatgttcatttggatacggcgcatgcccattccgcgacaagactaagaattgggttccatgcacatggaatggatgaaccattccaggcgcatcattgctattggtaacatcccagtactgggctttgccaattggttgcgtggcatcaatccgctgcatggcgaactttttaccgtcaatcgcaacaccttcgtccatcccctgcatcacaacgtggcgaactggcaaagccggatcaaccactggtgccttcacatcgaacaacctatcaggcaaggtcgtctgatccggtttgaacgcatgaatgcggaactttagcaatggcacatcatccgtatataaggtgacctcgtcgccttcatggtattggccaaaatcaacaatcacttcggcacgctcagcacaagtcagcatcaaatgggtgaatctgactggctccggtaaaagtgagccatcaccgccaatttgcgtaaatggcaggtcatcggaaaaatgcaaccgccattcacggcgattagcaccatccagaaaacgcaaccgaaccttttgcgtggtgacatcaaaatagggattgattgtaccgttaatcattgcggttggcccagcaacaccgtcaggatcataatcagcccggtagtcccactggttgttctcgtgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttgttccaatgtgaagtcgatatgcttactttcacccggataaaccggcgcatggcatccgccatcaacataagggccactgacattagccccgtgccaatgaaaagtggtcaactcaggcaaggtgtttttcagtgtcacgtgcgtatgctgaccacggcgatacacaatcgtctgacctaacagactggtattatagccccacgtcttggtcttcgcccctggtaacagttgcgtttccccagcctctgctgtcaccgtgtaataaacgtcggtcgctgtctctttatccggtttcaacaacggcggcacatttaagggcttctcaggcgcatcactgacctcaagcggcacgtacccgccatcgtggagatcaaacgctggctcatcaaagaaatagtccgtataggttttcatcgtgatttccccctctgacaagaattttaacactttttagggttgccataaacataatttacaattaatctaaagtagtattgaaaaatggtataggtcttatccatacacttgaggaggattttcatgcaacaaatgtcgaaaacaatgggctggctcatgctgacgttaaatgtggtgctgctgattctaattggtaccatgcacaatatggcagcgatgtggttaatgggtctgattatgactttggacgctgtgaccgggttagttaccgcttatcggccccagtcaagtcaacaacacgcccaccagcactagtttgttaagaagttgctgcaagacctttcatggagtcattgatcagcgttatatgttgacatatacatatgtttaatatatcatgtgtctgtacttagatgaacagtcacatgaaagagggtggtttaatgcagcaactgtcaatgacgcagaaacaaaccatgacgtcagccttacgggttgaatatttttcaacggcatggatggcatttgagttcatagtcggtttttggtccggtatgcaagcaggttccattctcttaattgcgtttggcctcgatagttttcttgaaattatttctggcagtgccctcatttggcgtcttaaaaaagaagccaatggtgcgccatctgcggaggttgctcaagcagagcaacgttccagtctcattgtcggcagtgttttattattactcagtctttatgtcattggcgtttccggctataatttggttacacatgccgcagctgatacaagttacagcggcatggcaatcgcaattgcttccgtgttcctgatgcctgttttgaccattaaaaagcggcacttgggagaaaagttaacctctcccgcgctgattgaagatggcatgtgcaacatcacctgtgcttatatggccgcaactgttctgcttggcagtctgctgacttggttgtttaactggtggtgggcggattctgtcgctgctttagtcttggtttattttgtggctagtgagggctgggaagcgttgcaaacgggattgggacacggtgatgacgcttaactaatggaggtttcggtcacatggacacagacactttggaactggtcacgacagctaaattgactgagacagaacgcatttttaagttattgagcaatccgattcgcctacagatgttaaaacttctcgaacaacgggaactgaatgtcggtaccattggtgacttgttaggtttggaacagtcggttgtttcccaccagcttgccttgttgcgaaagcaccagctggtgagcgccaaacgggtgggtaaagccaatttctaccgcctcgatgatccgcatatcatcaccgtcatcgatgctatgctcgcccatgccgaccacgtggctcgcggcaagcgacacggcgaataatgcaacaatgggtttgcagtcggagaaggctacgagtcagccataaaaaaacgttacctttaccattttcggcaaaggtaacgttttttttaatgggacggatttacaattcaagtgcaacaaattagtcaaatgaaaagactcatagcctgagtccttgtaaaatggaatcaccacaagaccaactacaaggagaactcgactatgagtccgtacacccatcttaccttaaaagaccgtgaatcgatactgctggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcattactaatttattagccagtatggtttctgcactttagtaaaatcgagaaaattggaggcgtctgttttttaagttcatactctcacaatgattctaattccttgtaccaagataaaggcacttatcatgagcgttgtagtcatcgccattacctccctgtgttagtattaatgtaaatataccccattataaattcgcagcgctttaatatgacatttgtcatattaaagcgtatacacattttctttcaatccatagagaggctgtgatgaatgatgcaagaccctaacatcggttcatactttcgtgaaatacgcaaacgaagaaatttacgaatagaggaaatacgcggaaacttgcaccaatccactatttctcattttgaacgagatcatgacgacattacacttcgtaacctgcttcagatcctcgaaccaacgttcacaacacctgaagaattttgcttgcttgttgatgatcaagatagttcaatcaacagtattctcaagaaaatttctgaacactatgacaaactggatattgatgggttaaaacattttttagccgtttttaagcgttcaaacgctatgactctccccgttcgtttaatcatccttattgttcaaagctgcttgaatgaattatcgggagaaaatcttcttctctcaaatgaagactgtgactatgtacaggattatcttcttcaatctggtaaatggttcagtttcgaatatattgtttttggcaatcttgcccaatcactacctgcttcagtcaatttgcggctttggaaaaagatgctgacatcttttgatgaatttcacttgcccacctatgacgatttactcgtcaatatcttgtataacgtttctgcctcgtttttgagtcaaaacgatttggcttcggccacataccttaccgagtctcttgatttatcaaaattagatcattacgttctttatgtgcgacatcatgttgtttttttgaaattacttttgaagtatcggcaggacccaaaagatttgcaaaatatcgatcgtttcagaacctttcttttgggcacacagatggttgatgaaacactctttgacaaaaatattgacgccttaaaggcactggatgttgacattgatgtcatcttgtcacccgaaagtggcgtgtaacggtttcccagaagtgttacgttgtataaaaatgttgcgcatgccctctagcttgaattacttgtgcaagagaatgcaaaaagcgcaacttcatgttggcactgaagttgcgctgtgtttctgatccgagtgtgagttgttcatgatgaaatcagctacttgaaaaacctttcgctagttaaagagatcagtggcagcctgcttaagctctttcaccaaagaggacttggcatggaccactacttcaagatggcaagcggcggcatcataagttggtaactgccaaaggacgatattccctttaacgcagctctcgaagtcagcaaaaggttttaacatttcgttcatgaagttatctgatgaagtcacgaacataccaatgaccattcctgttgcctcgttataatcgtcatttgatagaacaatgagtggtcgccgaatgttgccgttattgaaattgtgacctccgtattctttacctaaatgcggttcagcatcaacgaaaacaatgtcaccttgttttggcgtgttctggtcatacttctttacctcttgatgactcttcagaaacaattccgatctcttttttcattgctttaaaatcaatcttttgaatagctttcgtgtgccacgggttaattcgttgtggctcatactttaacgtaccctcatcatcaaccagtaaaaggtattcttgcccctcgttaacgccagcatcggcaggtactgttaaacttagcgagttgccagatcgtctagtggtaaaacgacctagtacgcgatcatgacgcttctttgtatccattaagatccctcccgtaagtacaagtatatacggacgtgtaaatgaccttacgattaaccatggttactgatttggtgatttatcaaaaatccagacacgaacgattggccatacagaaataaaaaaacgcgctgatgtgcgcgtcttttctataaaaagttctccaacccaacaaccaattcatcagccgtttgtaccttactaatcgcgactgcgacgccttgcatgaagctttggcggtcgaaggagtcttggcggatggtgagggcttcaccagggccgccgaagaggacttgttcgtgggcaatgtagccgggtaggcgaacggcgtggatcgggacgtcatcgacacgttggccgcgggcgtcattgtcgatggttggcaatggcttttgggtacgtccggcggcgattttgtgggcggtggcgatggcggtgccagaaggggcatcggctttgtcctgatgatgcatttcgatgatctcggcatcagggaagtaggcagcagctgcttgcgcaaatttcatcaaaagaacggctgagaggccgaagttcggggcgatcaagccaccaagatgtttggcgttagcaagtttgatcagtcgttcctgattggcagggtccatgccgctggtgccgacgattggatggatgccggcattgatggcagcttcaatgttggcagcaacggcgctgggattggtgaagtcgacccagacatctgccacgtgtgcatgaagctggtcataggtgttgagtacttgcacgttggcaggcaagttgtaactttctggattaagatcggtgattttagggtcgaaaacggcacttaatgcgaagtcttgatgtgactgaaccattttgactgttttctgacccatggcaccacgaaaaccggcaacaagaacctgaatcatgcgagcacctccgcttcaatggctgatagttctggcacgcccagtagatgggcgagttcctgctgttggctggcgttcaggggtagtaacggcaaacgtgggctgccgacttgaaagcctagcgcattgagtgcagctttggttggcgcaggggatgggaaatggaatagagccgccatttttggcaacagttgacgttgcaaggcggcgactgtggtgatgtcgccacgatcgagtgcggcgtacatttcacggatactgtgggcgtaaagatgggctgcaacggaaatgactcccatcccaccgagtgtcttgatgttgagtgcctgagcgtcttcgcctgtccaaacgttgaaagcgtcgtgcttggtacggtcaatgatgtcactcaaggcagggaggctgccgcattgcttgatgccttgaatcatgggattttgcgccagtgtcgcaacggttgctggtaacatatcaacaccggtgcggcctggaatgttgtaaatgacgatcggcttctgcgccgctgcagcaacggctatgtaatgggcgatcataccgttttgatctggcttgttgtaataagggacaacaaccaaggtggcatcaataccggcaatgccgccaacttcatgagtgaaggcggcggtttctttggtgttgttagaaccagaattagcaatcacaagtgcgcggccatgaaccatatcggcgaagcgggtataaagcgtgattttttctggatgactgagtgttggtccctcgccggtggtagcaccgacgacaaaaccgtcagtaccttctgcgattaaatgatcgacaagtcgctgcatgacgccatagtcaattttgtcgcgatcattgaatggcgtcacaatcgcggtgatcagttctgctttttgcatgatgaccctcctataaacgcgctacccagtccagaaacctacacataaggaccttggccgcaatggccacttatgttccggtttctacccgcgccagttcgcgctctgtcttaatgtaactactaatgataatttgtgctggcttacactttttcaagcattcgatgttcaagaaagtgcacaacggcggtgacaccgggcacgagtgcggcttcgtcaggtgaaaagtcggctgcatgtagttgtgagtcagggtcattgacgcctagccagaacatggtgccaggaatcttatttaataggtagccaaaatcctcacctgtcatgacaggctttgtatcaacaaatgtcacgtcaggatcatctttcatcacttgaataaagtctttggtgagtttgtcattattttcaacgggatagtagccgccttggttcaaggcaactttgacttggcagttaaaactggcggcaatgccttgaccgatgtcacggattcgttgttgcagaaagtcaatctgctgctgggtgaaaccgcgtaaagtgccttcgagatgcgccctgccagcaatgacattgcggatcgtacctgcgcgcatcaagccaaaagtaatcacggcgctgtcggttggtccaacattacgggcaacgaccgtttgaatctgactgatgaagcttgccgccgccacgatcatgtcattggcattttgcggcaaggcagcatgaccgcttttgccgatgaggtcaacgttgatttcggttgtgccggcaaaaagggtgccgaggcgtgtgctgatcgtcccagccggtagatctgggcgatcatgcaggccataaaactcatcaatgtgccaatcgccggtgaatgcgcccatatcgtaggcgagcttgccgccatttttactttcctcggctggttggaagaaaaagatgaggttatcttttggttgatgttcagcaaaataactgaggatgccgagggcgacagtcatgtggatatcatgtccgcaagcgtgcgcgatgccggaatgcttagaggcaaatggcaacccggttttttcggtaaccggtaacgcatcgatatcggtccgatagccaatcgtacgctgcggatcgcgcccttggaccttgacgagtaaagcggttggcaggtctggcaaggtgcggatggtgagatatgtttggggcagcccttgaatggtttttagcaataaggcgtgcgtttctttttcctgcaaggctagttcggggatttgatggagttggcggcgaagggtgatgaggtcagcttccttcattaataagtcacagctttctgagttcgtcgagtaggacggttttggcttcggtttggtcattcacttgtttgatgactttcgcaggaacaccagcgaccacggtgtgcgcgggaacatcgttaatgacaaccgcgccagcagcaataaccgcgccttcaccgactgtggtgccttcgaggacaacggcattggcgccgatcatgacgtgatcaccaatcgtgacgggcttagctgaaggtggctccacaaccccggcgagtacggtgccagcgccgatatggcagtgcttgccgacgattgcccggccaccaaggaccgctcccatgtcaatcatggtgccagcaccgatttctgcaccaatattgataatcgcacccatcatgatcaccgcattgtcgccaataagcacctgatcacgaataatggcgccaggttcaatgcgcgcattagccgccttgatatccagcaatggaaccccggtgttgcggccggcggtttcaacataatagtcatctaacttggcttttttcaaaatgggtttaatttctgcccagtcgccaatcacggtgccggtatgtttaccgatgaaagcatgaacgcttttgggaaaatgcagctcgcttagtttgcccttgagataaaccttaactggggtggtttttttgctattagcgatggtggaaataattttttgagtatctaactgtgccataatcggcctcctatttggttgcggcagtggcgtcggtttgagctggagcaggctgctcagttggtgcggcgtaatgtaagtcatttttaatgagatcagcatcggtttcgcgggtcacgaccaactgggcttgaccattttccacgaaaacaacggcgggtcgcggattgcgattgtagttggatgccattgagtagccgtatgcgccagtgtcaaaaacaacaacgacatcgcctgatgtggtggtgggcagcggtgcatcatcgatcaaaatatcgccggattcgcaatacttgccgaccaagtggacatgttcagctggcgcagcatttggctggtcagctaaaacggccgtgtaggttgcttgatacaaggcaggacgaatattgtcgcccatgccaccgtcaacggcaacgtatggccgcaatcccgggacatctttacggctgccaacggtatagagactatagccggccggcccgacaatcgaacggccgggttcaatccagatggctggcaacggccagttaagcgtttgactttgtgatttcaaggttgccagaattgccttaacaaaggcttctggtggcagcggatcgtcttgcttggtataagcaatgccgaagccgccgccaacgttcaggactttggggatgaagccgaattgctgatgccagttattaaggacatgcagcagcttttgggtaacggcttcgaaacctgctacttcaaagatctgggagccaatgtgggcgtggatgccaagcaggttgagatgatcgtcggctaaaatgcgcttggcggcttcatctgcttgaccactagcgagatcgaaaccgaatttactgtcggtttggcctgtctggtcataggcatgtgtgtgcgcgctgataccaggggcgacacggattaaaacgtcctgttgaccaacggtgtcacctaaaaggtcatcaaggagatccagttcgtgaaaattgtccacaatgatggtgccaaccccggcatccaatgcttgtgtcagttcagctttgcttttgttgttgccatgaaaactgaccgccgccattggaaaatcggctgcctgagcggtgtaaagttcaccgccggacactacgtcaacgtgcgcgccttctgacttggcgacttcgtacatcgcaatggtcgcgaaggctttggaggcgtaactcacggcatatgacacatctgcttcttcaaaaacccgtttaaatgcgcgaatttgctggcgaatggcgccaatatcgtacacataaagtggggtttgaaatgttcgggccaactggctggcagcgaccccgccgatggttaattggccttcatgatttgtggcaaaatccataagttcatcctcccgaatttggcagggcgatggcaaacgaaaagggatccttttgtttggccacgcgtcaaacaaaaagatcccaacttgcaatctacttgaatgatagcgccccgcttaggtttctaagcgacagtacaggacttattcaatcctggcccaacaggtttgccgatcccggcgcccccatttcggcaaccgcccctttggcttgatgtcatcacgaaggatcccgctcgatcaagctactcatgttggttgcaacctctatctgtttgtcaccagcctataataaaaagacgtggacgtcaaataaataatgagagagcgcgaacaggcccgcttagaaaccggagcataagcggcctcaagcctcaatggctgggtcttggccagtgaggcttgaggtccttatgtgcaggcttctgggcctgttcgcgcgctttaagtgagataggtctgtcttcgaggcttttagttctcctatagttggcatttgtccgatagtccgagctggccctgcggtgacagagactggtgactgtgaactcaggtcattaaaaacaaatttaaaaacattgtctctatgcagtaacccgaaaacgtgtcatgttagcgacatgctggggcttgtgtttctgggagagtctgttaaagtacaggataaaatgacaaagttctcatttgtcgtgacgtctaggaggcagtttatcgtgcgtgtcgtaaaatttggcggttcatcgctagcaaatggttcacaattcgccaaggtcgtggcgatcatgaaggctaacccagctcggcaggtgatcgtgacgagtgcgccaggtaaacggcacccgggagacaccaaggtgaccgatttattgattcagtatgcacaggcagtgatgcggcatgaagctgtggctgccattgttgcagaaatcgttgctcgatatcaggcaatcgccgatgattttgagctcgaagcatcgatcatggccgcgattgaagaagagctagaccagttaccaaagttgactttcaagaacaatgattatttaatggcaggctttaaggcgcgcggtgaaaagttgaacgcgtttttaatgaccgcggtgttgaatcatgaggggattgaagctacctatggcgaaccgaagtcgttaggaattgtggtcacagatcatcccaatgatgccgaagtttcacgtgaaacctatcgcaacctcgctacatttcgacgaccaatcggggttttggttgtaccgggattttatggctataccagcgatgacgatattgccaccttttctcgtggtggctccgatatcactggggcgattttggctaacggttttcatgccgacttatatgaaaactttaccgatgtcgatggcgtagcggcggctgacccgcgggtagtggcgaatccgcaaatgattcgtgaaatgacctatcgggaaatgcgggagttgtcttatggcggctttggggtttttcatgatgaagcgattctgccagcgattgctggacaggtgccgattaatcttaaaaacaccaatcatcctgctgctcccgggaccatgatcgtcccagaacagcattttgtcccgaaacatgccattaccgggattgtaagttcccaacattttggggcgatctacctgcatcgatatctgttgaataaggaagttggcttcactctgaagatccttcaggtgttagcccacaacggcattagttatgagcacatgcccagcggaattgatgatctcaccattattttagatgatcgccagctaactgaggccaaacgcaagacaatttgtgccgagattcaagcggcggttcatccagatgtgctgaagtggattgatgactatgcgatcatcatggtcgttggtgaagggatggcgcaacgaaccggattgattcaaaccattctacaaccgctcgcaaccgccggtgttcatgtctcaatgattaatgagggggcctcacagatttctctgatgctgggaacctcacgtgagtcggccaatcgcgctgttaaaacgatctacaatgctttttttataccgattaatcaacgtttggaggtgcactaacatggtgactttgcaaaaggttcatggttccgaaaatagtttctttcttttcgatgaaacgcagttaactcagccgttgacaaacacccaattagcaaccgtgacccaacagctaacgaacgctgaaacaggtttgcttggcggtgcggacggggtcttggcaatcacggcggcgcctggaacggctggcaaaatgacggtggtcaacactgatggcagttttgctaaattgtgtggcaacggtctgcgcacggttgcccgttatctgagtgaaaaaactgggcaagcgacgttcaaggtgcacacggattttgctgatcttgccgttgctcgtcagccgcaactggcagaaggcgtaccggcctactcagtggaaatttcgccggttagttttgcgcctcaggacttgccgtttgccaatcttggcgttgaccgaattgtggctactgttttgccagcgattcatccgagcttgaaattcaccgccattgctgtgcccaacccgcacttaattgctttcgtctcacctgaggtattagctgggtccgatctcgaacggattggcaagatgctgaatgccaaaaatccttattttccggaaggggtcaacgtgacttttgccgaaatcctagataaggataccttatttgctcggacgtatgagcggggtgtcgggttcaccaatgcatgtggcacaggcatgtcagcaacgaccttggcttttattttgacgcatccagaggaagctgcttttgatcgggtcaataccgtgtataatccaggaggaatggtcaaaacaattgtccatcatgacggcgagcgttactggattgaattgatcgggaatgcaacggtcacggcgacgattaccttgccagacacggcgttactcgcaggcgactggcaacaagctgagattcacgcgactggcgaacaggctgagtatgaacgatttattgacgcactgccgcatcggaagttagcaaacacattgacagaaggagtttagatcatgagaggttatcacgtagcagttgttggggctactggagctgttggcacccggatgttaaaaatggtggcagaaagtaaactgccgattgcgtctgtcttggcacttgccagcaagcgctcagaaggaaagcaagtcccttaccgtgatgggacgctgaccgtccatgagacgaccgatgattcattcaagggcattgatattgccttattttctgctggcggttcagtttccaagcgatttgcaccagccgcggttaaagctggggctatcgtggttgataatacgagtgcttttcgaatggaaccagaaattccgctggttgtcccagaagtgaatccggaagcgttgcggcaacacagtgggatcattgcaaatccaaactgttcgacgattcaaatggtcactgcgcttgaaccgattcggaaagcctttggtcttaaacaagtggtcgtttcgacctatcaggctgtttctggcgctggacaatcagctgtgaatgaattgcttgatgaaactcgcgctgcattggacgacaaaccgcttgacccgcagattttaccaacggcgggtgacaagaaacattatccgatcgccttcaatgccttgccgcaaatcgatgttttcgaaccggatggctatagccatgaagaatggaaaatgatccacgaaaccaagaaaatcatggctggggatatgaatagcgacaccatcaaagtgaccgcaacctgtgttcgaattccggtgccaattgcccactctgaagaagtgtacttcgaagtcgaagacgacaaggcaactgccgatgatattcgcgaggcattggcgcatgctcctggtgtcgttgttcaagacgacccaagcaaacaagtgtatccgcaagcgatgaacgccgttggcagcaaagatgttttcgttggccgcattcggccagatgcagaaaacccacgattcttccatatgtggaatgtttctgacaatttattgaaaggcgctgcttggaattccatgcagattgctgaaacgatggatgccatgggactcattcaacctaagtaaatcgttcggtaaaaaaaccggtatcatcattgttcaggaggttctgaacagcgacgatgacggcttttttattgctttgagattgttcaaaaataacacccggatttcttgcgagaagcttaaggttggtacgcaaagattgaccatccagattaaataactataatagttaaaaaacaaaggagcagttgtcaaatgaaaaagcatcgttttgtcatcgcactggtgggtctgtcactctttgccgccagcagtacgattgcggctgatatgacgcaggcgaatatggatcaacacagtgtgacctacacgatcaaaggcgacgggttagtcatcttcgacaaaactcgaacctatcgaacaaaatcaaccgctgctgcctataaaggaactttcgccgccgatgcaccaacggccagctttgaaaaggtcgggacattggctaaccacaaggactatcgcgttacccgcaaaatcaaagtaaaagctaagatgcaaggcgctgctgcacagacctttttctatgtgaatggacatggctgggttaagggcagtgacttgacgcgggagtgatttgttttaaaatcaataccttcatctaatttaaataaccgtgatgaatcttttatatgaaaaaggttcatcacggctttttatttccttatcagatgtatgaatatatttatggtaataatagttgacgtagcactggcaggcactatacaatcaaagctctcttgatggactagtctcatcacctcatacgtgagtgaggcttctaagctagagatgacgcatcatagttttatctacttctagaggatgtttgaaatgcgagataagcaaaggggggtatcctgtggtaaaggttcattttggtctcactcataaaaaagttgattcagttctaatcattcaattctttaacgccggtattatctgggttcataactcaaagcgccgttgggagttgactggtggcaagttagaaccgggcgagacgatggtgcaagcagctgtccgcgaatcgtatgaagaatcaggtgctgttgttcaggccagtgcgattgtgccattgggctactatgttttacctactggacacacaacagcagtggttagtgctaaagttgaacgtttgcaagctattcctgcgtcttctgagattgatgatcggcaagtatggtttaagcctgtcccggatgctgagcgttcttttcatgatgatatttacgcccagatttttcaacatattgggtggccagatgagtagacgccaatacgggtttctgctgaatattttatcggtggccgtaatggctgtgacaccggtcatgaacaagttctcgatgatcacgctctcgccattagctgcaagtttctacaatgcgcttgtgtcattgatcctgactttggtcacgatcgcctttaccaaaacaaaattagtttggattaagcagccgattatttgggcgttggggctgacgaattgtttaggcatattcttgcagtatatgagtcttttcttccttgatccggtcagcgtcgggttggtcggcaggttttacattgtctttgcgatattgctttcagtgcttctgctacgtgaacgatttgatcgaaaagagattgttccgatcgtcttatgtatgattggcacagctttggtatctgacttctccggtgatgttaataacatactggggctggcttgtgcgctcggctacacgtttagctttgccctgaccaataccttagccaaaaaagctcttatcaacatagacgagaagatactactcttatataaccaaggcaccgccgtcgtcattctaggcggttttttactcggaagcggacaattatccctcgcgccgaatcttggcatgggtgctgtcgccatttcagctttttgttctggctttttgggactgctactcttttatcgcggcctgaagttgatttcatttcgcgatgctaatcttattcgggcattgaatcctatttttgtcttagtgtattcattgccgttcttcacaattcaaatgacgccagcgtttctgcttggcggtttctgtatcattctttcgattgtttggatgtcattgccgatgaagaaggttggcgttgattgagacgaatgtttcaagcggtgagttttttgaaaaaaaggaattgttctcctggaaaatttgcaaatgatcaaaatttgagctgctacataacttgtagaatttgaatagaacagcatataacggaaaggaagcaagtgcacttaagattaaagctcgattatagagaaatcagctcattcatggttttcttgacataaactcatactgggagtaaaaatttaaccattctaggctcggagtaacttaaagaaaactggacattgcttctctatatgaggaaagtcaccgtggcaaataaatctggagactcaattattaaaccgaattgcttcggaacgagcgtagatgcaattagacataaccagcaaattcattatgtagaagagattatgctataggcgttgaattacggcagatgttattgcttttctagaagttttctagacgataatagctgcttttttggaatttcttggagatgatctgactgatgaacccaattataataagaacgctaaaaaagcatggcgttgcttttacgttactagtaatatttacgattataagtacagcactgatcactgggaatacatatttagaaggtagattgttagacagtttggtttatagtcatagaccgacactttttataacattctttgtgcttatgctggggattggaattcttagactgtttttttcgttttttacaagtcacatacaaatactaaccaaacaagagacggtgcttgagttaaatagaaaaatattttttgaattatttaagaaggacactcttagtatacttaaatggagtccaaccaccttgagttctcgtattaatgatgatgtgaccgagatagtttcctttttctcagatacacttgttaagctgtgttccgtgattgtatccacgatcacgatctctgcatatgtattcagtgcagatccgaagatattcatcataatgattatcttcatacctatctactttttaatttacattgtgtttcgtcccaaaatatacagtataaacttaacgatgaaaaataagcaaaacgaatactatacgacgagaaatgatttcgttggtaggtatattgaaatcaaaggatctggtaatttttccagtgagaagaaaaggctgcgcacagttgaggatggtttacttaaaacgtttgtcaaaagtttttgggtacgatactggatgtcgacatctcaaatagtgatgcaattagtctttcaagccgtatttttcattgtcggaggcttggcagtactacggggaaatatcacaattggctttttctctatagttcttcagtatttcggacaacttcttaattcagtagatcagatttttggaattgcaattggaaccgagaaatatcatgcgtcgcttacgaggatgaaaaggattttcgacattgcggcagataaaaatggagacaggcctattagcagtgtgagagcaattgatattaacaattttaatataaaaatgtttccagaaagcaagaaagattcaaagatgttctattctcaagatttgtcgtgttcattcgaaaatccaggactgtacgttatttcaggcgataatggtattggaaaaagtacattcgtacggacaatcacaagaatttaccagcctaaactaaggggcagtgttttgatcaatggactggatgtaaataaaatagatatggatgcattgagacaaaaagaaatgggattcctgtttcaggatgtaccatcgcctcatattaccgtgagagaatacttatctgatttagaaagaaatggtttcttgaatgatttaaaagaatcaagaccttttttaaatgtgtacttttcagatgtattcaatttggctgatatttatgaaaaaaaagtagatgtactgtcaagtggtgagttacagcttgttcgattgcttgctgcattgggcaaaaaagatgccagtatgtatattttggatgagcctaccgcgaatatttacccacaaattcggtctgccgtgatttggttgttacaagaattaggtaaaagcaaattgattataaccatatcgcatgacgaacatttgataggccttggtaagtcaattgtaatggaatagcaatgaagaatcattgaatatatggtgagataattcaatggttcagttatttctgaagtgaaagtactgatataaagtgagctcattctaagctagttcttcaatagtgctgtaatcaattttctgaaatagacgatttaaacaaaataatgatttctgataagttcataaggagtcgtttcggggagacgaagatttaaagtatagcgggaagatgtttactttctcctcttaatgtctaatagttcatttctttgttgatgcgaaaaatgaaacgaaaagttgccgcacaaattctctaatagcaggtgccactgccaagagctgaagaagcttggtagtggcacttgttttactttgaagatagagatgaacattttagaatcataaaaatcacttagttgataaccatctataaaatatctatgccacgatattatctatattataatttgccatagataataaaatggttctcttttggtggactattatgtataataattggcgtaagcgcttgcttgtaggcgatagcaatgataagagtagaaaatataggaggggaatatgaaattctctaaacgctcaaaacgatttgatataatcaggcgaagtgccgtaatagtttttgcgctgatcagtatgacactattttttcaatttaatagtggggttgaggtccacgcaacgactaagactgagtttaatgacactgaaatcaacagagaaacaagtgaacaattaaaaatgatcgatccgtacttaaagaatgttgatggtatcacaagttttgactatgatgctgccatgaatgacaatgtcgatcccgttgtcctaaaaattggcgcagaaataaatagtggctggtgaaagcagcataactgcaagctttattggcatcaaagaatagtaaagattataattagtgcaaagtccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctaagaaaatcaaaactagagatgaacttttctttagagccaattttgctcagcaaatcctactgacttctggcgcacatgatgggcagttattcggctgaagaagggatgctttttagttgagaaatttcacagccgtgccatatgccacaacactttgcatgtcaccgccaattgatccggagtcaaaccgcatcatgacaactgcatcgccaccagctttttgggcttcgtcgcgtaaccgctcgatcgctttttcccgtgactcatggagcatatcactgtaggctttgatttcaccgccgacaatgttcttcaagcctgcaccaatgttgctgataacattctttgactgtgttgttaagccgaaaacttcgccgatcacttcatattttttgccgggaatgttttcggtggttgtgattaagatttcttgtgccatgagagaatctccttcataaaagttgacgtaacaaatcagtggcgagctatcttgctgcttatcagactaccaccggcttatggtgacaacaagctaaaacgcttagcgtgacaaaaccgttagctagtgtcatcaggtcaacatttttagaaaaaacctgagcactagtttgcctcttaaagaagtttttcccgttagctgctcgtgctagaaaacagacgcgatcagggcgttacttgaatcacaattcggccttcatgcggctcatccagcaattggtggcctttcacaaagccttcgcgggtaaaaggcaatacatagccgactttgacggttaatttgccttgagacataagattaatcaagactttgagtgcttggccgacttcggagccgccaagcggtcgggtatgaatgaaacggatgccgcggttgaggagcggttcgtgatgactgacagatacgatcagcccattgtccttggccatggcgacatcatcatcaccaccgatcccgtccatggcggcattaatcacgacgtcggcggttttggcaagttccttgacaggattcccgcggtcataagcgacaaaatgtttaaccccgagttgattcacatcaacttcatggcggctggcggcgataccaatcaccgaagcaccgcgggcaacggctaattggatcgccgcggaaccgacaccgccagaggcgcctttcacgatgacggtgtcgccatcgttaacatgacctagttcgaccattcgataaccggtcacgccgggggtgatcagagccacaccgttttcaggcgtgatggactcaggcagtaacacactcatgtcagctgcggccgtcacaatttctgcgtaagcactggtggtgcgcgcaacgacgcgatcaccaagtgcaaattgcgttacctgatcgccgacagcactgacaatgccagcaacatcatatcccggcacggttaagccactgccacccatttgacgagcaatgcgatcacgattattcagaccgatcgcttgggacttgatttgaatttcccgtggtcccggcgctggtgtggccaaatcgatggcatcgatcacttccggtccgccagcatgactaaaaccatatccaagcatcttgttccctcctcatcaacgtgctcaccagcgcagttgcctgcacctgaggcagcttacacgccggtttcttctgcgttggttcacgttaagcctctatatatcggcattttacccatgataagaaagaaaaaacaattaaaacgacctagccgcttaggggtggaaacctcttacgcagctaggtcgctatgaaggtgacacatggtggaaatgaacgaaccggccatcagtagattaccgattttctcttcgcggctggggatcaaaaccatgtaactggcctttaaattcatcaggattttgactgacataagtaccgcgggcccaactggcagcgacagtttcatcaactggttcatcgtgttcgctgtaatccagccccattttttcagcagcaggggagacccgaatgctgacgaattgtttgagaactacagtgattagactgaccatagcaccaactaagacgatcacgatggcggtgccgacaagctggattaggagcagctgccatccaccgccataagccaagccagcgtgcgcaatgtcgggggcgacctgtttgctggcgaacacaccagtcaaaatactgccgacaatcccagcgaccccatggcagccaaaggcgtctaaagtatcatcaatgcctagccgtggcttgattttgctgataaaccagtagcttgtcaacgttgccgcaacgccaatgcatgctgccccaaaactcgtgacatagccagtggccggggtgatcccgacaagcccacacaaggcaccggtacaagttccgatcagcgttggatggccggtttgccagatgtccagacacatccatgtgaccaacgccgcggcggcgccaaccgaagtcgttaatgctgccgtcatcgccgcttgattaacaccgagtgcagagccggcgttgaatccataccagccgatccataaaatggccgtgcctagaagcacccaaggccgattataaggtgtgatatgttcatccgtgcggcggcctagaaaggcggatagcgtcaaggcggtaatgccagcattgatgtggatcactgtgccgcctgcaaaatcaagcacacccagaccggccaataaaccgtgcggactccagatcaagtggacaagcgggtaataaaccagcaatgaccacaagacgataaaacaagtcagaaacctaaaatgcatccgaccaacgacagcgccaacaaacaaggccggcgtgatgatggcaaacatcatttggaacagcacatacacaccggttggaattttcgccgtggtcaccgcgccaagcgaaagatcactcaaaaagaaatgatgaacctgaccgatgacaccgaaaagatcgccattaaaactgagctcatagccgacagcgacccaaagtaggatcgcaatcccggtgatgtagaaaaccgacagcatcgtattaatcacgttgcgtttggaaaccagtccaccatagaaaaaagccagtcctggcgtcataaaccagactaatgtactcgcaataattacaaacccagtatcagctaaattcatctcttccacctcattaccattgatggcggtattgtagcatggcatttttaataacttagcgattcggtcgatctattggcctagagcaaatctggtgctgaaaggagaaagactgctatcaaaggattttcgaagcggtaaaaaaactgaagacgcgttagcttatgtgacatgaaaacttgacgattttatggcaaacagaaaaatatgccattggtctatgcgaaaaaattggtttttaaatgaatataagtgaaggcaatgtttggaaactggcgcaggcgccatgcaaaaacacagggaaaagcggctactgattgcgaccatgccaaacccaagatggtggtgtttggtagcgctcagtgtagcagttttccctgtgttcctaaacaaacacgttcattaaagttcgccgtctgcgatttgaccgagcacagatttggacggaatgaagaacaattcgccagtttctggcgtcgaaaaatcaagcagccgatcagaattgtcaaacatgccttgcaacatacgcttggtgaccgtccaatgacgggcatagccaatgaagtaggttccgttttcgtttttggccggattactgaacgggacattcatgcgcacaattttatgttcaacgccgccgtcattatcctgagaaaccacattgtgggcatttggcagcttcttttcgtcagctaactcaatatcgttgaatttctttcgaccgatggctttttcctggtcctccgtcgtcaaatcgttccatgctttcatattgtgttggtatttttgcgcaaaagcataggagccgttttcaaatgtgggatcttcatcgccgatcaccgcatactctggcgtgtcgagtgcgcttggattttccgtgccgtcgacaaagccaatgatcgctcggccttcgaaatagcggaagccatgggtttcatcgagtgtcacagtctgatcgtcaatgatggtcatgatctctgacatgagttcgaacggaacggctgaattctgcgagcgaatgtggaagaacagatcagctggggttgccactgcggtatattttggcccgacaactggttggaattcctccaactctttaggcaccggtgctgctgggaaaagataatcccaagcttttcgcgacaagccaaatgcaaccgccaattttgcatctgggtagcgaatgttcatgctattgatgaatgctggtaagtgctctgctaagtcggcaatcatggctttgtcggctgcggcatcttcgcgcttaaggtcaagcgtagcaaaaataatgtcagacccggcatccttatagacatcctgtacatcacgtaaatttatggtcatcgttacgcctccaaattagaatcattctaacctactatagtctaccatagcggtggctgattgcaacgatttcgcgatgtttttaacctaggcattcggtggtaaagtaagaacaaaggttgtgattgtttgataatttcagtagcagatcaagccgaacttgtcattcgactggtggtggctgcactttgcggctttgccattggctatgaacgcaagaatcgcttcaaaaatgccggtatccgcacacatatgattgtggcgttgggtgcggccttgattatgattgtttcaaaatacggcttttttgatattttagatttgaaaaatatggcattggatccttcacgtgtcgcggctcagattgttagtggcgtcagctttttaggcgctggcgccattttggttcgccacaataacgtgaatggtttaacgacagctgccggggtttggacgacagcggctgtggggatggcaattggggcgaagctgtacctcatcggcttggccgcaactgtcctagtgctctgcattcaagtcctgctccatcatcactatcgctggctgcccagcggtgataacggcattttgacaattcgggtccgcagcgaaggctttgacatggtacatttacgcgaaacattaggcaagtaccatatcaaggtcctgaatgtgtccattaaacatgaaggcgacgaagttaaaatgaacctgcatgtggagagtaaagccaatgaagacatgcggcgcctgctgacgttttatgccgacaatccgaatattatttcgattgaattctaggcaatcgctaattaagttggctagtaccgtctgcatagttgagggtcacaccaggctgaacgttgaagatgtagacattaaaatgaatcgtgttgtcgccgatactttgcgcacgcatcgccacaccgcgtggtaacagttcatcaccgcgaaagatcggggtcacttcataacgaataaaatgctggcgtgactgtttcaaataatgtgccatatcatcttcatgggcctgcatcaacggcgaatttaactgccgcgtcccagtcatcaaatttttcggattattattttcaccggaaagctgaaaaccaattaaatggctgcgtttgtacagccattcgccatgcactttcttgttgtgccacccagttggattccaagtcagcggctcgcgcttggcagttggcatgatagcttgattcagtaaagcattggcagtaccagcacggttgagactatcgagattgctaaatgttgtccacgggccttcatcagtggcaagttctgctttcgtaaaaccaggctcgttattgttgacggtaatctcggcagtgttgttgtaattgagctgcgccagttgcgtgaccggctggcgcgaggtgccatccgttgccggcacactgttgctaactgaacttgattgcggcggtgtccccagcagtgaagtgtgttgctgcgtgtaggtataaccgccgctggctaagccaaacaacagcaatgtcgtcgccaaccgccgattcgcccgccgttgccgctttgtgccttttcgcagcaaaagcagcagcatgccagcgagaatgagactgaatgtgatgaggttattcatgttgcctccaaatagattagttccatatcaaccggaaactgggatcggataacgcgggtaaattgttctgaatagtctgaggatagcatattcttccaccatgtgagctggcgtctttcagttcgcttaataacaaaatacgccgatgctgaaccgattccttatttttatcaattatcgttggcccataatgtccttcgccaagtgactgaccatgttaagaattccaaaagccgaataatgcatttgtgaaacccccaaatatctgctaatatatgtagaaatcttttaagcgaggtataaaattgctcacagtaaacaatgtatcgatgacgttctccgaccgtaagctatacgaagacgttaatttgaaattcacgcccggtaattgctatggcattattggcgcaaacggcgcgggaaaatcgacttttcttaaaatcatccaaggtgaactgaccccaacgaccgggacggttagtttgtcgccgaatgagcggatgagcagtctgcgtcaggatcactttgcgttcgacaatcaaacggtgatgaacactgttttgcaaggttgggaacgactttatcaggtgatgacggaaaaagatgctttgtatgctaagccagacttctctgaagctgacgggaataaggcagccgagctggaaggcgagtttgccgaaatggacggctggaacgctgaaagcgacgcgtctcagctgttgcggtcactgggcattgcggaaagtgagcaccagaaactcatggctgatctgcctgaaggggagaaggtcaaggtgttgctcgctcaagcgttgtttggcaaacccgacgttctgctgctcgacgaaccaaccaacgggcttgatccgcaagcgattaactggcttgagaactttttagctgactatgaacacaccgttttggttgtctctcatgaccggcatttcctgaatgcggtctgcaccatgatgtgtgatgttgacttcggtaagatcgaactttatgtcggcaactacgatttctggaagcagagttctgaactggccttgcaactgcaaagtcaggcgaatgctaaaaaagaagagcagatcaagcagcttcaggaattcgtggcgcgtttttccgccaacgcttcaaagtcaaagcaagccacttcacgtaaaaagcagcttgaaaaaattacgttagatgatattcggcctagcacacggaaatatccgtacatcaagttcgaaccagaacgcgaaatcggtaacgatttgttacgggtcgagcatgtttccaagacaattgatggtcatgaagtactgaaaaatgtcagcttcattttgcggccaggtgacaaaacagggatcatcagccgcaatgacgtgactgccactgtgctgatgcagctgctggcaggtgagcttaaacctgacaccggcaccatcacatggggtgtcaccaccagccgtgccgctatgccaaaagacttgaatcctgaatttgatcatgatgatctgaacattctcgattggttgcggcagtttgcgccacaagacgaacaagataacacgttcttgcgtggcttcctcggtcggatgctcttttctggggatgaagtgctcaagcaactgaatgtcttgtctggtggcgaaaaggtccgttcgtacttggctaaaatgatgctaagcaaggcaaacgtcctcatcatggatgatccaaccaaccatcttgatctggaaagcatcaccagtttgaacgatgccttgatcgacttcaaaggctcattaatcttcaccagtcatgaccatcagttcattcaaaccattgctgatcatattatcgaggttgggccactcggtgttgttgaccgtgcggacacaagctatgatgaattcacgcaacacgaaaccgctcaggcccaggtagccgatatttatccggctgataaaaagaagtcaaaggcgtaattgccgatatcaccttgagcgttacagcttgtgacatcatacgcagttactgtacaggcgaacaattttccgcagtcagggaaattgttcgcctgtttgtttgctcatggataacttattggaatttataaaaatcccagtgccaaggcagagcaatcgtaggccagatggggtcgaagcgccgtctccgctctagctgcgcatcgccagcccagctggccggagattccggtgtttgcacggtaggggactcttgcatagagcttttctgcattgtttggaatctagcacatcataattgtttgaattttagaattcttgctcatctctacttcaattttgtttttcaaacccatctgatagataatatcagcataagtaaccgacaagataagtgtgtgtgacccgcgcaagttgttattgaaagtctcaccaatctggtcacatcagctaagaaagcagtgatcaatatgtcacaacccattacgattcttctcagcgtcaccggctttattgttgcgatgattgtcctcaatggtttgttaacctggcagcgacagcaaaaactcaagcgccaattgctagctgactggggcactttccctgaaaaacggccaaaaggtgagcgctatttaaaagccgcctatcttgatcatgaagcccaagttaatcacgattgccaagttgacgacctgacttggcaggatcttgatatgttagacgtgtttgaacagctgaacgtcacccaaagtagtgttggcgctgaacgggtctatgcacaattgcgggcttatgatttaggtaaaccagctgttgacgaggcgttgattgccttttttcaagatcatcctgacagccgattgaaagtgcaaatggcgtttgccggactgggcatcgagccggcgaacaatagccaactttatctacggacaaccaccaaaaaagccttgccgaatgcatggcgattcaaagtaatgggcggttttccatttatcggtgtcttgttgacgctattgtggccggcaattggggtgaccttgatggtggtcagtttgctggtcaacgtgttctactacattttgaaacgtgaaggccttgatgccgaaattacgtctatgggttaccttgtccggacgattatcacagcagaacgtctcgccaaaattagccaaccgactcaagcagcattgcgacaagcagttaaaccaatgcgcggcatcacgcgatttgcgtttgtcttccggaccaagaccggcagcatgggcgacattttaactgagtatcttagcattatgttcatgctgagctttattgcctacaacacagtgctcgatcgcttaagcagccaccatgctgaggcgctagccctgtggcaacggctgggcgatttagagttggccattgccattgctaattttcgcgcggcggaagcgactacaacgcagccagtttttgctaaaggcggcatgaccgctactgacttagcccatcccttgttgaaacatcccgttgccaacccagttgactggcagaaaaatgcgttgatcaccggcgccaatgcttccggtaagtcgacctacgtcaaaagtattgcgatcaatgccattttggcacaaacgatcaataccgtgacagcgacaagtttcacgatggagccgggagaggtcatcacggctatggcggtgcgtgatgatctgagtgaaggcgatagctattttgttgcagaaattaaagcaattcggcggttgctcaatgccgttgctaaaaagaagcgcgtctatggttttatcgacgaaattttaaaagggacgaacaccgtcgaacgaattgccgcttcagcgagtgtcattaattggctaaagcaatatccgagtctggtcgtggttgcgacacacgataacgaattgacggacattatgggcgatcaatgcgtcaactggcattttcaagagaaagtgacgaaggagtatggcgttgtctttgactatttgctctatcaaggcccggccacttcgcataatgccatagcactgttggcaaccatggactatccaacgtccttaattcacgatgcgcggcagttggctgcggattttgaacgtagcaaagcatggcctaagtttgttaaaggagggattcaagcgtgacagatgcagataaaatatttgaggctattcgtcagaatcccgataacgctgactttaccgcccaaggatgggatccgctatatcatattgaacctgaagcaacgatcctcatcgccagtcaggcaccaggacgaaaagcacaaacgacaaaaacatactggaatgatccgagtggtgaccgcttgcgaacttggatgggcgtcaccaaggatcagttttatcacagcggtaaaattgcagttttgcccttagatttttattatcccggcaaaggtaagtcaggtgacttgccaccgcgtaaagatttcgcggccaagtggcatccttctttgttagccttaatgccaaagattcaacttacaattgtgattggcgcctacgcccaaaaatattatttaggaaagcatcgcgaaaaaacgctgactgccactgtcaaaaatttccgggcgtatttgcctgactattttccgatcgtccatccttcgcctctaaactatgggtgggttaaccgtaatccatggtttatgaccgatgtggtgccggcattacaggcgcaggttgcagacttgatgaagtagaatgaattaatgtgacgcgctcgcaggagtctacacataccgaccttgaaaaagtcaggccatcattcacagccctcaaataaatgcgaacagattatcgcaaaaggtttttgtcgtcctagatctcgtgcataacttatccggatataaggatgaaggcggagcaatcggaggccagatggggctcagccgtgcaaacaacacagcgaccgggctttgtcgctgatgttgttaggcgacttcgagacccgtttttgggctcgaagcgccgtcacagcgttccagccccagctggccggagattgcggagtttggcacggcggggatttgttagcccagctcttttctggattatttaggatttgacaaatcataagatcacttacgttttgattttcaggtgctactgtgtagtcacaaaaaagctgagatcgcggaaacgctccgccgcgatctcagctttttaagtagccgtttgcttgaataatttaatgagtgattgaacttatggtaatgtcacgaaaatgagtgcgccaacaacgccgccagctaaaggaccgagaacaggtacccacgagtaaccccaatcagaaccgcctttatgtgcaatcggcaggatggcgtgcgccaagcgtgggccgagatcccgcgccgggttaattgcgtaaccggttgtccccccaagtgacaatccgattgcagtgatcaagataccaacgcccatcggagctaaacctgctgtccatttgccttgcgcaaaagctaataggccaaaaatcaagacagcagtgccgatgaattcagacaagaagttagcggtatagttgcgaatggctgggccagtcgcaaaaacgcctaagatggttgcttggtcattggtcttcgtccaatgtggatagtaatgcagccagacaacggcggctcctaagaaagcaccaagcatttgggcagcgacaaacggcagcacccatgaccaagaaaattgaccgatggcggcaaaagcaatggtcaccgccggattgagatgggccgggccaaggaaagcggcggtataaacgcccatggtgacagccagtccccaaccaagggtgatggcaacccagccagcatcctttgcttttgattggttgagtgacacgccagccaccacgccgtcaccaaggagaatcaggatgaaggtgccgataaattcacctaatgtttgtgtccacatgttgattcctctttctattcaggatgaaccggtgctggtgccgtttttagataggccagttgactgtcggcaatggcagcattcaaggcggccagttgttgggctttcaccgagtcgtcccatcccagtgtttgcgccatttcgtcaacaaccggctgtttaaactcagccagtgtttcagcgtggaaaagtagggcattggttcggcgcaagagataatcaaccggtgtgagcgtcatttcttcattgagtgaataacgcagactcatggtttccttcagacttaatcctggcgcagggccatcgacagcgtaagtgagcactcggctggtattggaaccgaagcggttagccagatcttgggcttctttttccgataaaccagcatcaacgccaatccgaatgtagaaggccatggtttcttcaacattggtcggatcaaaatgtccgccggaaacttgcagctttttggaatcgactgctggcgcgtcaacgttgaaacggtcgaccagaatacggcgaatcagtgcgagggcaccagtggccattttccgatagtccgtaattttaccgccggaaagggtgatgagcccgtctgtcgcctggtcaagcgaactgccgcgagaaacttgggatgggcttaatccggcttcggcgtgtgctgtttccagtttggaaatagcacgttcaacatcggcgcgggtcgcctgatcgtcttcataagcgttcacaacctcgatcaaggccgcaaatgaatcgtctgaaaccttgccgctgttagcaccgccgccgttataatcggaactgccgttgtcgttgatcagtggtcgcaacccagcccaactagcttcaatatcgtcgatcgtcatatggctttcggggaagcgtttattgacgactttcagcagataatcgacatcttcttgctcaacgcggggatgttcataatcgccggtataatctgtatcagtggtaccaaaatacgttttgccttctcgcggaaccacgaagaacatccgaccatcgtttaagccagtatccatgtaagttggttgcggaactggcaagcgagaaccgtcaacgactagatgaacacctttggttggccgcaaagttggcgcgtgtttttcgtgatcgtcaagtgcattgaacttatcagcccatggagcccatggaccggttgtgttgatgaccagtttggcatggatatcgaattcagtgtcgtccaacaagtctttaacatgcagcccaaccacttgaccagcgtcattgtgcagcatgccgaccgctttaacatgactggccatcaagccgccaagttcgtcagcttctttgatgttttcgatcacaaggcgcgcatcgttgttgacgaaatcgagataaacgccaccgccttgcaggttatcagcggacaattgtggttcacgttgaaggacttcatcttttgtcacggtataattggcgtactgagaaccttcaacaccagccaatcgatcatagagatccatggcaattttgacgctgaacatgtcaaacgtactgccggattcttgataaattggcaacagcattgggaatggccgcgggatatgcggcgcgatcccttgcacgacggcgcgttccttaacagtgtcagcgacaacgccaacatcaaaagatttaagatagcgaataccgccgtgtaccaatttggtcgaacgcgaactggtgccttccgcaaagtcctgcatctcaatcaaaccggttttgatcccgctggcagctgcttgaatcgccaccccagcgccggtaatgccgccaccgacgatgagcaagtcgagctcggtatgctttaactgatgaatcgtttgtttgcgcgtttcgttggaaaataccattttgttctccttcattacggatcgagtcagtctcgatcattttttggttgacagatcaggctttcttcgccttgtgcttatacatttgggttgcagcaacagcttgctgccagccttcataaaggtggtcgcgatcaagcgcgcccattgttggttcaaaacgtttgccaagcttcacgatactttgcagttcatcggtattgttccagaagccagtcgccaaaccagcgaggaaggcagcgcccatcgccgtcgtttccaaattggctgctcgttcaatcggaatgcctaaaatatctgcttggaaatgcatcaggtaatcgttgttagctgcgccgccgtcaacgcgcaaagcttggatcgggataccagtgtctttattcatggtatccacgacatcacgtgactgataagcaagagattgcaaggttgctttgatgaaatcttcgcgagtcgtgccacgagtgatgccaaaaatagcaccgcgagcatcagaatcccaataaggcgcacctaagcctgtgaaggctgggacaacataaacttcattttgactcttagaagctcgtgcggcggcttcggagtcgcttgaacgctcgaccaacttcatggcgtcccgcaaccattgaatcgcactgccggcaacgaaaacggaaccttcaagtgcataggtcaccttgccatcaagtccatagccgatggtggtgagcaggttgttgttggacaaggtcggtttttcgccggtattcatcacaatgaatgcacctgtgccataggtgtttttcaccatacccggctcaagcgccagctgaccaaaaagtgctgcttgttggtcaccaaccatgccggcaatcggcacggtactgccgaagaaatggtaggctgctgcattgccgtaaatttctgaattgctgcgaacttccggtagcatttgcttaggaatattcaacaattggagaatctcgtcatcccaggctagtttatggatgttgaacaacatggttcgtgaggcgttggtatagtcggtgacatgaatggcgccgccggacagcttccaagaaagccaagtatcgatggtgccgaaaagcagttcgcctttttccgcccgttcttgcgcgccaggcacatgatccaaaatccagcgaatcttagtcgctgagaaatacgaatcaattagcaaaccggttgaatcatgaatcatatcgctgtggccatctgccttaagtttgtcagcgatctcgctagtttgccgcgactgccagacgatggcgttgtagattggcaacccggtctgtttgtcccatacaaccgtggtttcccgttgattggtaatcccgattccgacaatttggcgtggctgaatctgtgattcaataaacgccgtcgcgatggtcgacaaagcggcattccaaatttcattggcattatgctcgacccatcccggatgcggaaaatactgcggaaattcccgctgtgcatcaacaactttttgaccattgtgatcgatgatgatggtccgtgtactcgtggtaccctcatcaatcgccagaatgtacttctgatcacttgtcacaaataactaccccctgtgaaataatattgtacacaatgaaaacgtttccagaaacagttataccgtacctcgtgacattctgtcaactttaaacttatgtgtatcattagttattttaaaaagttaaaaaaccgatcaaaattctgtaaatgagatggaaatggaggttgtgctgcaaatgagatatcttgaataaaaaaacgcgtggccgatgaacgttttcatcagccgcgcgtattttgcttaggatcatctgacctgctattggatgagctggcgcatgcgatggatccgctcaaaaatctggtcttcctgacggcgatcagcccaagaaaaattgtgcatcgtgctattcgggcgattaaccttcgtgtacaaaatggttggattataagcatatttgccaggcgtatgcgcgacaaaatccgccgtgaagtaatagtcctcagcaatgcgtaattgttcatcatagcgaatattaccggcagttaaagcatcacgagagaaagccttgttccaaatataaccgcccacttcggagccgtggcgtgagacttgatcaaacatttcacgctgtgacaacaattgaaagcgattgggcccgccgcggctgcgatgccaccaatcataaccaaccgcagtggccacaacacccgatgtgaacccgtgtgataacgtttcggcaaaggtcggcgcgattaaatcgtcaccgtcgacaaacgccacagcttgaccagtggcatgatcaatgccaaagtttcgcgcagcaccgatgccacgatggtcattaaaagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggaatgagatacatatgaattatttcaaaaaaaatacctgctgtcattcaactgctgctcattacttgagtattcgaagaacaacgccagttattgatatgccgtcataagtttttaatttaatcatcccagtagcaatatatttatacttaatgaaaaataatctatgaaactataaatcacttgcaaataatcactcatttatggttgagatagtgcattgaatgcggttacaattcctttgactggtaccaaccactaggcctatggcgggtgtcggtctatgaaaaagttttaggagggtttttcaatgcataatggctcaagcaccagcacctgtaagtatcgtgtgccacgctctttgttatacagcagcgcaatcctatcactaaccgcagcggcagtatatgttgccagtgcctttgatgtcgcggcagccaaaaacctgttcaagcaacaacaactagagcagccaaaagcatgctcaatatcgtgaacgtaagcaagcaagatgattattttgaagtgacctattcaaatgacctgaaggcgcgtctctttatcttggccgacaatcagttccgcttttacgttgacccttcagaaaaattcgcggcaccggcccaatcgggagaagggttgaatgccaagatttttaccaaatcaatcaatgcgtcttcggtaaaagactttgcgtctgctgccttgactagtactagtgacggctggtcgattaaaactggctcgctcgccattaatctaaacaagactgccgctaccttgcaagttaaacgcggcgcaaaggttattatggccgaaagtcagccacttagtatcacagcagacgatactacccaaacgcttaagcataacaacgatcaatacttcggcggcggtacgcaaaacggtaactttacgttaactggcgaaaagatcaaaattgtgaataccaacaattgggtagacggcggcgttgcatcgccaaatccgttctattggtcaactgctggttatggcgtcatccgcaacaccttcacgccagggacctatgactttgatgccgcaaataatggtgaaattaaaacgtcgcatcaagaaaagcggttcgatgccgtctatttcttcgatgacaaaccgtacaacttgctaaaagactactacgatttaaccggtgcgccagcgatgatgccaaggtatggcttctatgaggcccatctgaacgcttataatcgtgacacttgggttgaagttcctgaaggcaccagtggcggaatcagattcgaagacggcaaattttataaagaataccagccaggaaaagtacccgctggtcaaagcggcacaaaggaatcactgaatggcgaactgaacaactatcaattcagtgcccgtgcggtgattgatcgttacaaaaaaaacgatatgccactgggatggtttcttcctaatgacggttacggcgccggttatggtcaaactaatacgctggctggcaacctaaaaaacctcaaagattttgcggattatgccggtaaggaaggtatcgaagtcggtttatggacacagcaaaatctgtcgccagttgacccaaataaacctaagccggatgatcgcgatttttcaaaagaagtcgctaatggtgttaaagctttgaagaccgatgttgcttgggtcggtgacggttattcttttgggctggatgggcttgaaaaagccgacaacatgatgaaaaaagtcaaaggcgatgacttacggccttttggcatcacattagacggttgggctggcacacagcgttatgctggtatttggactggcgatcaaactggtggccagtgggaatacattcgtttccacattccaacctacatcggcaccggtttgtcgggccagccatacgttggttccgatatggacggcatctttggcggcggaaattcaattgtcaatgctcgtgactttcaatggaaggccttcacgccaattcaactcaacatggatggctggggcagtaatccaaaaaccccattttcttttgatcaacatacgactgatatcaaccgagcctataccaagcaaaagacgatgctcatgccatataactataccgcctctgcccaaagcgtttttgatggcaagccgatggttcgcggtttattccttgactacccaaatatgcctgaagcttacacggacttggttaagtacgaatacttatggggtgacaacttcttggttgcatcaatttaccaaaataccgcttcagacgatcaaggcaatgatgtccgcaatggcatctatttaccggacaaggatcaggtatggatcgactattacactggtaaggaataccgcggcggtcaggtcttgaacaattttgaagctcccttgtggaaactgcctgttttcgtaaaaaaaggtgctatcattccgactacaccggcacataacacgcctaaggaaagggatcaaaccaagcgacaattccaaattttcccaatggctggcaaacaagacttcaccgtctatgaagatgacggtatctctcgaaaatatctaaagggtgcctacgcggaaaccaaagtgacaagcaacctgcaagagggtcagcttgaggtcaatgtggcgcccctgtcaggtgattacacaggtttgaaatccgaacgaacaaccgaatttgctattcgcacgagtggcaatcccagcaatgtcattgcaactgttggcagtcagcaagtcgctttaaaagcagtcaccaatcagaaagactatgatgccggcgaaaatgtttactttgtgaatagcgagtaccacaccaatcagtatctcgaaaagctgaccgacaagaaggctattgaccaaaccttcctccaagtcaaacttgccaaaacaaacgcggcaaccaatgggatcaagttaactgtctctggtattgatgctaaagatgatccgtcaaccgacgatctgccagtgaatgacgaattggcgatcccaagcacaatcaaacaagatgaaaagacgacaacagacaccgcggttggcatcaactggtcgcctgtaacagacgcattaagttacgacgtcaaagctgacggcgtggtttatcgcagtctcaaaaaaccagcattcgttttgtcaccggttaaagaacaaactaagcactcgttccaagtacgaacggtcacaaaggatgccgtgtcgaaatggagtgataaacaaacctttagctctgatgaaaatccgttgcgcttagcactgaaaatgaccaacttgaaagtcgattcagccattaaggatgtcccagtatggcaaggcaaacaaacggtcgataaactttttgatcaagacttaaccaccgaagcccacaccaactggtttaccagcggcgagaagcagtcggcaacgccgatgacgattaccgctgacctagacggtgtctatgatctcgatcatctcacctacgtaccgcgagaaaatggcggcaatggtaatctatcagcattgaaagttgaaaccagtctcgatggtattcattggcatgaagctggtgaaggcaaagggtggacatttgatgctcaagaaaaaacaatttcttttggccaaaaggaaaaagcccagcacattcggctcaccatccctaaggcatcaacgctaggcgactttgtttcaggcaaagaatttctgctatttaagcgtgacggtaccaacaaacaagtattaggcgatattaccaacgatggcgcgattactggtgatgatcagatgtcgctcgtgaactatgctggtttgacagctaatatcgacagtgacttcaatggttacgttcaaaatggcgatttaaaccaaaacggtgtgattgatgcatttgatatcaactatgtgatgcccaaactcggcaaaacaccagtatccaaaccagatgagaagattccaagcggcaccctagccttgcagtctgataaaaccacttatgcccccggcgaaaccatcacgctcaatttgattggcaaggatctgacaaacgttaatagcttattcgcccggttgccattaaccaacccaaatgttgatttaattcgggtcgaacccactgctgcaaccgcaggtatggtcaacttcagcaaagtccgcacgcattcgaatagcagtcgcgacctatatctcattttcgcaaatgaaggggaacaaaagcggctcactggcaatgaaaaactggcaacgatcacacttaaagcaaaaacacagttaacgaaagccgatctaagctttgctttgactgatccaatgcttaccaaccagtggggaccagaggctttgccggaagccccagcgccaattgtgctgcgtcctgaagacaattcagagcataatcatgctaaagagcagctagcggcattgattgatgctgtgcatgccctcgatccgaagctattcaccgccaccagttggcagcttgtccttgcagccagtgaaaaagccagccagttgctcaaagatgacgctgtgtccccatctgatcttacagctgcctacactgatctcaaaaccgcattgggcaaactggaagcagatcgcggtgtcaatcaagaccaactgaaagcactgatcacagcagctgcaacactaaaggcagaccgttacacgcccgaaagttatgccaacttgcaaaccgaaataaccgctgcaaagaccgttagcactgatgccggtgcctcacagaaacagattcaggaggccattcaatcacttagtcgtgcttggtttgcattagtcctcacgcagacacagccgcaatccgacttagcacagtgggtaagagttgcagaagccttaagtcctgaccaatacacgcctgccagctttgacaagttgaccgcagctctagcagaagcaaaaaaggcgcttgctgatacagcaacgtctgctgatacagctcaaaccttgtcaactcaactacaagccgccatcgatgctcttgtgccgcgcggaaataaacaacaactggccgatttgctaaacaccgccgagaaactaaaggcaaatgattatacccctggctcctttgcaaaattgacggaggttttacagccaacccgcaacgttttgaacgatgtcgatgcaactcaagatgcagtgacgaaggcaacagatgccttgagcaaagcgcttcagcaacttatcaagcagccgaacaaggctgaactcgtcaacgtgatcaccaaagcagcagaactaaaggagacagactatacacctgccagttttgctgatctaaaaaaggcattgacgtatgcccgagaagtgaacaaagatccagagacttctggggaaacagttgcaaaggcagtaactgacttaaagactgcgctcgacaaactggtcaaacaaacaccggctcccactcctgataaagaaaagccaagcaataacccgcctaaatcaggcggcttccaaggtgacaccacgattaaaaaggaccagacaaaagatccaaccaagaccgatcataccagcaacatccccgatactggcgaacatacccaatcaatcctggcactactgggcgcgaccatcatcggcgtactgggttacttgaagctacgacaacctaaaaaagacaaatagctactccatgactcatctcagaaagtgaaacagcttcatgagattgggatagtcttcatagccacaaaaagaacgaatgagttttctcaaataggggaaacttattcgttctttcttatatataaatgaataggatttaaagattccagtaccaagggggagcaatcgttggccagatgggactcagccgtgcaaacaacacagcgacgggccttggagctgatgttgttaggcgacttcgagaccggtttttgggctcgaagcgccgtctccgctctagcttcgcgtcgccaccccagctggccggagattgcggagtttggcacggcaaagaaaatcctgtctaacatcttttgtatcccgcgtaaaattgcccttccaaaatcattaacacctttataaatcactcaacctcacaaaaaccgatcccgtttttcctgaaaagcttgcacaataaggtgcccaacctgttgaccaaattgcatagccgtctgccgatcataatcaaattgtgtcagcaccaccgcatacaagcgctcaccttcagcggcaaaacaggccgcatcatgttcgcaatgaggcaactcgccagttttgccggctagccaaccgacgaagttttccatggtcggcgctaacagcagcttggtgcggttttgctgatgccgcagggcttgggcacagatatccgctgccggttcgttgccgtccgacattaacaaagcgcgcaatagttgccaggcagcgcttgcggtgatcatattatcgccatcaaaggttgattgcatcaagggtcgccgtagttggacgccaggataatgccgagttagccacgctgcaatggtcggcagcccatacgtggttaatagcgcattggtagccagattatccgataccgtgagcatcaacgtcagcaaatcacgcacgcgccaagcttgtggtgacatgaaacgtaaaatacctgccccgccgaccgattccggaagcgtcacttgccgctcgagttggctgggatcatctgccgctttttcctttacaaaggcggcaatgcccagtttgatcaaactagcagcgggaaatggttgatcaacctgcgcgccaaacagcacatgccgggtatcagcaaccaacaaggcgtgtttttcgtcaaagttctgattcacttgatcaagccgtgtcacgagtttatcaggcgtcatgcaaaggatctccaattgtaagctgtggtccgttcgtttgaatgcctgcttgctgctttttgaccatgtagaccgcgtccaaatctgtgaacgtaacattatcatgaaccgcggcaaacgcgatcgccggcaccagactcaggttactttcgatcatacacccaaccatggtcgtcacgccaaaagacgcgcaagctgcatcgatcttcgcagcctccgccaaaccgcctgttttcattagtttgatattgatgtgattgactgcatggcgactgagtaatgccagcgcatcttgaaacccaaagacactctcatccgccatgattggtaactgtcgcatagcagtcaacgttgccaggccttcgtgattgcgcgcagcaactggctgttcaataaaatctatcggtaactgcaaagccgccagttcggtcaccgcaaccttggcttgatcagttgtccatgcttgattggcatcgagacgcaggcgaatatcaaggcctgcagctttggcaatcgttttgacgcgctccaaatcatctgccaatcgaccaccaccgactttgatttttaaagccttaaagcctcgggaaacaaatgccttcgcttcgctcaccatatcaggcagcgcttgaatcccaatcgtcatgtcagtcgtgaccgttcgctgttgaccaccgagcaacgctgtcagcgggatgctaacctgctttgcacgcaaatcataaagtgccaattcaaccgctgcaatggcgggttgctccgatgtgctagcatgaagccgcgtcagcaaactattccaatctcgaatgtcacggccaatgagtgccggtatcacctgtgtctgcaagttttcctgcaaggtcgacatcgtatctcctgtcaccaccgcgttgggggtgccggcgccatgaccaactgtgccgtttgtcagcaaaacgtcaacttgaacagcatccgctgccgtcacggtatgcatcgctgttgtgaaaggccgcaccagcggtaaactgatcggccgtaactgtattttttgaataattggttctaatccggccatgaagtcgccacctcgaaaaattgggttaataactggcgcctaaccgccaaccatgcacgattggcgcggctaggatagattcgattggtcaaacagacaaatccgcgctgggtatcacgatcaaatgctattgatgtccctgtaaacccagtgtgccagtattgatgacgtccttgcgcccaacagcgccagccgagtgtccgaccgcctttacaaaagcggtcaagcagcacaaacgccgctggtggcagaacatgatcgccatttgtcacgggcagaccagccaacaaccgtgtgaaaatagtcagatccgcaagcgtggcgaacaaccctgcatgaccactaaccccatctagtaaaaaggctttgtggtcgtgaactgtcccacgaatgatgccaccgcgagcaggcacgttttcggttggcacaaaatccgccgcagccacgtgttgcggtcgataaccggtcgcatgcatgcccagcggtgcaaaaatatgttgcgtcaggcttgttgccaaatcaccatcgagtgcagcaatcgcccaaccgagtatgatgtagttcaaatccgaataaatcgtctcagtgtctggtgcagcgacagcagccattgttttgacggcatgaaccagccccgcttgatcgagcgcatgggcatcagggacatctgctggcaagccactgcgatgcagtatgagttgttcaatcgtcagttgtgggtagcgcaaaccgctgaccaacgagcctatgggttgggttaattctaacttgccggctataagcaactgcagcagtcgggtggtcgtgccgacaactttcgtcaacgacgccagatcataccgcgcttgcggcaacaacggcagcctgtcatccccggcaccttggtagccgatcacatgcaaggcattttcttgcgggccaagcagactatacgacacgccgaaaaccgcgccatcagttatcgcctggttaaccgttggcagcaaagctgtctgcttatttgtgcccatgctcggcctcccaagccgccaaaactgcactgataacaccatcatgatccgccaagacctgcgttgcatcggcggcatccagctcggttttagccatcacaattgcgactgggaccttatgtcccgctgctttcagcaaggttgcagcttggatttgatcaacgccggttgtggccgcaataatgcgttctgcgcgatctaccaacttggcattggttggcaaaacatcgaccattaagttttcaaaaaccttcccggcgcgaatcatgacccctgtcgacaacatattcagaaccatcttttgcgcagtcccagctttcatgcgtgttgatccggtaatcacttccgggccaacaactggggcaatggcgatatccgcatgttgtgccaagacactgtcagggacacaggccaccgaaatcgcaagcgctttggtttgttgcgcaaatgctaaagctccgatcgcatacggcgtccggccagatgcggcaatcccgataaccgtgtcattggcgttcaaattcagtcttttgagatcatgctcggctagcttcgcagaatcttccgcgccttcaaccgacttgaacatggccgacatgccaccagcaattagcccgactgcccgctctggcggaataccataagttggtacgagttcagctgcatccaaaactcccaaacggccagaagtgcccgccccggcataaatcaaccggccgccacgattatatcgttgcccggcagcatcgattgccgcggcaatgtggctattttctttggcgattgctggtgcaatttttgcatcttcagcattaatcaacgccaccaaatcaggcgttgtcattgtgtcgatgtgtgtgctggccggatttctttgctcggtcattaagtctgcgattgacatatttttcccctcgaatctttaactcacttgtcaattgtgacgttgcgcgataattctgctcagtttttttgatctcaccttgaacgaccccaagaaaaagaatgttcgcgacataagtctccgtgaacattgaggtcaccgcaccgattcgcaacaacggttctgtcggcggcaaggcaatcacgcaacttgccgcttcacgcaacggactcggctcgtgtcgtgtcactgcaattacaggcgtttggtttcgccgcgcttgctgagccgccaatacgacctctttagtcaaaccgctgtaggaaaaaacgaccatggcatcggccggtgtcgtataataagcgcgctccactgccgtgtgggtgtcgtggtcaaaaatggccacgtacccagcgcgaatcaatttcaaataaagatcctgagcaactagggcggaagcactgactcccaccagataaatatgacgtgcctgtcgcagcgttgtaatggctgactgcacggcagattgatccaactcatcaggcaaatcacgcactgcggcaatcgcagtctggcttaatttatgcatcatggtcgacaagtcgtcgtcatcctgaaccagcggatcaagtggcatcacctctgcaggtaacgtcttttcccgtgcgagagctagtttaaacgactgcaggtcggcaaactcaaattgacgaacaaaccgaatgacagatgcggccgataccccgcttgcgtgggcaatctgcgctgttgtctgtgcgataaaagtctcaggatcggttataacatgacgagccaaagcttgattcaccggacttaattgcgacagacgcgactgcaacgtctctaagattgtcttcattcggccttatcaataaaagttgcgatggacgttgcactttcgttgggaaccatttgcgcagtgatagtgactccctgtttcaataagcgccgaataatcgcaatatcgtctggtgatacggcaacggaaggcttgattttcttagtgcctggtttttccgacaagttgccaacgttaaaggccttgattggtacgccgccatcaatcaacttcgccatatcgggaatatttcgagtaatgacaaagacttgatcatctgcaaatttgccattctgcaaattctcgatggctttggcaacggagctaattgctagttttttccctgctggtcgggcgattttcaaaccttgaatcgccatctcatcgcgtaccacctcatcgttaaccaccattaagcggttagcgccgactgtgttcgtccagaccatcgctacttggccgtgaatcatccgttcgtcaacacgtgctgccacaattgtcattagaatcttcctttcaaacaacacgggccgatatcatcgcgcccgtgtttttcgcctatcatgattttaaactaaactaccgatccagccgaagatggcgcccagattgcccaacaccatcccgatcagaatcaggacaaaaattagtcgcgttgagttcatatgcttgcgacccagaatccagtatgagaacaaggcaattgctagtggaatcagtgctggcatgattttatcaagcatgtcttgcacattcatcgtgaccttgccgactttgtaggtcaggtcaagcttgtagttgataaccgccggaatcatcgcgccaacaaccgttaacccaaggatagaagcaccttccgtgaaagtcgccatgctatccgcaaaggttgttgccagccgggtcccttgtgacaagccaacttggaacaatttccagcgaacccataaaatgaccaagcaaccaatgaccggaatgagtaacccgattggttgattcgacaaagccagatatgccgtgattgaatagataatcgcattgtaaattgccacgaaaatcgtatcaccgacgccagcgaacggacccatcaagccagttttcagaccagtgatcgctttttcattctcatcgttcattcccaactgatcctgcaaagcaacatccgcgccaacaattaagtgtgccatttgcggcgtggtgttgaagaagcccatttccatattcagggcttgtttcattttcttaggatcgtctttatacaaccgtttcaaagctggcatgacagagtaggcatagccaagaccttgcattttttcgtagttccatcccaattgcagacccaacacgttttgaatgaaaatctgcttgagatcttttttagttatcttatttaatttcagttcagacatcgatctcgacctcctcatcggaatcatcgccgccgttgctgccgccattgttatggttgcttgggccgtggctattcgattcgttgcgcttgcggtcgttggcatctaaaacatgtagtgccgcgaagacgaagccaaccagcgctgtgcccagcaaggagaatgttttcatgaaataagccattaagacaaatccaagaatgaaatatggaaaatagcgtttgagtggcagataccgcatcaggatcgcgatccccatcgctggtaagataatcccggctgttttcaaaccaaccatcaaccatgctgggatccaagcgttgatcgctttaacaaccgcggaaccaaagaacaaaccaacgaaaaccggtagcattcgtgaaactgtccacggaataatcccgtaaaggttattgcgctcaacccctttatagtcgcctttttcagctaagcggtcagcgtgatgttggaaaattgtgttcgtcatccgcgccaaaatatccatttgtgtcagcagtaagccgattggaatcgccaagccaattccataagccgcgccccgacctgacatgatcgcaaaggcactgcccatgatggatccagacagaaagtcaggaacggttgcaccgccatacgttgcaacccccaatgtggctaattgcagcgttgcgccgacaatcaagccggttttgagatcacccataactagaccagttaccgccccgccaaacactggcgagaataatccgatcttaacagacaatgcatcaagttgtgcaatgcccacatagatcgtcaagaaaataagtgcaaaagcagatattgacatgatctttcccctccctaataggatgtcatgaatcaagtcaattatgccgccatatgaaactgcatttcaagtatttgcgtaagaataattgacattgaaattcagtttcttaaaaagcagcgtcattacgggtgtaccattttctaaaaaaaggcttacttcatatgagacacagcagcattcttctgtactacaacaggtagcgggcgcatcttatttcttaaaaagaattttttgaaattaaccatcatgacgatgctttctcagtccactttgtacagtttgccgaaaaaaacgccgcctcagggacgacgttagtaagcctgttattgtaattggaactttaacaccaccggattgtgatcggaatactggaaacctgtcgaaacgacacgcacactttcagctttaatattaggcgaaagaatatagccgtcgattaacgtcacaaaacttttacccggttgatacggttgatccaaggctcgaactgacggcacggcagccttggccaagcccatggtcgggatatgaaaacctgcagggagtttggactttgggaaaagatgggtccacgtttcatcgagatcttttgtgtggaagatttcagcggtatcttttaacaagcgatgattgtagtcgccagcaaccatcacataattaccttgcttgtaggcctgctcgatatatttaaacaacttggtgaactgtgcctgctgaatcttgacgttcggtgtgaatgccgacatgtgaatgttgaccatgacgaattgtttaccattcgccaccgtggttttggttgccgtaaaagctcggtccagatcaatgattttgttaaaatcagtgtccactggcaaactgtagcgccgggagctatcaaccttggctttacttaacgttagaataccggacttcgctttgccgatcggttgggtgaacgggtagaacaagtaagccgaatcataattctgaccgtatatattggcgtattgttgctgcgccccagtgaccatcttcacttcattcacatgttgtgatcgatcaccatccggatcaatttcctgatagaaagcaacatcaggattttgcgcctgcgtggttttgatcacaccattaatgctggtacgcacggactttttactgtaggctcgcgaatatttgccgccatccatgaaaaaactataacttggcgggtaggaaccatacccgatattgtaagtcatcgccgtataagtctggcccggtttaaactgcgcactttgttggttcttcacttttagcgcctgatcatcaggcacgcgataataagtggtgaataaataaatcaaatatccgccggcggccaacaacaagacaccgagaatgccgccaacccatttcaaaattcgtttcaccatcgttcctcccaaaatagttgttttgcttattatagcagttgtcttttcctctgagaccagtactatgaggatagacttttttataaaaaggggatcgccatgtcgactgaaactgacagcattttagctgctttcgaaaaattcaacaccattattatccatcgtcatattaatcctgaccctgatgcgattggctcacaaaccggattggccttgctgctgcgtgccgcttatcctgccaaaaccatctacacagcgggaccggctgcccccgatttagcttggatcggaccgcaacaacaagtgtccgctgaagcttacactggtgcgctcgtcgttgtgattgatacttctaatcgcgaacgcattgccggtgatcattttgatcagggagcgatgctgatcaaaattgaccatcatctggatgaagatcagcttggcaccatcaactgggttgacacccatgcttccagtgcatcagagatggtgtgggacttagtacgtcacagcccacagctgcaactcaccaaagcagccgccacagcactctacgctggcattattggtgacaccggccgttttctgtatgatttaacaaccgcccgcacccaccaagctgctgctgacctacttgcaaccggcatcgatgccgccgcaattggccgtcaagaagaccagtttccggaaaatgttggccgcttgattggttgggccttagaaaatgtcaaaatcactgacactggcgccggatcactcctcatcacaaaggccgtgctcgcccaatttggccttgcgtatggcgaagaacagcgcgcagtcggcaatatcggcaagctagccagcattgatcgctgggtggtcttcaccgaacgaactgatggcagctatcgggttgaactccgcggcaaaaccaaagaaatcaatacgctggccgttcaacacggtggtggcggccatccgctggcaagcggcgccgtggcagataatgctgctgaacttcatgctattgaagaggaacttgcatcgttataaggtgtcatgaagaatggtaatggcccggacgaatgatctaaacccaaaagccagagcgatgcctcatttctaatgaatagctgttgtgataacgattggtagacttggttttcaaaaaatacggtaaaatattagaatcgaggaaaagttgacacgtactagtgtgttttctaccttatcagtcaacaaatccatgatataatgactttggtttagaaaaacttttacggtcacatcacaatagccgtttcccctgtacgggaaacggttatttttttcacccgctgcgataaatcgtggacgacgggcgtgtgggttgaaggcaactgcaaagactatcgccgatcattcaacctatgttcgagcagcaggagtaccactcccacaatgagcggggcgacaatctgatttagaaaatcaatcacggtcacacccccctcccagggcagttgccatgtttgattatagcaaaggttgtggggcagacataaataaagagaaactataacgaacgttttttatccatttagtttaaaagcgttgctaatatgttcctattcctatctaattttatccctattaattcttttttgctaaaacaataaatcggtcttcaaacgttgtcacgctatcttggctatcgatgatcttctgaagttgatgcaactgcggcattactttttttacatcaaaatccggaaactcccatggaataaccgtggcataataaacaattgcgccaacatcagtgaaattcatttcctcaattttcaagtcaagtgcaacgatgataacgaattcttgatagtggtctaggctgttacgccatgcatcggtagtaatcgcatgggcgaagatagttcagaatacgtctgggacgatggttcagtgcggagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggggcgttttttcctatactaaaccttcgtcgaaccaagtacttaaactgatcatcggcaccatcattggcctctttgtgctcggtcacctaacaccaacactggcagtcagaacgcagcttttgatgcatggatactttcaaagtgccttttgcgcgaagattgcgcggtcatccgaaaatgcttatgctcctgcgtatagtcatgacaatgatggcactgtctattacgttaagccttcaccggtttcccacgaagaactcaaaatgacgagtgcccggccgaatcgttacgctgttcagacatttggtttgagctttgccaccatgacttggtataactgatgtcaattgaacgcaggtccactctccttcgtgacggcaatatttgctgttatcacaatgactatggctctggttcagctactatatactaggacatcagcgccaataacactcgctgcccttacgccgaaatttgatgagtcaactgtcccctttttaaataaatcgacactaaaagccgctcgatcagcgaatcgagcggcttttgcttgctacaatgacttatttaacaaaccctaacgtctgcgcaatcaggtaaaggttcaaaatgatcaggaccccactgatgaaccatgctgtccacttcacccaagcacggttggcgaactcacccatgatttttttatcactagtgtagagcactagcgggatgacggcgaatggtaatgcgatactgaggaagacctgcgagaaggtcaacaggttttcgattttggcttcgttgccatggtagtaaatcgcgaagatgagcactggggtcacggacatgagccgagtcaaaagtcgttgggcccagagtggcattttcaaatgaatgaagccttccatgataatctgaccggcaagtgttcctgtaatcgtggagctttggccggatgcgagcagcgcaaccgcgaacaacatggaaagcatcgggctggcgatcgcaccgacaatctgggagttgcttaatgcgttgaaaagatcaacgaagcggccaactgagctactggtgccgaagaacagcgctgcgccaagaatcagcagtagtgagttgacaatgaaagccatggtcagttgcaggttggaatcaatggtggagaacttaatcgcctttttgacttcttcgtgcttcgtgcgatcaatttttcgtgtttgcgaaatcgaggagccgaggaacaggtcatgcggcatcaccgtggcaccaacaatccccaaagagagatagagcattgatttgttggtcacgatatccgcgtgtggcagatagcctttcagcagttccgggacatttggttgcgcgagaatcacttcataagcgaaaaccaataagataaccagcactaaggtcgcaacaaccgcctcaatcttacggaaaccgaggcgcatgagcagtaagaggatcagcacatcggcggtcgtgataatgatgccgacaatcagcggcatgttgaacagtaatttcaaggcaatggcagagccaatgatttcggcgatatcagtcgccataatcgcaagttctgtaatgacccaaagaaaaccgcccatcgctttgctggtgtgatcacgtgtcatctgcgctaaatctctgccggtcacaataccaagacgagccgccatggcttgcagcagcatcgcaatcagactggaaataagaatgacagatagcaaggaatatttaaatgaagcgccaccggcaatactggtgatccagttaccaggatccatatacccaacggcaactaggatgcctgggccagtataagctgctaaagttttccaaaagcccgcattgtgcggtacttcaacactgccattcacctcatcaagacttttgcttggcgtatcttcgaagtgaataatgtgttcgcgttttgattttttatcttctgatgccattgtgtgaagccctctttccattggcttgaaatttgggtctaatttgagtatttactcaacatcgtccgacataaatatacacccttttggatacaggtcaagaaaaaggttaggcttgcttaacttattcgccaaaatcgctattgaggcaacaggctgcgtgctataatgggaccaacttgttgactttaagttttcactcaaacccacgagaagggatcctgacgtatggccagctcagcagacaacatcttgcatcagacgcaactttttaccaatttcaccgctaagcagaaactcatcatcattgcggccattgaggtttttgctgaaaaaggatacgccgcggccagtaccaaagaaattgctttgcgagctggggtggccgaggggaatatttacagccgctttaccaataaacgcggcttgctcaatgccatcatcgcaccggtgctgagtcaaatgttccctgatgagttggacgatttcattaagtctcgcctccatcaggactatgtctcattggaaactttcttgacggtgttaataaaggatcgcgtgacttttttaaaagataatgcccagatcatcaaaattgtactgtcggaattactgaatgatacgcaggtgcgggctcaggtcgttgatggtttcaccacccaatattgggaatccatgacacatgacctgaacgcgatggtaaagcgcggtttgattgttgattggccgcttgaagatattctgcgaacaatgtggtcgatgaccggtggcttgattttaggcttcttgtattttgaccaacctttggacgccaataccgtcaatcacgcgatcaccgccgctatcaaggccttatcgccgaactagccacctgctacttaccgctcacttctgttttgaaaaggacttttgctaatgccaacccctactgaaacctggcgtccggtcacgcgcgacgatgcgtcaggactgacacaattacaaattgattttggtatcaccgatgaaatgctgggatacgcccgtgacgattacgagcaaccgcatatggaatacgatgcagagagtgacacttttctgctgatttataatgtgcctagcgataaacctgataccgatggctacctttctgaacccatggcgtttctcgtcaccgatgaccgcctcatcacagttggcagccatgatgtgaacaataccaatgccgccatcgccaaaacagttgcgcgatttggcagcgaatcggtatacagccttttgtggcaatgcctgcttgctatcaccgataattttgtcacactggtaaagcagcaagacgccactcgtcgtcaaattgccacacgcttacgtgaacacacgaccaaaaaagacttgttgaaaatcgccgaacttgccttgagtgctgattttttggttcgagcaacgatccaaaatgccgctgttttgaaacagatccacgcgtcaacccgtgtgcctggcatcactggcacacaaggggaacaactggaggatgtcatcattgaagccgatcagattgcggaaatgatgaacttgtcttcccacaccttggatcacttaacggatagctacaacaccgttttgaataataacttgaatgacatcatgcggttcatgacagtatggtcgattttgctcaccgtgccgaccatcgtttccggcttttttggcatgaacgtgcccctgcctttcgcccacgaaccactcggctggattatcacgattatcatcgcggccatcttgtggatcgcattgggattgctgcttaatcggtacattcggaaaaattgaacaatctaactcagccgtgccaaactccgcaatctccggcatggcactggggtctttaaagctcactaggtcattcatgggaaagaaaagaacgtttcccattatgcgaaaaattattcgcctttacttagctttgctttggcgctgaagccggcgtccaattgtattattcagggttcgtgcgcctaaaccgagggcaatcacaacaagaatccacttcggcagcagcaagcccaccagaatgtaaacaatggcgacgagcaccatgagtgataccgcgcgatattcctcccaatcatgggcatttaggttttccttttttggtcgttcgccaatgacggatcggaacaaaataaattgaaacaaatcgaccataaaaataatgatggcaaataatgttgcactgatccgactgcctggatggtcaccgatgaaactggtcgcaaatggcactaaacagatgaacacaagatagaaaaaatttaatactaagaaattagtgctcggttgcgtaacggtatgtagtagttcttggtgaaatgtccagtattggccgaccaccgcaaaactgataaagtaaatgacgacagagaaaccagtcgcataaagatctgctatggtcagtgttttaggcaccttaatgtccaacaccattaatgtcagcacaaccgcaaaaacgccgtcagaaatggcatcaagtcggctcttactattttcaaacatgtgcatctgtcccttcttcgctttttatcataaccccaaatgacggtgctttagcgtatgattgacctatcaacgttcgacagcgtaaaaaaactgtgagtgccccatggtcacagtccgacctgacacacggcatttctaaatgcgctagatgacgtccattcaaattcttggaggagcaatatgactttttcgatctttgcctttctactgattgccgggatcggtgctggactaacgtctactttagctggcttggcttcactggtttcgtacccagccttgcttgcaattggcgtgccgccggtcattgctaacgtcacaaataccgcagcactcgtttttactggggttggctcggctgtatcctcactgccagaactccgtggccgcggtaaatttctctggcggctgatcttactggtatcacttggtagtatttttggcagtgccttattgctgatcgccccggcagccacatttgaaaaagttgtgcctttcttcatcattgccgcgggcctgttactactcttcagcggccgactgccaactcaagaacatcgtcccggagaaccggcacgcaccttaacatttggacaagaagccgctcaaaccatcgtcatttttgttactggcgcctatgctggctatttcggcgccgctacgggtgtggtcatgctggcaaccttaaccttgaccgttgatcaacctttcatcgtctccaattccatgaagaatttgaccggattcgccgccaatgccatcgccaccgtcatttacgccttcaccaccaaaattgaatggctcatggtcatcccgctcggcatcggtctgttcatcggtggctatatcggccccatcattgcccgccgcctgccggttcaactgttacgattcatcatcgcagccttagcctttttgttagcagccaagttatttgcgcaggcttatctttaaccagtattaaaaagcagtatcgcttgccttcacaagtgatactgctttttaattactcaaaacagccacaccgctaacccaaacaaaacaagatggaccagtaatctgatgatgtgatgattcacatgcggtttaccgtataccgcgacgccattgaaccatgtcaccgtggacaaagccaataacccaatcaataaaacggtgagcgcactgaacttatcaggaataattgccgcagtcatcactaaggccgcagccagggccgtcagttggtctaaacggacatccccttgttttttctgccatgcttgccacgctgttaataacatcaaaaagccgtatacaccaattgccacacgtattgagataactgccattagcctagccttcttgcgcttgtaacacctgatccatcacatgcaagacgccgaattcatcgttactccgcgtgcgatatttggcatgttgcgccatgccttgcgttgcattggccatgatgtaactgtaaccaaccgtttctagcattggaatatcattatcataatcgccaaacgccatcatttgtgtcgtaggaatatcaaaatgacgactcaaaattcgcatgccgcggcccttgttcacgccgaggttctgaatatctagccaagtctcaccgctgacttgaacggtataattcttgccaaatactgggcggaaataacgttcggaatttttgcggctgtctttatttggaaaataaatcgtcaccttatcaactgccagcgactgcgttaacaaatccggcacctttttcaattggtgataaaacggcaaaagagctggtgaatattgggcatcagtagcattaatatacgcggcatccaaagcacacaggacaggaacaccgtctgttttcgtcatgataaattgcacgatctcacgatatttttcctcagggatcaggcttttcccgattaattggccgtgcgaataaacaaggccgccgttatcgcagaccatcgaaattcggtcactaaagtgtgggaaagtttcctgtagcgtataaagcggccgtccactagccacggcaaactcaatgccagcctcgccaaggcgatgaagataacgatcaaaatgcggcggcaaggtccctgcacttgtcagtaaagtctggtccatgtcactcgcaattaattttacattctgcatgctaattcccctatattatttgtctaatttcacttgctataatttaatgcggtgcgcctttagtcacgacattttcgatcaccgccgcaatctgttcagaatgctcaaccgtgccatttttcaaccattttgtcagcacgccaattgccccgtcaatgaagaacgcgtagtagtaagtgagaacacttttgtcggtctcaccataccacgattgatagctggtttctgttttttgtcgaattggatccgttatcttcttcaacaccacgctatcaggattattcaaaataatcgctgctgcttgcggctgattggcaatgacatttaaaatcggcaccaaccatgtggccatatcgtttattttaaccgttagataaggccgaattgcctcgaccaaatccatttcaatgcgttcgaacaaatcgcgtggagattgaaaatgtaagtaaaacgtcccgcgattcaaatctgcctgtcgacaaagctcagtcaccgtgacctcatccaatggtttcgtcgccaaaatatgcaacaaagcgtctttaaatcgatccgtcgtatactgaacccgccgattatccttcgtccccgacatcgtcatcctccgaacatcatttgaacaagttgtccatttaaaaacaaaacgaccatttctgtccttgaacggccggtttaaatctaacataatgttatgaaatggacaatgtgttgaagagcgtgagcaggcgcggttagaagagcgtgaacaggcccgcttagaaaccggagcataagcggcctatggctgggctttggccatttaggcttgaggtccttatgtgcaggtttctgggcctgtgaacgcgtctaagaacttcacacattgctcaccatccacgctaggaggcaatcatggcatatatcgaagtcaaacatgaatcaaaacgttacaaaatgggcgaaaccatcattacagcaaataacgacattaattttacggctgatcaaggcaaattaaccgtgattcttggtcccagcggtgccggtaaatcaaccttgctcaatatcctcggtggcatggactcccccactgaaggcgaggtatggattgacggcaccgatattgcgactttttctgatcgtcaactgaccgcttttcgccggcataatgttggcttcgtgttccagttttacaatctgattccgaacctgacaacaagggaaaatgttgaactggctggctcaattgtcaaagacgccttggatccgacaaccgttttaaagcaagtcggcctaggtgcgcgactagataattttccgtcgcagctgtctggcggtgagcaacaacgggtggccattgctcgggcgttggcgaaaaacccgaagctgctgctttgtgatgaaccaactggtgccttggattatcgaaccggcaaacaagtcttgcagttgttacaggatgccagtcgtaaagatcataaaaccgtcatgatcattacccataatgcagcgattgccaaaatggctgaccggatcatcgaaattaatgatgcgcaggttcgcagtattcacgatgaaccgcagccaacgcctgtcgcagacattgagtggtaggtgagtcacgtcatgaaaccattaaccaaaaatctttggcggaacattcgcgactctttgggccggttcatcgccattgtcattattatcatgctaggtgtcctgctgttcgtcggcgtcaaggccacgggcccggcacttaaggattctctaaacaccacagtgaaagccgatcatctggctgatagtcagttgctggcaacgactggtgtcagtaaggctcaagttaaagccgctgaatcagttagcggcgtgcaggcagaagccgtcaagtttaagtatgtcataggcggccgcgccagcgatgttgttgcgctttacggctatcaaaaagggacaaccatcaatcgactgcatctcaccagcggacagctgccaacgcaagccaatcagattgtcctcgacacggcagctaaaaaaagcggctatcaactcggtcaaacttacaccttcaccagcggcagcaagcttgctcgacgtacttttaaaattagcggttttgctgattcgccagcctacatcgaagacactagtcgtgggtcagcgaatatcggtgatggcaccgtgcgttattttgcctacatcccagcaagtcagatgaagatgccggtcgcctcgcagctcaacattcgcttcccagctttgcaaacacgcgataccttcagcaaccgttacaaggacgccgttgctacaaaaatgaaattggtgaaacagcgcgtgaaggcgcaaggcgaaaaggatctgcgagcagcagtatatgccaacattgttaaaaccgctacggccaaagctcaagcacaattagcggcgtcaggcatgccggcagccgccgttgccgcagctgccgatcaagctatcaagccgcaactatcaacctttcagcaacaggccactgtcaaagctcgcaaacaactgtcaaccagcctcacatggcaaactcgggaagatctgcctggctttggcgattacggcggttctgctgatcgaattgccgccattgccaatgttttcccagttttcttctttcttgtcgctgcgctgattactttcaccacggtcagtcgcatggtcgaagaagcccgcgcgcaaatcggcacattcaaggcgcttggttacggcaaatgggcgattgcgcgcaattacctcgcctatgctgccttagctggtttattaggtgggatcatcggggtttttgctggcaacttgagcattccgcgcattgtcttgagcttgtataaaaattacattccgctccaacaagtcgtctccttgcaatggccgttgatcgccttgtcattgttattggcgctgatcgcaacattaggggccgccgccattgtggtccgcaatgaactaaccgaaaagccggctgccttgatgcggccgcgagcaccgaaatcagccaaacgcattttgctggagcggatcacgccgctttggtcgcgtctgtcttttaaccaaaaagtcagctatcgtaatcttttccgatacaaatcacggctggtgatgaccattcttgggattgctggcggcaccgccttgatcctcaccgggtgtggcatcaaagactcaatcactgctactggtgttcaacagtatggtgatgtcatccattatcaagccattgtgcgattggctgatggcaaaaagccagctgcggcccgcgacattctggctaaaagcaaagcttatcgcagcgcgggcacggttagcggcgcggtggctaagctcagtgctaaaggccatagcctgagcgatgttaatttgtttgccccagcaaacggcaacgatcttgaaccttatgtcagtctccgttcaacggcgtcaaatcgcaaactgaccttgccgcgccacggtatcgtgatcaccagcaaactggctaaggcactcaacgtgacaacgggcgatacccttaaagtcgccacaactaatggtcagagcaagcgattcacaattaaaggcattgctaagaattacgttggccattttggctatctctccaacaccgcttatcaccagctcgctggtaatagtgcgaaaccaaacaccttgctagtccgcttgcagccccaaagcagcaaacaaaatgatcgactcgctaagcaattgctcaatcatcacgcgattgtcgggattagtttcacgacgacagcaaagaaaacgttaagcaatatgagcggtatgttagatcctattgttttgatttttattctgctcagtgcggttttgtcattcgtggtcttgtacaatctgaataacatcaacgtttcggaacgcattcgggaactatccacaatcaaggtgcttggctttttcgatcgcgaggtcaccatgtacatcagtcgtgagagcattgtgttgacagtgatcggcatcgtgttcggctatctgctcggcaatttgctgacagcctacattttgtatcaagccgaaactgaggccgtggtttttccactcacgatcagcattgtcggctacctcacggccacgttactcatgttggccttcaccggcgtcgtcacctggctcacgcatcgtcgactccaacgggtggacatggtcgaagccctgaaatcaaacgaataacctacaattttgtcaggcagcgtcgtcacggcgctgcttttttcatacaaaattcatcaaaaattgggattaaaaaccttcatgatcgcaattttgaagcgcaaatgaagattgagaccaactcctaacagtcctgtaacgctgacgtaacattgacacagtaaagtagcctttagttaatcaaattaagggtgaggtcaaaaatgaaattcaataaagtcatgatcacgttggttgctgcagttaccttagcaggttctgctagcgccgtaacaccagttttcgctgatacaagcgacagtatcgcttccaacaaaagcgaaaccaatgcactgttgaagcaaattgaagatgcgaacacagaagttatcaatttgaacaagcagatcgataccaagaatggtcaaatcagcgatgcaacggctaagatcagcgcaactgatgccaagatttcatcactcagcggtgaaattgttgccgctcaaaagaatgtcacagcacgcaagaacaacttgaaagatcagttgatctccttgcagaaaaaggctggcaactctgtcagcggcaatgtctatatcgactttgttctgaattcccagaacttgtctgacttaattgcccgcaccatgacggttggcaaacttagccaagccagcaaagatgcgcttgatgccgtgacagttgccaaggataaattagctggcttgaagacggaacaggaaaatgcccgtcagacgctggtttcaactaaggcttcattggaaacccagaaatcacagttggtttccctacaaaaagatgctaacgataaacaagatgctttgaataaacaaattgctgatcataaagatgagttggttgctttgcaaagccaatttgcccaagaacagtctgaagcagctgctgcaacccaagccgctttgaagaccgttgccgcttcaaccgcaagttcttctactaccagcagttcaagcagcgcaacttcaaccagcaccatcgccaacaacacatcaagttcttcaaacaacagttcttctgttatcaccaacaacacagcttcaggcagtggcagccatgctgacttcagtggttcaggtaacacctatccttggggtcagtgcacctggtacgtcaaatcagttgcaccatgggctggtaatggctggggcaacggcgcacaatggggcggttcagccgcagcagctggcttcactgttaaccacacgccagcagccggctcaatcatcgtcttcgccgctggtcaatccgttggcggtcaatggacagccgatggttcatatggtcacgttgcttatgtccaatctgtctccggtgacagtgtcacgatcagccaaggcggcatgggcttcagctcaccaaccggcccgaacacccaaaccatctctggtgcaagcagctacgtttatatccaccggtaatttttacctacccttaatcacgtcttgggatcacatcacgatcccaacctaaacgcgttcgccagaccagaaccctgcgtgtaaggaccctgaacgcaatgaccaaagcccggtcatcacgttcaggcccacttacactccggtttctaaccggtctggctcacgctctttcttaaaaactaccgagttatctaaaagaagtcacaaagaatgttcgatcgcattccttgtggcttctttttttggcacttaaggaggtttatcagcaactatttcgcttgttcgagacacgccccggtagcaatcaaacgcgacatgacaggaatcgcaattgtcaccagttatgatacccaacacggaatcgatatcggcttttcaccaaacgaccttgtttatctctgctgctgtctgtaactgagacgcagcataacactatcaagtctgaatttttgttggtatgatacgtgtacaacaatgcaaaattgattcgtcctttacagcacgtttaaaggagcccaataaaatggtgtatctcaacacaattttacagctactcatggctttgttgctgctggcacagctactagtcatggccacggcttggttcaccaacgccgtcacaatctggcagcgccttagcatgacgttcactgcactagtccttgctggcggccaccttgttatcatgtatggctttggctatttggcagatgctcatgttcccattgccggttggacttggtttgctttggcggcggcagtcctgcttctgcttgcaaccatcgcgggagccagcagacatgaacgtagaagcagtcaccgatgaaatgacggtctcacactgaacaattgtttcacttttgattcgctttttaaatttcaggtgtgtttatacaagcaatacattcaataactatcgcctcatttatatattaattatatttttatagttataaattgattttaaaacacattgacaagtcgtttccctctgtgtatcctatcgtttagaaaacgttttcttggcggggtgatttattgcttgataaaattacttttaaaatgtatttgcgtttctctattttaggcatgctgctatgggctcaacacacttccgaagatcaaactggtaagatcgccttgtctctgaatggtggttatattctcttttttctcggcggtatgttgcacagtcctgaactatcaatgatccctatcttcttgcttatctatggaaatgctaactttattaagcatattaagggtgatgaaccgtatcttttttcaaacgttggtagtctcttgatcatgactgtttgttttgcaacgatttttttgatgaaatcacggtacgcatttgttctaatacctttgttttcattatgctccaatagtcttttagtcagtcttcaagtctccgaaaaacacaaataaaataattcacgtttctcaacttaaaggtcgattggctaacgtagcttcgacctttttcagttgtttcccaacgcatgctttttcaattttatggctttgactaaaagtcgaaaatcacacattattaacagtaggaaaccgcgatgaaaaatatacctttatgaacgtttgctgctgcgccactcaccaacaaatgatgtcgcaattttttcatattaagagagataaaacttttttcaccagaaactcaaaaacgcttagtgagcttgcttatctgtccgcttcttcagacccatatttggggtttaaaaagtgtcctcagaaacaaacagtagtaaactcagatcaaatgatcttattgtcgaatcattcttagtttacgataaagaggaaaaaatgaataaaggtcgagttgaagcattcacagacgcagtcgtagccattatccttaccattatggtgcttgagtttaaaaccccggaaaccgcaaaatggacgggtattatccatcaattaccttatttttttgcttatattgtcagctttctttttgtcggggtggcttggtacaaccatcactacatgtttgccttagccctcagaatatcaaaaaaagtttattggattaacaacttgtggctttttagcatgtccttactgcctgtcgcaactggttgggtcgggaagtttccacaagctactggaccggagtatctatatttgtttgtcttcattttttggagtttatcatatctatggctttcagatgccattagaaaaacacctgaacacgtgcatactgctgttagtcaaaaaattgcgcagatgtttccttttaaatttctatcctcaatctttttcccactatcagttgtcatcactgctattagcatctatttttatccagcacttgggatctcaatcacctttgtcggcttgatcatcctgagttttttaacaccatcagacagcgatcaagtcagccaatagccgacgccaaatcagcattcaaaataccgccgcgacttgaccatcgcagcggtattttttaatcacatcttgagagcaaagtacaaatagaccggtttattcagaagatgtctgcatataattctcaatcttaaaataaaaacgaattctaagtgttttaagattagttagcaacttgtagcataaccagttagaatgccgctgagtgtcccgtaaagaccaccaatcgtaactcctgctgggccaaatccacttagagatcccgctccgtttagaccaccaatagccccgccaccaacgagtcccataaggcatttattagaatcacttccgccgacaaactgttgtagctcaagttcactcagtttccttgttttactcatgttcatcctccatcataaatgatctttcgctgaaaaatgggcgactgttatttctattgtgataacaattatccagaaaaaagggattactgttaatatattcaacattgactgctcgaatgtatcaccgatcaatattcggaagatgatattgatcaagccacaaatcacccaaaaaataagtttaaaaacacgattctgaagcaccgtagatagcgcctccgacgcctcctaaaattcccaatccgccaatgacatacaggtttttggttttggaacctaatcctccacctgtgagggcacccatcacaccacccccgacggttccagcaatgcatttccctatgccaccaccagtaacttgagccaattcagttacatttagtacacttacgtctttcatgtgtattctcctttattatttaattcgtgccatttacgtttagtttttgggtatacagaagccggcttctgtatacccaatataaaatagcaagtgtattttgtggtaaaaaatttttaaccgtcgtgtttttaccgataaacgtcgcacactgactcttataaaggttaagttcagattttcgtccttttatttgggacttttggctaaaaataatcctctgaatctaatccaactatttttaggctttttgatcaagtcttcatcgtttaaatgtacaattccatctctcaactgattgtccatcaggtacccaacggtatacagaactgggaatataataaaaaagacaactaaagtcacacataataactatgtgcgaactttagttgtctatttggcgtataaacttcatctttatgctttctgccgaccgtacctttttactgtagcccgaactgcaaaaccgaaagcaatagcagcaatgctgtacaacgccaccatgccatacctagattgcataattaaagttaccacccagaaaatgtgaaaaaagacctgtccgttcttgctaaaatgatgtttgcataacataccatctagagagaaggacaggtcccatggccattataaccttaattgaacgatctcagatagggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggttccacaagccttcgcagaatttgactgattagtggcttctgggacagtcttctcctctgtaaggttaagggttgtcataacgacaacccattttttaaacagttcaaggtatcacttatttagaaaaatccagcaccaaccaggaggcatgcccatgatcaaatacaacctaaagctcggccaagcacagtattacaagcgttactacacgcctcaggtggatgagcgcgattgcggggttgcggcgcttaatatgctgctgcaatttaatggctcggattattcgctagcgcatctgcgacagctggcgaagacagatcaggaaggaacaacagcgttagggattgtccgcgctgctcaggcgcttcattttgaaaccaaggcggtcaaggcggatatgacgctgtttgatcttgatgatgttccttatccgtttcttgtccatgttttgaagcgtggcgagttgcttcattattatgtcgtgtttaaggcgacaaaggatcatatcttgattggcgatcctgatccatcagtagcgatgacctggcttcccaaagagcgctttgcgaaggagtggtcgggggtcgctatttttattgcgccagaaccgcaatatcaaccacgcaaagaggacaaaggcagtctctttgcgtttgtgccgatactagcgcgacaaaaagggatcattgccaatattattgtcgccgctgtgttgatcacgttgattagtattgttgggtcttattttcttcagtcgattattgatacttatattccaaacgggatgcgcacaactttgggaatgattgccagtggcctcatcctcgcttatgtgctgcagtcggttttaacctatggacaaaattttttgatggctgttttaggacaacgtttgtcgattgatgtcattttgggttacgtcagacacctttatgaattaccgatgtccttcttttccacgcgtcggactggggaaattgtgtcgcggttttccgatgctaataagattattgatgcgctggcaaacacaattatgaccttgtttcttgatatttggattgtcttaattttagggatcgtgttaggcattcaaaacaccaccttattcttggtgtctttaattgctgtgccttgttatttggtgattgtgttcgcttttcagcggccatttaatcgactgaatcaagagacgatggaaagcaatgccatattgagttcatccattatcgaggatttgaacgggattgagacgattaaatcactgaccggtgagaaagtcagttatgaacgggttgaccgtgaattcgtcacgtatttgaaaaagtcgttcaattatacaaaagctgatcaactgcagcaggcgatcaagggactgctgaagttggttttgaatgtggtcgtgctgtggattggtgcgagtttggtgatggctaacaagatgagtctaggacagatgctgacgttcaatgcgttgttggcatatttcactaatccgttagaaagcatcattaatttgcaaccaaaattgcaaatggccaaagtcgcgaataaccggctgaatgaagtgtatttggttgaatcggagtttaaagaacagcgaagtttgaatgatcggcatttaattgatggcgctatcaacgtgaccgatgtgtcttttaagtatggttttgggcaagatgttttgaagcaaatcaatcttgaaatcccggagaatgccaaatacaccattgtcggcatgagtggatcagggaaatcgaccttagccaagttgctagtaggtttctatccagtggacactggcaaaggaaaaatcacatttaatggtgttccaatcagtgatgttgatctaacaacgttacgacaatatatcgagtatgtaccacaagatccgtttattttttctggctcagtcattgaaaacttaacgttgggtagccgttcgaatatcactgaagccgatattgaagctgcctgttcagtggcggaaattgccggagatatttcgaatttgccgcagatatggcagaccaaactttctgaaagcggcagtattttatcgggtggacaaaagcagcgcctagcaattgcccgcgcgttattatcaccggcaaaagtgttgatttttgatgaatcgaccagcagtttagatacgatcaccgagcgaaaaattgttgatcggttgttagcgatgactgatcgaacgattatttttgtcgcacaccggctcaccatagctgctaaaacggaacagattgtggtcatggatcatggtgcgattgttgaacaaggaaatcatgctgagttattggccaaacaaggctattatgctcggttggtaagtgagtgaggaggccgcgatgattgatctaaagaagttagagacaaccgagttttataaccatcgctaccgtaatttttcaacagtcattattgtgccgaccgcgatcctttttgttttgttgttgctttttctgatcttcgccaagcgcgaggtgaccgttttaacagcggcggaaattgcgccggtcaaaacggcggtcacagttcaagggacggcggcgaatcgaattgtgacgaatcatatgaaagaaggcaagcatgtcaaacgcggcgacacgctgctggtgtatcacgatgtagcttatcctgcacaattgaaagtgcttgaacagcaactggcgacgttgaaagatcaaaaagcgcagctcgaagttctcaaccagagtattgctgccaataaaaacctttttgcgagtcctgataaattcggttatcagcaacaagttcgcgattatctcagtcagcgtcgggtttacgaactggaatcggaagccttgcatgcgacccaaggtgtggccgatggtaagagcaaagaaatcgatcaattgttgcaaaccagtatgcaggcaagcgaggctaaaatgacggcgattcgtgaggcccagacggccatacgaaccgatcgcccattaagcgacaatcacgcgtacaactatctttatttgcaatataaagccgaggctaagaatgccgatgctgctaatttgaacaacttgaaaggccagtaccagtcacagttgcaaaacttattgacaaccgaaagggaaaccctcgcttccttgcgcacccaacgcatcaaccagaagcaggcggatctttcagcgcagcagacggggcagaatgaggcaaaactggcctcgttgcaaagccatatgcagcaaaccatgactgcagaacaggtgaaagtccaacaaggtacccaagaaggcgaggcgaaactggcggcactaaaggacgaaagtaagaattaccaagtcaaagcatctgccagcggcgttttgcatcttgaagcatccttaagtggcaacaagtacattccggctggcaccgttttggcgcaaatcttgccagacttagccacgcaaaaagaagttgagttgaagctggcagtttcgccagcggaaatcatgagcttgaaacgtggtcaaagcgttcggctgcgaattgcggagaatgtcccatcaccgatgacgctgaccggccggattgatgccattgatgttgcaccaacagtgaatgctaaagttggcaattactttaaagtacaggcccgagtgccactgagtgaacgacagcggcagaccttgcactacggtatcgcaggacaggccgccgttatcacgggaacgaaaacttactggcaatattttgtcgataaaatgtttaatcaccagtaaaattaaggctcatttttagctgaaagatgaaaaacacgacgttaatcggccaaaacacgacgttaatcggcagattgcgtcacacaacgcgggagatggtaatcttacaataagcaagtgcttgttaaagttgggatgggaattatcttttgttaagggaaaggtaaaggggtatggaatatcaacttgaaatggaagctaggaaattgattatgattctccgtcatgaaattcatcagttgcatccgcttgatcggtcgccggagatggcgtatgtcgttgatagagtcgccggtgatatggacaatgaactgccgcatggaccggagtttgatcgccaattgtttagatttgcccaaaaaattgatttcattttgtcaacccaaagtatccagttgagtcaattggggcgggatgcgattgatgacattcgacgtttggcgaacggggaaccgcttggcaaaccagaaccggaaaggcgtggcatacaacgcttttttgcccatttgtttggctgtaaataaaaatattggaaacacactggttgtcgcttagcgtgtcgatcgtttgatcggcagcaggatcacaagtttggggtgttgaagatagacgctttggttgatgcaggtatggtgagcttgatggtgatgggcggtgtcatttgttacgcggtgccggtcttttggaaaagaatacttcgcagacacctgattcacgagattaagaccctgaatcaaggattgcagttatcaagcaaagccatgagccaattaattgatccggaaaatccttatatggtatttgctgatgaaaatggtgaactggatttttcatttttgtggctaggcaacttgcgtcaattgaggcgtgaactgcgtctaattaaagaacagaaagctagggtttgacgacgcgttggtgatttaatcaaaactagcctagaggcacccgacccatttttgcggctagtggcgtagacgaaggaggttaagttttgaatgatgggcatatcatttgttatctcgtagctgctgtgttagctgctttaaaaagtgtcatttgagtgccgtatttcagcgtaaactgtcggggtaagagacgaggcctggtttaatcgccaacgcgtgtacgtcagatgtgctaaaatagtgaatgtttattttcattttttcaagataacacattcctataagaagaaggatcggcacaagttatgacggcaaaaagtaatcagacagcgcgaggaacgcggccactttcagaaaaacatcacatgcagattccatggtatgacgtgattgtcagcgaagaacggcaggcagatcatgccacgcttgaggaacgtgcttcactcgttggtcgggtggggattatgttgctggcgtgtggaactggggcatggcgcgtgcgtgaagctatgaacacggttgcgcgtgctttgcgaatgtcgtgttctgctgatattggcctcatttcgttatcctacacttgttttagtaacaaccacgcctactccgaagttctctcattatcgcaaagcggcgtgaacacagataaacttgatgcacttgaacggtttgtgcgcaattttgaaaagcaatataccacggaaacggtgcgcgagattcatcatcggctcgatcagatccagaaaatgtcgggtaattatgatccgctgcgagcaggattggctgcggcgctggcgtgttgcgccttcgtttttctgcttggcggtggtccagttgagatggtttgctgttttgttggcgcgggtatcggcaactggctgcgcgggatcatgattcgccgcagttggaccttgttagcctgcattggcgtcagtgttgccgttgcttgcttagcgtacttccttgtttttcgtggattggaaatgagtctaggcatcgctgcgcggcatgaggccggttatattggtgccatgctgttcgtgattcccggttttccgttcatcacgagtatgttagatatttcgaagcaagatatgcggtcggggatggagcgcctgctgtatgccttgatgattacgattgtcgcatcactggtcggttggttagtcgcgatgattgtgcacttgcgccctgaaaactttgttgatctgggattgaatccgatgcttttgctgctttttcggttgattgccagtttcagcggcgtctttggtttctcggtgatgtttaacagtccaaagcgcatggcggtacaagctggtttgattggtgcagtggcgaatacgctgcgacttgaactggtcgacttgagcacgattccaccggcggctgccgcttttattggcgcgttggtcgcggggttacttgcttcggcgatcaatcgaattgacggctacccgcggatctcgctcacagtgccatccattgtgatcatggtgcctggcttgtatatttatcgagcgatttataacatcggcttaaataatatcggcgttggcgctgaatggatgacccgcgccgctttgattatcatgtttttaccactgggactgtttacggcccgcttaatcatggattcgcgatggcggaaaagtgattgagagcatcatttggttggacacaaaagacccatttcacgtggtaccatggcgcgaaatgggcctttttgtgttccgaaagacttttaagaggtgaaggaagaatgagtattttaaaatggtatgctggcggtcaagaccgagcagaacaagcgatcagtattttaactgaactggtggcagacctaaatcatagccagcagaaaatgccgttacaacaagtgttaagtgattatatagaggcgtttagaaaggaggaatcagctgttccgttcattctgagccgcatgaatctcgacatttccagcgctctgaaaaacaaccagattgtgttaactgctttcgagtcggataagcttgatgcattgatggccctggcgaatattcggtatggttactaacaatagctatccagtgttttgggggcggtaacagcagtcaatcatggttcagttcacatgacaatttgaaaaattaaaaaccagccgttatgtttggcatgtcggtggttggtggctgatcggtcatccgtatcaacattgcgccgcattttttgaagtgttaaactgccgttatcgttaggagctgatcgtattgggtggaaaggaaacacggttatttcaggccattgatggtgcctataatgatgccgcagttcagtcggatgatgagattaaacgttttttatttgaatcagcccagcgattggcaagtggtgatcggttcagttacgtcgctgcccgccttgacagcttcatcgcgtcttattcgcaggttcatcactttcagtatccgtctgcacttgagccagtttataaattggtagcaggcgctagtatgcgagcgcgcggaggtggcgggttgagcgtttggctttgaatatttgtaaggaggacacgtccatgaaaaaacaagaaacacaattgtttgaagcaatcgatgttgcttatgcagatcctgagattgccaaacaggatgatcttcgaaagttgttgttcacatcagcgcaacatctgcaaaatggtgatccctatcagatggttgctgtgaagttgaagaacagcatttcacgctacgtggccttgcatcagttggatgcacctgacgcactgaacaaactttatatgaagattgggccaatggacgatcgagactggggattgactcagatttttagatgaacttgactacctacagaagggcttttgcacaagcaagggcttttttaatttgccgcaatcacggattttggctcaggatgatagaaaagcagtactgttgcgcacaggacaccagcgattgctaggccgaccgttaaactggatgctggtaagaggaaaccgagcaaggcgagcagccagatgccagtccaactaattaggagtaaagcaatggtgcgaaagtagccagccagacataagttgaccagcccgatgccaacacaaaggctaatgaggagtgggcgggaaaacgaaaaggcatttgttttagccgaaaaatagccgattagcaaagggacgatgataaaaagagcaaaggcgattagaaggccaaaaatggttttagaagagactttgttgaatgaaatgccgcgggcaaagggaacgccaatgaaagcaaacacgacagcaacaggtgccgcgatactgcttaatgaaagtcgatgctcttggccaactagcatcgtgaaaatgatggatgcaaatagaaacatgacaattggccagtattgatcaaagagataccaggcaggcacacgcggcaattccttcaaaatattgtccgccgcggtctgcggatcgtcactaaagaatgcagccacgcgatggccggctgtttgtgcatcggtcaatgtcgttagtaggtcattgatagcttgttcaatagcgtacggatctttgcgtaaatcagtccgcaaatagccgatgacggtttcggtgtaggtatagtcagtgccgtgaatggcttttagttgttgatcgtttgcagttcggagttgttttaactttttcatgagtagcctccataaagcatttggcaccgttgtcgtgataaggatcgtcaggtcaggatacttccagatgtgactgtgactcaggacggtagaaaagtagcaacaaacaggcgcctaggccaacaaaggccaagccaacggataattccgaaattggcaagaaaagcgtcgccgccgtgaaagcccagattgctgaccacccaaggaataataaagcgttttttcgaaagcaggccacaagccctaaattcagaaagacaaagccgccacagacgggaatcagtgtggtgctagaaaacgataggttgaaaacatgatttgacacatagccaattagtagaggcaagccaacgatgaggaataggctgatcaagacacgacggattgttttacgagaaagccgattaaacgagatacctcgaccaaatgaaatgccaaagaggcctaacgaaacgatcaacatggggaaaaagtcggttagtaagaggcgggtttcgtgatcaaccaccatcatcaagatgccgtcaatcagcggaaacatggcaaagggccagaataggctgacaaaataatcaagcggggcaggcggcaattcttttaaaatattatctgctgctgtttcaggatcatcgccaaagaaggttgagactttgcgtcctgctgtttgagcatcaatcaaagttgtcaacaaatcgctaatcgcatgctcaaccgcatatggattcttgcgaagcgcaccacgcaggtagataaccaccgtttcggtataagcgtaatctgtgccgtgaatttgtttgagctgttgatcgttggccatacgcatttggttcaactttttcatgttgtgcctccttggttgagcttagccatcgcttgactcagttggtgccattgttgttgaaaatcagccagtgtttgttggccagcctcggttaagtgatagtattttcgatccggtccgctttcagatgctcgccgaacgcccacaattgatttatttttttgcagtttcagtagcaacgggtaaatggtaccttcagggatatcgccaaagcccagcgcacctagcttttcatgtaatccgtagccataaatatcgccttgttggatgatctgtaaaatggcgccttcgagaatgccttttaacatttgcgatgaaggttgcatggcttaacctccttttggtaccttgttaagcatagtataatcgtgagggggtaccttgtaaagcaagatacgcatttaagaaaaaagtcagcaacatatgctgactaattgggcgtatcggcatgaattggtgggttacttagtttcttttagctcaccatagccaaaaatcatgaagatgaccccggctgtttccatgagtggcttcgcaacgctgccaatgtaaaaaccggttaaataagcggcattagtttgctggggattagcgatctttccgttaatgagaaagaaaatggtgctcactcctataatgagaagtaaaagcaatatgcgatgaggcaaaccgttaatccatgcatgatagtctgggtagtgagtcgcaagtacgatcaagttaatcacaaatgcgagtgtgagccaaccgacaacagacctgaagttgtttgaaacagcttgcagtccccagaggactaagaaaagggtaacattcaaataataggtaacttgaaaatacttttgatcccgttgtgcatgtttgtcaatcgcgtcgtaatgatctgtcatcgtctgatcctcccgtaatagttgatccaaagaaatatcataaaaatcgctaatcctgacgagtgtgccgatgtcaggaaaactgcgcgcattttcccagctggaaattgtttttggggaaacgtgtaattgctcggcaatttgtgtttgtgtgagttgttgctgttggcgagccagtttgagtttgtcgctgaattgcatgtccttcaccacctgctattattgttgaggcaggaataaaattacacaagcttttttcaactgatagaggtctgagaatcatagagtcattgatatgacgcgattttgatgcacattgctgatggatgattgttgacactagtgcgcaggataggttgaatgcttgctaaaatgtggggtagcttttggccagctttcacgaccatgggtgtaataaaaaagcccggcatctgccgagcttgtgaccctcttaatgcgtttgaaccagcgagccagccatggcaccgaggaggcagcggaatgagcggccaagttgttgccgatgatgtttatcgaggcgccggaaagccccaagatagtggcgccaatgattttttgttttagctagatcatctaaggtgatggcattgccgctgcgcaaaatgcggtaaagtgcgtccacggtaaccgcggtggctttggcatcaaggccagctaaccaaagtgcaaaagttttttggaaatagcgcgatgcccatgttgtggttggcaagtgagcgaaggtcgtgtcggcaatgttccaagtaagaacatcgtgttggccgaacaacttcacgcgacttttgacaacctcaaaattcatcgctggatcgagactgacgccaattaaggagctttgtggaacgagcttggtgacacggtcacgatggcttggatcaagcgggacaccgctcggcccatcgaagctatagacatgggcaacttgactggctaatggttgtggcaagtggtcaaacgcataggtggcgatactgccgcctttggaatggccagtcaggtaataagtgccgggatgctgactgatttgtttaatcaagtagcttaatgcccgacgctgcgctggaatcgttggcatgaagctcatattgagatcttctttccaaccaaccagtttattggttgtcccccgaaaactgacacaataaaccccgggggctaatgtgaatgtgatggccgcgaagtcttcttcgttgcgatggctgcaagtttccagccaattttcccaagtaacccgggcaaaacgttcactgtgacgcatggcgtctaacatgatttgatgagttggaatcgcccaagtagtcaaggtagccctgtttaggcgggtactgtcatttaaatcggcaaaacgtgcatatggctggccgatcaggtaattgaagttcaaataaccaagttgcgcaaataaacccgcatcaagttcagtcagcggtgtttgttgaaatgacgccaagctatggcgttgagggtaatcagcaattgaaggcatttcaatactcctagttcttgaataactttttcgagaaattgactatctctagtgtaaccggtttactgggttaaagtatgtaatatgctgttaattgttgtgtatatttaatgttcttttttaaaatgttttaaaagtaccgacaaaaatcaagtcacagcaacgtttgcacgccagaatgctgtattgttgttaacggaggtgttcgtatgccagatttagcacagtcaacgtttattttgccgcaagatgcgacactgacctcagaacagtcagcattggaacagcgaatttggacctttatccacgacaatcacaacacaacgtcaacacatctattgatcatttcgggtgatgccggtgctggtaaaagtgtggtgctggatgctgcttttgcgcagttgcaaaaagctgcccgtgcgacaagcggcgagttggctggcacagacaacaagttgttggtaaatcacaatgaaatgctgaagatttacaaagaaattgctggtacaaagtcttattttcgaaagaaagactttatgaaaccaacaccatttattaacgcgtaccgcaaagccggtaagcgggcagatgtcgtgctgatcgatgaaggccatttactactgacgacgcctgatccgtataataaattccgtgggcataatcagcttgctgatattcttcagttggctcgagtggtggtgctcgtgttcgatttccaccagctagtcaagctaaagagtttttggacacctgctttattgaaaagagtgacgcgcgattacgcagtgacacattatcatctgaccgaacagatgcgggtaggcgatgcggcggtgaatgattggattgatcattttgttcgtggaaaagtgttgcctttgccacatccgcaacattttgattttcaagttttttctgatggtcagccgatgtatgacctcattcagcggcgcaatgccgaaaccggcctttcgcgcatgatcgcgacagctgactatccattcacagtgctcgatggtaaaacctggtatgtccaagctggctctctgcggttgccttgggacaagatcaacttcaccgatcgcccgtgggcacaacgtcctgagacattgcatgaagttggttccatttatacgattcaaggctttgacttgaattacgcaggtgtgattctagggccgagtctaggctatgatccctcaaaagaccgacttacggttgatctggcgcagtaccaagacaaggaagcattcaaaaagcgcccggatttggccgacaccaccgacgctaaagccgcgattatcatgaatgccattaatattctgctgaagagggcgaagcatgggctttatctttacgcagctgatcctgctttgcgccaacggttattgcaattggccaaataatcttgcaacctcacttttgaaatgcaatagattgtgagtcgttccagttagcactatgctgaaactgagtctaaatctaaagggagtggtttgcatggctgaaaagtataaagcagaaattgtgccattgaacgctgagaagattggcaccgcgccgcacggtgccgcgacgttcacgattgatggtgcgcaaatgaagattcatatcgatatgtttgatacacctgctaatgtgcagcattgggaacatttccacggattcccggatggtaagccagcagaaatcgccacagcggcacaagatgctaatggtgacggtttcgttgatctgccagaaacagaaccggtttccggtacaacgatggtgccatttgacgctgaaccggccaagatgcatgtgccaaatgacagttacccagtggctgatgcagaaggtcactatgcttatgacaaactcgttgatctgaaggaattgcagacagcgtttaaagccgcttttggcagtgacgatttgcagcttgataaaagggtcatttatattcatggtgtgccggataccttgaagctaccggctactgttcaaggaactgtcatgaactacgatgcccacgttactttaccaattgcagttgggaaaatcatcaaagcttaaactaattagttgaataaataacctataagtagtcttggaacttactggcaatacgccggctgtttcaaggctgcttttgggtttgaagaccttatttacctataaatagagctttttacattatatgtacagattaatacctataatgtcaataagtattcactgttaaaaatatcttgttaaataacgaacattatcattcctttgcgcggggtcaacttgttaagctggtgttggaagaagaaagacgccggaaacaatggaaggaggcgcacagatgcctaagaagttgatccatatcgtcatgttggcgatgttgatgctgacccaggtcggcagcgccgttgtccctgtagccgacaacggtgagacaaacatcaccgaacatgaccgtgcggcgccaaaatccgatccatcctcacaccagaacgatgcgagcggacaagcggcaattagccaagacacaattgagtctgacaagaaacagacaagtgcagcaatgagcagttctgagaacctgtctagtatcttttaagaactatcttcaggaaggccaatacaaccatttgaagactgctgttaagggcgtgttcacagtttttccaaagtcgccgacatttgtctagccaactccatgaacgttcaacgatccatcgttgcggtaactttgttcagttttcaaaggacgaccttgtcaaaagacaactttgatagattatcatgaccagcgttacatgtcaacatttttattaaatatcctgttaaatggaagatgcaagcgcttctaccttaccctttttagaaaaggaattgctttttgacagcaataatataataccagcaactcagacggtgtgcaagtatttttttgagtttccagcaaaaccacgcgatgctcctgtccatacggcctaattgattgttgcgtgatattgcttaacctacccaacaaaaagcggtacatacgacttaatcgccgtaatgcaccgccttattggactcaattacttcatacctaatttcacttggcaatcagggcaaataccgtaaacttcgaggtgatggccactcactttaaagccggttttcttagccgccactgcttcaacatctgtaacgcctggataactgaaatcaaagattctgccgcagtttgtacaaatggcgtgataatgtggctcaatgggaaaatcaaaatgagtggccgcatcattagacgacatttcttcaactagattaagatcaaccaaaagccgtagattattatatacggttgcaacactcatatgcggaaactgcggcgacagtttcgcataaatcatttccgcagtcggatgtgccgtactgtcaatcatgtacgaaataatcgcttcacgctgcggggtgacccgaatctgcttcgctttgagcaagttaattgttttgttgtaaaccgcctgattcatagccagcctcctatttgtaactattatcatctagtaaaattgtacgctcttttctaatctagcacaactgtttacttacaaaagttcagaatgagcagcttcaggtcagtaatcccattcgctacagcacattttgtggacacagaaaaagcagcgctcgccgctgaacgctgctttcaatgaattcgattgctactttgactcgctactgctgctatcgctatcgtctttaagttcgggtgcatcggtcttatactcatcggcaactgacttacctttgttttccgcttttagactcgtgcccttcttttgcgcggctttcaactttttctttgtatctgtcagcttatatgaaaagtcacttcgatcaaccttcttaaagccggccggtgtatagaatcgcaacaaatcgccgttaatgacgcgatcagacagagaaagttcggcggtcactcgattagtggacgcatcaacactttccttctggctttctgataacttgtcgattttcttaccagtcgtggtattgaaatattgactaccaacctttgtaaagtctggcgtgacaaagtcgccgtttcggaaggccacggtttgcggatgatccgcggataacaagtcggacccaaattgaactgtatcgttatctttcacacctaacaggttcaatattgttggcagtgcgtcaatctcaccaccgtacgtatgattaataccaccttttaagcctggcatgtgaatcataaatggtactcgctggtacatggcgttgttataatcattgaaaccagaaatgttcgtaagcttagccatggcttttttatggttattcgaaataccatagtgatcaccgtaaagaacaatcattgatttgtcatacagaccagtttccttcaaccaattgaaaaactcacccagtgcttcatcaagataacgggcagtttgaacatagccatcaacggtatcgtcgccagtatccgtcttctcgatggtttgattggctttatccaaagtatacggatagtgatttgtgaccgtgatcattttggcatagaacggttgtggtaattgctcaatgtactgagctgagtctttgaggaaaatcttatcctttagcccatagccgacatcgtagttcttcccacttgaaaaataatttttcgagaagaagtagtcatagccccaagacttataggtgttgtctcggttccaaaaactcggcacatcgccgtggaatgatgctgttgtgtaaccttgctgatccaaaattgctggcgctgcctggaaagtattggttgtgccatcggtaaccatggctgccccttcaggtaaaccaaacagtgagttttccatcatcatctcagcatcggcagttttcccttggccaacttgattaaagaaattgtcaaaggataacgtatcagattcatgatagagcttatttagattaggcgtcacttcctgcccatcccatttgaagtcaatcataaactgctgaaggctttccaaatggatcacaaaaacgttcttccctttggcaacaccagtatattgcgcattaggtgtgactctgttcttattaagataattcaaaacagatttcacatcgcttgaatcagcgtttgctttcgtggcactgttttgtgctgttttgaccccatcaacaactgtataggcattaaggcctaaatacttaacaatatagttattgtcaaaggtacgcgtcagtaagcctgaacggtcactataagccatactgagattagctgcgaacatcgcgacagctaaaaccgaaaccccgagcgcaaagcgtttcttaatcggccgaatgtccatccgaatgactttaaaaacaagcaacagaatcaaaatgaggacgtcagcgaaaacaataaaatctgttggttgcacaatacccatgatgcctttattgaggttattggacacggcgcctgaccctttgatcaatgcaaatgtcagaaagtccgaaaattctcgatagtaaaggacattggcaaaaagccacaccgatgtaagtgcatcaataatcagcatcgtaatgtacgatttacgccctgacatgtatagtgcgatgccaaaaaggaacagtgtggttggaatcgggttgatcgccaagatcagatgttgaaagctgccggtgacgcccagattgaattttgattgatatgcccagtatgtcttcgcccaaaaaaggacgatggcaagcacaaaaaacccgagccgggtattaaaaaatcccctgagtttactgccaagctggttcatgtggagcctccaagtcattgtttaatgtcaaaagtatagcacattcgctaggataaccgcttgttttgaaaaagacaaactttctggacctatttgggccaatccatggtgattttaaagaagcctttaaattcggatcaggttttgacggctactgaataccatttccaagcgcttctgatcatgtgctacacaaaaagcgaaccttgtcagttcgcttttgtcgttgatcaagctggtgcttgatcgctggtgctgtcacttgtgccatcgtcttcatcaaaatccatcaaatcatagatttccatggctgcaagatcgatattatcaaactgaaaggtttggtgagtgcctaattcttcaagttcataagtttcggtcttgggatcgtatgtcacgaggcccttttcatcaccatttttttcgaagcggcgcgactgggtctcgccatcgcctgcctgcatggcttctaggcgcttgatgatggccacgagctgtgattgtttcataaaatggcctcctataaacgcgatcaccaccttgcgagccaacatgccaattattggcactgacacatcgaatctcatctgggcgggatcacgcgctgtttatttttcctatttcaagaaatagcttagcataaaccacggcctctgtgggagaaatctctctttgaattgcagttttattgcattgcaactatgagggaaaatggactatgctatttgcaacctacatactaaggagatcgcccatgaagttgcaaccattaaataaacaattagccgacatcgacgttagtgaaatccggcaatttgacgaaagcgtcagcaagattcccggtattttgaagttaacgttaggtgaacccgatttcaatacgcctgagcacgttaaacaggctggcattgaagctattcaggaaaattattctcattataccggaatggtgggtgatccagaactgcgggaagctgcgcaacactttttcaaaacaaaatatgatactgattacgctgctgaagatgaaatccttgtcaccgtgggcgctaccgaggctttggcaactgccattacaaccatcagcgatccaggtgatgccatgctggtgccgtcaccgatttatccggggtacatccctttgcttacgttgaatcatgtgacaccgatctatatggacactagcaaaaccaactttgtcttgaccccagcgctgatcgaagcaacgattgctgctcatcctgatgccaaaataaaaggcatcattttaaactatccaagcaatccgactggcgtcacttatcgtgcgtctgaggttaaagcgattgccgcaactgctgctgaacatgatctttatattatttgcgatgagatctattccgaactaacttatggtgactcacatgtttccatgggcagttatgcttacgaccgaacttttgtcgtgaatggtctgtcaaaatcacatgccatgaccggctggcgaatcggttttttgatgggtccgcgagttttgatcgcagaggcgaaaaaagtgcaccagtatctcgtcaccgcggcaaccaccattgcacaacgcgctggcattgaagctttgacgaacggacaagatgatgcacaggttatgaaagccgcctatgccaagcgccgcgattttgtctatcaggcgcttctggacatgggcttcgatgttgctcggccggatggcgccttctatctttttgccaaaatcccgatcgaactggggcttgattcgcgacaattcacgcaatcgcttgccacagagcagaaacttgcgctgatctcaggtaccgcgtttggccctggtggcgaaggttatattcgcatcagctatgcggcttccatggctgacctcaaggaggcagtcaaacgtttacaagcattcatagctgcgcataaagccgcctagttttgaagacaatagataaaagcgcttggttatcagatcaaaattggtctgattaccaagcgctttttatttatcgacatgtagcttacggataaagtatcgccatcacagcagcaacgtctgccgatgtaaatgcgaccttaccggcttctgccagccatgttaaaaaaatattcacccacgaagcatatcgtgccaaaattcgctgctcctgttttggggtggcccagctagtctccaaagcaggtctcagggcaacagcaatttcgttgatttgccacgccttaatgtgatgctgattttgagccatcaccaattcaacgatgccggtcaagatatgcttaatctcggcgtctctgatccctaacaaaggcgcataacgtttgctttgtctaaaggcaggccaatactggttcagttcttcgcttgctgacgacatttcgccctccctgagctttgacttttctcagtcgctcacgtacgtttgctttttggcgggaatgccatggcaatgatgccgcagatcatccccaggtaataggtcaagaaccgccataacagcatccctagaatcaattttgaaggcgacgcaacataagtcgcaaacaaggttttaaagctatactcggccccgccagcaccgcctggaatcggaaacaggctgacaatcatcacaatcatcacgtgcaacacgatgacctcaacgatactaacatgacttacgccaagcgacaggagcacaaagtacggcaccgcatagtaaagcagcaattgcacaagtgtcaacaagcaagccttgatgacccgcttcttttcgcgtttcaagtgcaaactctctgcgtaaaaagtgtcaattttatgatcaaggttactttgcatggcaagttttttctcaggtttgacaaaccagccaatcggtatcatcaccaaattcactaatttttttgtgaacttatagtaatacatcaccatgagcaagcctacgatgacaaccacatgaatcacaaaaccaaaaacgatgaacaaagcaagcgccccaaaatgtttggacacctgatcaaacccgatgaatagtgtcaggacaaagttaatcaggaccatgaattgatacacgacaaacttcatcaacaacacggaacttgcccggccagcttcaacgccactttgcatcaaagcaaataattgggctggctgaccaccagaagccatcggcgtaattgcattaaacaattgttcaaccaacggcacacgcaaagcggttttaaagtctaaatcatcagcttcacttcgaataaagatctgaaccacaaaggtttcaatgatccacgacccaaacatgagcaaaaaagccaccagcagccacttgagatcaagcgtcaatagttcgtggattaattgtgcgccgttcagatcacgagcttcataaataaaaataccggcgccaatcaaaatcatgattaagacagccagtttgttcttccgtgtcatataactcctcggctagtgcttcccccgtgcagcttgatgaagatagaaatcgtgccagactttttcaagtcggctttcatcgtaaacttcagcagcttgtcgactcttagttgcataagttgccaaaagatcatgatcatccgcaagtgcccgcaatcgagactgcatatcgtcaacatcaacagccgtgatggcataaggtgtgatgatttggtgatacagctcaagatcccgcaccatcactggcgttcccgttgcaaaagcctcaaggacggacattgggaacagctcttcataagaaggcaataagaaaacatcggccatattgtaatagtcaatcattgtctcccgtggcataatcccggtaaaatccaagtttgccggggcttctgctacggccttcttcaaatggtcgtagccttcagtaatgcggccaaaagagaaaccacctgcccaaacaaaacgaaattcaggattatgttttgctaatttgataaagtcgctgacacccttacgatcctgcacctgacccgcgccaaaaatgacaaaatcatcaggtttaaagccattggcatgtcgcaaagcctgccgcttttcagtggatactggatgaaacgttcgttgcgatacgaaattaggaatataagtcactttgtcgcgactgatcccataagcttctaacttaggaataaaattcgggttcaccaccactaactgatccattcgcttataaaaagccaacgtatacttatcaagcgtccaccgcgccactcgcggcaacttcagactcgcatccagtgtactcggcacaaagtggacaaagccaatcttgcgaccccgttttttggagaaagtagataaataaaatttaggatcaatcgtatgataatggctgatgtcactacgcgtataacgattgacgttaacttcaaattcatttgaaaaatcgtgtttcagcaagcccatcagttctgtgtagactgcgccaactccttgtcctgcaaccttattggcagaggaaaacatattaataacaatcatatttaacctttcatggtccgtttactggaatcttcatcggtccatggtgcagcttcatcggcctcattaggcgaatagtgtgacaaaatgtcttgatagaaatccaaaacccgatcgccaaatcgatctgcagaaattgccgctaacttttcttgacgcggcttagcatcatcgtaagcatttggatgtttcaagtaattcacgacctgatgcaccatttcagtctcagttgaaaatgttgtccctaacgccggatcatccaaaagttgatccgtataatcccctgtcaaggcaaccactttgcgatccgccgccatcgcttcgatataagttaacccctgtgactcggagtcacttgccgatacaaacacatcgccaacccggtaatagtcaccaacatcatcatggtcaatttcaccggtgaatcggacatgctccttgagacccagctcagcgacttgcgcctctaagtcttcacgcgcaggcccatcgccaacaattaacagcaccgcttggggcacctgttccagaattttaggcatggcactgatcaccttatcaattcgcttttcatacgcgacccgactgagtgagaccaaaaccgggacatgcgccaacccgagcttgtcacgtaaatgcggatctttttgctgggcaaactgagtcaaatcaaccccagttggaatgattttgatctcagttttgacgccatatcgccgcagcgtatcataaacgcgttcagaaggcgcaacaacgccactgacatgataaagaaacgcccgcgtaaactgcttcacatgataaggcttcagcaaatgaccattcaggacataatgcagataatcctcatacatagtgtgataagtatggattgtcggaattttcaactgcttggcgacaaatttgccgatataccccatcgaaaattcagtttgtgtatgaacaatgtccaagttcaattccttcgccactgcgtaagcatgaaaaagcccacgaaccgcaattcgccgatccgtgaatgagacaaacggtacactggtaaatcggaataaattaggttcaacggcgtcgtccggcacatgcggatcagtcgttgtaaaaatataaacctgatggcccttacgctccagatcgtccttcaaggtcttgatggacgtcgcgacgccactgacttgtggaaagtagctatctgtaaaaatcccgatattcacctaatcccctccagacgtcatttgtttagtataagtataaagataggcatagctaaatgcaattttccctcaaacctttaaaattatcttaccttgtcgccatcacaccatcatcaggcaaaagtcgtaagttatgccatctagcattttatcaaacgagccttcaccaccggcggctcaaagcatctgcggcaatggtcaagaatcagaatgtcttccatcataccaaaaaacacgtcgatgatcatgtttctgaccagagacgtgttttttctaatactagttgctactgccgcggcattttaactttgtcattcacccttgcagcgcgtcggaaatatttagagaaaatgtgactattaattccccaagcataaaagcccaaagcaccaacgataatgacaacaaaatctaaaggatagtgaatccaattcaaaccattaaactcactgctgccaataagtgagatgagtgacaggaatagcaaatataccagcatccaagctgccgccttcaattgcttaagcgtgcttgcccagcctgatcgccattcatagaacaaatagaaaggaatacccaagaaaataacgccgatcacttcaaccgttgtcggccattttgcccagtaagccgctaatgaggttagcacaaatgacaatggtgccatcacccgcaagaggctcgacttcactggccgcttaaaatctggggccatgtcacgcaaggagatgaccgtaataggacctgtcaggtaagcaatcaacgttgccgtggagatgacgctagctaacgtaccccaagatggaaaaatcgaaaccataaccatgctaagcaacgcattcaccaccatcgccactcgtggtgtaccatacttttcatcaagtttcccaagaaatttgggaatatggttgttgctgaccatcgcctgcaacgcccgcccagatgaagcaacaaatgaaacgccagtcccaaacggggaaacaaaggcatccatatataacaaaactgataaccagtgaatgcccagcagaatcgccaagtcagcaaatggggagttgagattcaacccttgccaaccatgtgctgctaatagcttcggcgaaattgtcgtgataaaaacgctttgcaataaaatgtaaatgaccgcactaatcagtaacgaaattgcaattccgcgcccaatatttttttgcggtttcttaacatcgcttcccatgttgatgacggtttgaaacgcgttaaaggaaaaaataatcccagaaactgaagtggccgcaaagataggtgcgctcccataaggcatgaaggtcgctaaagaatgcccataattgccgggatggaagcttgaaagtgccaacagcgtgatcgtcagcaaaggcaccccaattttgaagatcgagatgaagctcgtgaatcgtgtcagtaatgagactgaccaatagttaagtaacgtaaaaataatgatgaaagcaaacaccaccagcaacccctgcgatgtgatacgcccatcagccaaaaaaccgtgcgtaaagctagcccactgccacggccatgatgccatatattgcacggcagccactgcttcaatcggcagcaacgtcactagcgagatccagttggcccaagaggcgataaagccaactaaagaaccgtgcgagtactgagcatatttgctcattccgcctgattcaggaaacatggtcccaagctcaatgtaattataagcaatgatgccaataatcaagccgccaatcacccaagacagaatcgccgccggaccagctactgctgctgcttcccaagaaccaaagagccagcctgaaccaatcaaggaacccaaagctagcataactaactgaaatagaccaattttattattttctctatttgaagaaattatcgaatacctccctaaaaaagtgacttgtttaatataacgcatgtcatgatcaatgtaagattgattattctttataaattcgctattttcccgatggtatcgcatatgaaggcgccaacattattttttaaaaattgccgttctaagatatctaaagctgccttcacgccattaaaatatcatcattttttgtcataccatttttcaaatcatgcttgtaataacacgctctccgaccaccgaatcaccaattaacaataggtcattctactggcccctttctattcctttaaagatgtcgtgactcttaaaaaaatcgtgaaaaaaatactaaaataatgttgtcaatattgccccaacatatgcctttggttgtaagcattctgttcccctaaaaaatattcatgaacgattgttcgctattcaattggaaacgctttattgtagaatgaaaaagctagtaagtcgggggaggaggagatatgaaagccacagagttaacattaatcaatgaagcaatcacaaactcaactgcattcagccaattgtttaagcaatatcgaccgctagtcctaacggtgttaagaccgtaccatctcagggatttttcacatgaagactggttacaagaggccaggattgcgatgctcaaagcaattactcgatatgatggctctagcggatcccaatttggtccctactatcgaatggtattgcagtcacacctgcgttcagtcttgcggaaacactttgcgcataaacgccgcatcgacgcgaccgcaatcccagttgaagacagcgcacttgaatctcttcaagaacgtctggctctcagatcgtatgaagatggtctactcatgcgaatcgagtttgcacagtttctggcacggttgtcacctttggaatatgaggccttcgaggcagctgtcatcagtcagacagacagttctgaagatcctttgctgcagcgtcatcgtcgcgcattggaacggtctcggatcaagatattgaagttctctcgcgaagaatagcaagtcaactggcagcaatcgtcaaaaaggacagtatcagataacgaaaaaagactcaggagcatcttacttttacgtaggatgaagaaacgctgggtctttttttcgtgtgtcagaaatcatacaattttcatgcaaaaacagcggctccatgatttgtgccaaattgtacacttttttaaatcgggtgtgatcaaaaatgtattgggaacatctttgtttgtggcacagattttcaaggcaaaaaaaaaccttcctaggaaggtttgtgataccggtgatcggggtcgaaccgatactccatcgctggaacgggattttgaatcccgcgcgtctgccaattccgccacaccggcataatattaaatgataatacactctcttggcgattgccgcaagataaggcggtgatcggaatcgaaccgacgatcaaggttttgcagacccatgccttaccgcttggctacaccgccatatttcaattaagtgcctttcccctatggcagttggagaaattggggtagctggattcgaaccagcgcatgacggagtcaaagtccgttgccttaccacttggctataccccagtaaaaagggcggtatgtggggatcgaacccacgtatgccggtgccacaaaccggtgtgttaaccgcttcaccaataccgccattataaaagcagggatagtaggagttgaacccacactgacggttttggagaccgtagttctaccattaaactatatccctataaaatggaggagataggattcgaacctatgaacccgaaggagcggatttacagtccgccgcgtttagcctcttcgctactcctccataatggcgcgggacggaatcgaaccgccgacacatgcagcttcaatgcattgctctaccgactgagctaccgagccatttggaactaaacttttgtatttttctctcaattgagagagacggttccaacgggactcgaacccgtgatctcctgcgtgacaggcaggcgtcctaaccaactagaccatggaaccatataaattgcgggagcaggatttgaacctgcgaccttcgggttatgagcccgacgagctaccgaactgctccatcccgcgataattataaaggagaatgagggattcgaaccctcgcgtggacttacgcccacctgacggttttcaagaccgttcccttcagccagacttgggtaattctccatctaaacatgacccgtacgggatttgaacccatgttaccgccgtgaaagggcggtgtcttaaccacttgaccaacgggccacaacggagaaggagggatttgaaccctcgcaccagtttcccggtctacacccttagcaggggcgcctcttcagccacttgagtacttctccatgtgtatatgaaactataaatggaacaatgggcctaggtggacttgaaccaccgacctcacgcttatcaagcgtgcgctctaaccaactgagctataggcccatgatcataaccgcagcgggtgacgagaatcgaactcgcgacaacagcttggaaggctgtggttttaccactaaactacacccgcataaaaatgattatgaatatggcgcgggacagaatcgaactgccgacacatgcagcttcaatgcattgctctaccgactgagctaccgagccgcaaacggtcccaacgggactcgaacccgtgatctcctgcgtgacaggcaggcgtcctaaccaactagaccatggaaccatataaattgcgggagcaggatttgaacctgcgaccttcgggttatgagcccgacgagctaccgaactgctccatcccgcgataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgggagcaggatttgaacctgcgaccttcgggttatgagcccgacgagctaccgaactgctccatcccgcgataacaataacatatcgattataccgaacagcgaccaccctgtaaagatggaccttgtagggctcgaacctacgaccggacggttatgagccgtctgctctaaccaactgagctaaaggtccaagctcaatcgcggcgggggggatcgaaccctcgacctcccgggtatgaaccggacgctctagccagctgagctacaccgcgaaaaactaagggacaaaaatgtccaatcgggaaaacaggattcgaacctgcgaccccctggtcccaaaccaggtgctctaccaagctgagctatttcccgataatgcacccagtaggagtcgaacctacaaccttctgattcgtagtcagacactctatccaattgcgctatgggtgcaaatcatgataatgccgaggataggtttgaccaagcacaccctcggcactgtgcttggaaagcggaagacgggattcgaacccgcgacccccaccatggcaaggtgatgttctaccactgaactacttccgcatgaaacatggtgctatcaaattattggtaccatgccgactaaaggattcgaaccttcgaccccctgtttacaagacagatgctctaccaactgagctaagtcggcgaaaaatcgacttgagccgccatttaaaaccaataattctctgagccgtgacaggctcgaactgtcgacccactgattaaaagtcagttgctctaccaactgagctaacggctcaatgctatctgagatcgttcaattaaggttataatggccatgggacctgtccttctctctagatggtatgttatgcaaacaccattttagcaagaacggacaggtcttttttcacattttctgggtggtaactttaattatgcaatctaggatatgatatcctagttccgtcttttacagtaatatactcagacataaaactgcctccttagttattgaccaaacattgtcattatatcatttggtttacagtatgcacgaataaccgtcattaacaaaaaatattaaacaaaaattatattataaacatagcatcagcaatttttgatatagactttccatcttactttcgtcatttcaataacaaatatactattaattctatttatatacatcaaagctatttattaacattaatgctatctgtaggaattgaactctggcaggatcacctgtatcatgcacatcgttctcaaagtgttccatatcccccgcagtacctactatgactggttaaggtgcaacgattaatgccaagaaaggatcaaataactaacgccgttaatgcgctttgcgggacagctttaagtgacctttgaagaccctatgtctcacgtgataaatctcctgcaacttaagaaaggcgtcttgattaagaattttcactctcaatcaagacgccttttacgtagtctctattcagcttgcagttttaaataatgccgaccaacatttaatccttcaagctactacagatcaatcgtagtccctttgtctgctttcgccgccgcttgtaaaattttttcagcaacaacgacatctaaaacggcggtgccaacggccttgaacaatgtgatttggtcatggctatctcggcctttaatatcgccattaataagttgtcctaactcacctgaatactgatcttttgaaaccagcccattcttcagtggactgatcatatctcccgcttcggctaatacgccatccatcgtatcaaagataacaatatctgcctgtttaactagttctgcggggatctcatgcatttgcggagtgtatgcgccgataccgttgatatgtgctcccggtttaacatcggcagcatcaaaagtcgcctgttttgatgttgtgaccgatgtgataatatcagatgctcgaatagccttttgtaagtcaactgctgggagaatttcaaccttaaattgcttaccaaagcgtcttgtcatgtcctgtgcaaactttgcagcacgatctttatcaatatctgaaacgtaaacacgcgtcaattgacgaacgtttagcatggcctctagttgtgttggtgcctgaccgccagtaccgatgagcgttgccacttttgcatcagggttagccatcaaatcagtggctgcaccttgaagcgcacctgttcgaagctgagtaagataagtaccgtcaataattgctgacacaataccagtctttgggttcagactaaccattgttgcgggaacgctaggaagacccttatcaatgttattagggtaaacggatacgatcttcacacctaatgctggttctttaccggctgcataaccaggcatgtaaagactttgcccattatcaggtttgatatcaatattcgttctcaatggaacggtggcatcaccctttgaatatgctgccagtgcaatcttatcatcagcgattgcatctttcattgagtaaactgcttgaacatcttttttcgttaaaacgcgcatcataatcctcctataattgttgaacctgaaacagcaatgctatgcttctcccttttgacgcaaggacaatgccatgctgattgcggaataaagtagcacaatgataaccagccactgtaacatactagtatctaagcttttaacgaaaaagacggcaactaagacacccagcacaccaaaagttgaagtgaataatgtgatttttcgactataatctgccaacttaacgaattgaatcgaactcgttgaaactgagaatgttgcggctcccatcatgattggaaaagcagctgatggattgagccccatcgcataaaccgtagccatcgtcaaagcataggaaccaataccgatgttgttaagagcaccataaatgaacagcaggattgcagttagcattaatttccagccagataagctcgttgctgttccgttagcaggaatccaattgaacttacccgctaaaatcattaacgcggcaataatcagacctgctgtcacaaacttcttaattgtgttagctggcagtttaacaacaaacctaggtccgatgtaagcaccaatgactgccgcgatgatacatacggctagcgttttaatatcgacagtaatggcggtgatgtaagaaagtgccattgcagcaacggggacaacacattgcgtgtttaaggtgcctggcagtttcttaattgaaacccatttagccttagggtaaagtgccgtgctgatagcaaaatcagaaatgccaaaagttgaaagtaagaagataataaatgagctaaatggcaatgcccatgtcgttgcaggttccgacataacatctgaacgatgccggagcaagtcacggataaagtaaaatacaaagcctaaattaattagtacgattaatcccaataagatcttaatcatgagcattcttcccttttctatccatcatataaatatctctgacgccttcgagatccggaccaaacgccttctttgctgctgcatctaaagtttccagcgttctcagatcatacgcatcgtgaatcacatattcttgcgcaatgaaaacaaacgaatgatttctcgtatagatgacatcatcaccttcatccccgaaagtgccataaagaacctcagcaccatcaatgacggcattaacccaacgaccgccgaagtccagtagtttatcacgttcaaaccagtgcggatatactcgtgtaaaaggcatgtgatagtcatgacgattactaaacagaatgacgacgaagtgatcaagaatcttagaaagtcgtgttagttctcctaaaatgtccgaactgatatcttctttccagatttgtaagtaaaacgacttctcgcaatgcgctaataagtctgacagtttgtcctgtgtctgttttctgttgggaattgaataaatcagttcaccatcttttttagtctccacattcgctaatcgtgtttttattcgtgccaactgggcagaagcttggtgtccgagtgttgtcactaattcatcagcagagataacgttgtaatacgttggattactcttgcttgccaaaacaatgccacgttccgtcatacgattcagaacttcatagatttttgaccgcggaatacctgatcgttttgcgatttcgtacccggtactcgctggtaattgaagcatcgtgacgtaacactgactctcgtacttagaaaaatgaaactgcttgaacaagtctgttagttcaggatccacaattcatcatctcccctcagaaatgaaagtatcaaaatggtagctaccaacagtaactactataagtgaatttattcactagtcaagattatttttaaataaagttgagcctttttttccaaaactcttgataaacagctttctatttaaacaagtctagcattctcttttgtgcacttcgttacaattacaaaaatccccacaaaaataaccttgtttccaaagctcgggacaaggttatttgaaagctattattaaaaatcgcaagtcttgataactgatttcactatcgggttaagaattcaacgcctctaatcgcttctctcaacgcctccaccaacccccgataatccactgtcccataatcattcacatccactcgaatcaactgacctagctgaaacgtctggtagcctcgatcttgcacgcgattgctaaacacttcaaatgtcggcatgccatcaggcgtttcgctgatgttttcgagtgtatcaccgcgatgatagtgattcatgagatgaccaagatgacggggatcggataggtcgcgttttcgctggcgatcgtagagtaccttgatgtctgcttctaatctgatggtgataaccgcatagtgatgtttggctgccaatttttcgagcgctggtttttgcaatcggctgaagggatagtcgcccagaatcattttgtgttcctgcatcagcatgccaatgccgcggtagtatcgtgctctcgcttctgcatcgaggagttgcttttcctcaaggttatcaaagcctaactcatcgtaaagatgttctttaaaaagatcgagcggcagggagacgaatccgctgattgcttgcatgatcttatttgcagtatacgttttccccgtgcctggcgtacctgctagcaggaccaagatctgcttttgatcgctcatcatgtcatcctctcctctagacgggctccctagctcggaagtcttcatttaaggaccttgatcgcaattcatcacagtcacacgtcgacttctagccgggttacgctcttccccacttacgcgttaattggcacttcggcatctttatttaagaacaaaccactcttgtgcttgacgatatcgtagacaacttggttgcatggttcgatgttgttccgcagcgagttgttgacctcggtctgaccgaacatttctttggctttccgggtccaaccaactaataattcggtcccaacattgaacttgcggaagccgttttcggtcaaacgatgataatcagcttcgttcacgccggtaccgccgtgaatgaccattggtttgctgatttctttgtgcaattcttcaatcaaaggccagttcaattcggtctttgatttgaattggccgtggtgagtaccaacaccgacagctagtgcttcgacatcgacgttattcaagaaggcaatggcttgttgcgggtcagtataccggccttccttgacggtcacaccttcttcagtcccaccgattgtgccgatttcgcactcgactgaaacaccatgttcatgtgcatagtcggctacccggcgtgcccgttccatgttttccttattcggcagcgctgaaccgtcaaacatcacagaggaatagccagcatcaatggcttctttaatggcatcaaatgacttagcgtgatctagatgcagatcaacatcgactaacagatcttgcgccatggatttgcaaaccgcaacaaagttcttcatgccaacgtattcagccgtcgcaacacttgtttgaatgataattggcgatcctgcatcctttgcagccgtgatcattgatggcaccatttccaagttgtgcgcattaaaagcgccaactgtataatcaagtgcttgcgcttcatccatcaattgctttaagttcttgtacatagtagattgcctcccagcagattaacaaccaaaacctgaccgcatgacccgtttggacatatcgagcaatgcatccgtttttgtgacccatttttgaatgtcgtcatcatttttcgcttttgccgcttgttttcgctgcgtctcgtataggttcagcaaggcattgtatgcatccccaaactcttctttatctttgacactcgcttcataagctgcgattgcctctaagtcgttgcctaatttaacctgagtagcgcctaattggttgtatagcaggtggcgtttgtctttatcatcggttatctgttcaatttgagtcgtcaatgccgccacttttttggttagagcagcagcttcggttgtcgaaagtgattgattgccttcttttggcaccgcggatgggtgtctctgcgtgtctttctttttaaataaactgccaaacatagtcgtgcccctttctttaaactgctttaagaatcggcgttaggatccaggcatacatcagcatggccacgatcgtatcggagtcagttgccgaagcattcacgaagccaaacgaggtcaaggccgtgactagcagcgctggcaacaaggtgatgaacaggccgtggataatgccgccaatgatggccccgcggcggccgccgacaacgtttccgaagatccctgcagtcccgccagcgaagaagttagttaacatccccggcagaatgaccgcgagtccgaaaacaggcatcaagaacatgccaatgacggtcccaatagttgtcgtaatgaagcctaagatgaccgcgtttggtgagaatgggaacaagactggacagtcaagtgctggtttcgcatttggtaccagtttcatcgcaataccacggaaagccggaacgatttcaccaagtaagagccgaacgcccgcaagcaggacatagaccccgacaacgaactgaatgcccatcatgaaggcattcatgatatagttcagactcgtgccgttaccggcgtacttaggacctgcaaaagccgcggtgatcataaataatggcaccatcacaacagcaacagagagatacgtgtcttgcaagaattccatgtactttggtaacttgatgtcttcaatcgagtgtttcttttcgccacgttcaccgaagatccaagcggcgcctgcttctaccatgtagccgatcgtacaaaagtgtcctaaagcaatggcatcgcccttggtaatcttacgaacaaaaggctgagcaatggctggcatggccaccgcgaaaatcccaccgatgacactaccgacagcaatggtcacaactgaattaaagccagctatcttgccgccgacaaccgtcatggtcgacatccacaacagcgcctgtccggttagaaaaatatatttccatggcgagaaccgcgcaatgataatgttgacaatgaagatgcccaaaaaggttaaggcaatttcatttcccaaccccagcgtattcatggcttgaccattgatcgcctcaatgctgggtacaaccccttttaggtgaaaaccatgttgaaaaatctttccgaaatacgtcagtgctgtgacaataatggcggaccctgctgataatacttgaaatcccagcagtgtcttgaaggttccagttaggaccgcgccaaaggacttgcgttgtagaagtaagccaagcatcgcgattaacgcaatggtgatggctgcctgagtcagaatattttgaataataaagttaaccacaaccatgattgattcccccttttaaacgcgatcactggcgcagcaaccgccacgtagggaccttggatgcaatggccaaagcccgaccatcacatccaagaccgcttatactccggtttctaaccgcgccagctcacgctctgtttaaacgcgatcactgacgcagcaacctccacataaggaccttggatgcaatggccaaagcccggccatcacatccaaggccgcttatgctccggtttctaaccgcgccagctcacgctctgttgttcaagccgatttttctgataactctttgataactggcacgagcttggcttcaatttcgtctggatcaacaatgttgtgcagaaagacaaactcgatggctggatcgaggtcatattgtttgaactgcgaagcaaaattttccgccgagacaatgatgtccgtccgtaaacctggtgttgatgaaatcgcctcatgttcaaggttttcatctaatcccaaacggtttaaaacatcttctgcagtcatctggcaagctaaggaagagcctaggccggcaccacagatgaagtaaatcgttaatttcctggtcatttaaatcgtctcctttgacgttttctcgttgaataaaatgtttttaaaggtttgaatatctgtttgttgcgccagctgatcaactttttgctgatcattgatgagttggacaatggctttcatgacattgagatgcgaataattatcgatcgcggccagacaaaagatgatcttcacgggatcattgtctggattgccaaagttgattggttttgccaacgttgtgatcgtcacgccaagcttctttgtcccatcctctggccgtgcatgggctagcgcgatggcaggtccaatgacaatatacggaccgaatttcttaactgaatcaatcattgcttggatataatttttggtaatgtaatcctcgtcaagcaatggttttgctgaaatacggatcgcatcttcccaatcatcagctttctgttgaagctggatctggtgatcgttgattaaatctttcaacataggctgaacctccctttcattaatttcgacatggttctccttgaatgctgcttgcagatcagctaatagtcgtttatcaactgtcacctgatgggttttcagcacatccagaactgtgcgaaatagtcttgttggatctaacgtacggccttcgtacttagttaacgttgtgtgtttcttcaaaaacgctgcaactcgggtcaaatcaacttctgaaggaatgggattaaccttcaaactcgggattttatcgattggcatgtcgactgttttgaaaactaagctgaccggtaatttgcggagaatgccaacttcagacgtgctcaaaacggcaagaacatcaatgttaaaccgttcctccagtttggctgccaacactctgcccgtcgccgtgccgaagttgcagacaactgcggcttgatactgatagtcttggcgctggcgatcctcagcttgtgtcgctgagaaatacatcgccagaaatgccttctcatcatcagacatggtcagctgatagcgtcccgtcttgaagaaacgatcaatcgcgtcatagatcggcccatagccctgctgaatggtctttctcagcggattaaccactttgacgtgctgtgacaagcgcttgaacaaagcggtcatatggttatatagctcttcgaaaagcttttcgtttttagaaaatggaaagccaatttcagtttccatatgatcaatgagcgcaacgctgaaaatctgggccttgacccagtcgtcaagatcaatcgcaccgcggcgattaaaactgttgatcagaaaaccgacataacctaactcgctggcaacatcaatttgtaaggcataatgctgaatgagttcattgagaaacttggcattttccttattgagatcaacggcagtttcatcatctttgacatagtgcccgctgcgaacacggtgtaaccagataatgagtaacacggtcacttgctggctgtacatgtcgttggcggccaaggccccttttggaaaacaacggcgtagtaagtcccggatataggtcacatcttgtttggtaaagacttccttcatcttgtcgacatacatcccgctggcgattaattgctgggcaatcaaggtgaccaaagcatgttgccgtgttaggacatccccaaacatcgttcgaattgatcgctcgttgccttcaatctgtgcgcctaactttgggctggtcgtgagtgttagattgtattttgctagatcagcccgcaagttgcggagatcagaatccattgagcttttactaatctgcatcttttcttgttcatcgacgagataaaccggttgggtggcttgaagcaaatccaataagagatacacagcgcgttgctcaggggttaaagcgccttgactgatgctgtcaaaatcaaggacgtcagacagcgaatgccgctgttgcgttgaaatatgattgtaggcgacacctcttttgatatcgaataagggcaagcttttctccgccaaaacttcatttaaaacctgaatctcatttcgaatcgtctttgtcgtgacgttgaattgcttgcctaaatcagataaagaacttgccgaactgtccaacaatgttcgcagaagattcgtcaatctttctcgcattgctttgcctccttacagcttctatactaagcaagcgcttacatgctgaaaagtagaacctttttccttaacttgggaaacgaagtacaccttgctcatcattcttcaagtttcagcctcgataagtgacaaaaagccccataacggctaggcttgcctgcctaacaattatggggcatatgaatttttgaggctgagcggacatcgccattttcagcgcatcaaaaaaagcgattctcatctgacgagaaccgcctttaagtcattcaagttactgttgtgctttcacgtaagccgtcgcctgcgttcctgcttggcgaccaaagatcacaatatcggcgacggaattgccaccgattcggttgtcgccgtgtaggccgcccgtgacttcaccggctgcgtatagtgctgggattggttgctgcttcttggtcagcacctcagtcttggtgttgatcttcacgccacccatggtgtaatggatgcctggggcgattttgaaagcatagtatgggccggtggtgaggccatggtccatcccagttgtccgaccaaactcggcatcctttttgttggtgaccgcttcgttccaagttgaaaccgtcttggataacgtggccgctggcaccttcattttcttggcgagttcatcaagggttttgccttcgacaccgagcttgtccttgatataaaagtcaatggcactcgaccgttggcggacgcctgtatcaatcacgacccaagcatccttacctttttgcttgttaatggcagcggaaaccttgtcacgggtattcatttcgttatagaaccgcttcccgctttggttaactaaaatgccgccttcaccgcgggtcgcttcaccaatgagaatatgcttgctttggttaacagttgggtgaatttggatcttattcatgtcgatcgcatagccgccgactttctcgatcatcttgatgccatcaccggttgcgccagcttggttagtggtgacgtaatgagccagatcagggcgatatttcttgatcatttgcttacttgccccgaaaccgccagtggtcacaatcacggccttggctgcgatttttttcgtcttgtcttgattgatcttgacggtgaccccgctgattttaccatctgtttcattcaacttggtaacatctgagttcacaaacagcggaatcttttcttttttgacttctttcacgagcccatcaacgagataaccgccaacggctgaaccatcgtgtggccgatgcgtgcgcttgaccgacatcccaccggaaatcgtcaatttgtccagcttaatcccaatcgaatcaagccagtcaatggcgctggctgagttgtcgacaaaatagcgcagcagtgctttgtcattcgtcccgccgccaccttttagcgtttcttcatagaactgatcattgctgtccttaaccccttgggcagcttcaactttcgtctgactggcattcataccgctagaggctttcagcgtattctcgccagcaacgggcattttttcaagaatgacgggattcatcccttgctgcttcgcctcgatggcagctgtcatcccggcaccaccagcaccgacaatcacgatgtcatacttgcccttcatcgttttcggatctgtgtaggcctgctgtgaagccccgctagtgaccttgctgctagctgctttgtttgcttttgaacttgacgaactcgactttgaactcgccccgctactgcaaccaaccagcactacactcatcagcgccaacagccctgcgattttaacccactttttcaaaacatagtccctcccttatgttgttgtctacgtgaatagattaacaaagtagcgaaaccatctcaacttaaccttgagtttgatgatataaacgttaatcgttttgcaagaaagcgagcttagaagcaggaacgaaggaagacgaccgctacaaacatgattgctgctaggacagatagaccaaggcctaaccacgtccagccgcgatgtttttgctgtaagcctaccaggaacaccgaaataccaactaggaaaaacaacagcatcaatagcgaaaagctcattttgatcacccgttcacctaacctgattgctatgactgtatcagagttttcttattggctgagggcggtttgacaactttgccttaatcttaacttataagacgaattgtcaactcaaagagggacatattcgtcttcatcatcaattcaaaatttaacatttccacaactcaaacaatttacaaggcgttcgtgccctcctgatttcaaacacatcagcgtgatcaatcattttgatcgacttgaaaaagagaacatcttctcccgatgctttattatcaagatgaccaatacacagaaaaggcctacaagaaggccgcatgaatgcgccacctgaacatttttttcaatatctgacatggctagattcggccaatatcccactgtgacgtaataaagagtcgatgtaaacgcaacaatcttcgtcataaaggaaaatgtgggtttttcgattaaaaatgccaatatagctagtggaaataaggcatatccagacaatgacacaccgtaaaacgattcaatataggtgcctattccaaacgctgattgaatgaacccgccgaatccgaagcaaaacagcaagacaccaagccaactagaaacaaaaaaactaatgacgaatggtgtactgccaattttccactcgataaatggcccaagcacaatcactgcaagcatattcttcattaagtgcggccattcatagtggtaaactgtgctcgttacaattcgccaaagttcccctcttaaaattgaaggtatgctcccgacaaagttggctgatggtattaaaagaacattcgttaaaaacgaaaacaaaagataacaaactatcaatatgcagcagataaggaatgttcctctagcattcaaaaatacggataaaagattgggtcttctcaactttaacaacataaaattcacccgttttcttttcattagcaacattagcaccaaattttcttaagtcttataagatcagttgctcggtttggcagaaaagaagggaactttcttccaatttcttagcgccacgactataagggcacagaaaaggccggaaagaacaccgcataattgactaatctgtacaatgactgcaggctctggtgtatctgaattcggccaaaaccccactgtaaagtacaacagaagaccgccaactaaaacgcactttgccaacaaagaaaaggcaggtttctttatcaagaacgctaatactgccagtggaaataacgcatagactgacagtgtgccgccataaaaagcataaacgtaggtgtttatgcccactgttgaccgaatgataccgccaaatccaaagaaaaataacaaaatgccgatccaactagaagcaaaaaagctcataacaagcacaggactgccaattttccattctataaaggggcaaaggaccaaaactataagaaccgtcttaattaagggcgtccattcagaaaagtacacagtactcgttataacgcgccagagttctccttttaaaattgaagccacatcccctaaaaggtcgttcgtgggaattaaaaacgtatttgtcaaagttgaaaatagtaaatagcagaagagcaatagacagcatatcagaagcgttcctctggcagccaaaactatcgcgacaaaagtcgagtttctcagcttttgcaacataaaagtcacccattttctctttcaagtcaaacctacgaagttgcaaacatattggctcattgataagtattcaaaaaggcggatttgctcagatccgccttttcttcaactcatagacctaggtttcattcgattgttgctttaactgtccaatccaaaaactagtttgtgcccaatgcggaccggcgaaccggtattgataagcatcaccatcatacggagttgtttgtggtcccagaagatcacttcatgtgaaggaaccaccaccatcttggggatataagaacccgccagatgtgttctaaaattcattgcttatgagaatggcgctgtctagcaggctgttcctgctaattttttcccgtagtccattatccgcgtttttgtgaaaacggtggcaatcagataatatagtcatgagcttatcgctaatgtactttatctatggaggaaagtcaagaaaaaggatattatttattataacgaactgtaaaatttaaaaaatgatataggaatattgtttaaagcctagattgcaataataaagttaccacgtagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccctatctgagatcgttcaattaaggttataatggccatgggacctgtccttctctctagatggtatgttatgcaaacaccattttagcaagaacggacaggtcttttttcacattttctgggtggtaactttaattatgcaatctaggcatcaatcaggtctggcactgtgccactcgtctgcgttttacattgaaggatcgtgcaaaagtacccaaagataaaatcgaggcgttggatggtgtgatcaccgtggttgaagccagtggtcagtttcaagtcgtgattggtaacaatgtcggggatgtttaccatgaagtcgtgaaactggaaccatctttaagcgaaggcgaaactagcggtgaaacagccgcataaggaaaaatgacgttcaaaagcgctttcaacagcctgctaacgttcatttccggtgtatttacgccattcttgggcgcgatggcccgcgcagggattttgaaaggcttgctatcactggccgtggtcatgggctggttaacagcgaaaagcggcgcgtatcaaatttggtgggccgcagcagatggtattttctatttcctgccaattgccttagcatttaccgctgctaaacaactcaaggttaatcagtttgtgtccatggcgattgcggcggcgatggtgtcgccgggcattgtcgcgttgggcgcaaaggcaacaactattgactttttcggtattccagtcgtgccggcgaattataccgcgacagtcttgccaattctgttggttgttgttgttcaaaaattcttagaaccagttttcaacaagttgtggcacgaatccgttcgtaacattttggcgccagtttgtcttttggttgtcattgtgccattgacgctgattgtggttggacccatcagtgcgacggtcagcagttggttggcaacagcgattgtgtcgttgaacaagagtgtgccaattttggctggtttagtgctcggcggtttctggcaagtgatcgtgattttcggcgttcactgggcactggtaccggtgatgatgaacaatattgctcagaatggaaccgatttgatgatgccgattctgctgccagcagtgctgtctcaagctggtgcagcattggcggtatttcttagaacgcgtgatgccaaaatgaaaagtcttgccggttccagtaccattaccgcactattcgggatcacagaaccgacaatttatgggattacattgaagttgaaaaagccattttatcttgcttgtgtggcaggagcagtcggcggtatgatcgtggcgatttccggtgctggggcaaatgccgctgctttggccagtgtgctttcactgccaacttttattggcaaaggctttggactttctgtggttggcgatgtggtcgcgttcgcgctcgggacggtgctcacttacttctttggcggtatcaacgcaggcgcaaaaaccaaaatagcgccttctgccaacagcgaactaggcgaagcgttagcagcaccagtcaaaggggtgcttgtgccgttaaccggcttggcagatgaggtctttgcatctgagaccatgggcaaaggtgtggcaatcgttcctgaaaacggcatggtgaaggcgcctgttgctggcgtgattagactgctttatccaaccggtcatgcgattgggattcagtcggacaaaggctcggaaattttgattcatatcggtatcgatacggttaatctaaaaggcaaacattttcaaccacttgtggcacaaggacaacacgttgaaattgggacgccgttggtgcaattcgatcacgaagccattgaaaaagaagggtatgaaagtaccgtgatgatgattgtgaccaattccgaccagtatcaaatcgcgacgcttggacagggagccaccgatgatcggccggtcatgacattagcgtaaagagcgtgaactggcgcggtaagcgcggcgtagcgaagcggcattaagggtgaccggctgttgcctttaatgttcttcgcatagccgcgctgcgccagtgaaggcgttttaaaagagcgtgagcagacgcggtttctgcggctgggagcgcgtttaaggagagcagaccaatgacatacctaaattttccaaagaattttttatggggcggtgctacggcagccaatcatcttgaaggggcttatcaagaagatggcaagggtctttcaatcgccgatgtgctaccacaaggcaaggatcgttttgcgattgtgaatcggccagatttcaactggaccatcgacaaaagcaagtatcgctacccaaaccatcaaggcattgatcattatcatcggtttaaagaagacatcaaacttttcagcgagatgggatttaaatgctatcgtttttcgattgcgtggtcacggattttcccagaaggtgatgagaaaacaccaaatgcctcgggcttgaaattttatgatgaggttattgcgacatgcttgaaatacgatatcgaaccagttgtcacgatttcacattacgagatgccgttgcatctggtgaccaaatatggcggctggaaaaataaacgtcttatcgagttttataagcattttgcggaaacagttttgactcgctactttaagcaagtaaagtattggatgacgtttaacgaaattaacagtgcatgggcatttccggtgatgagccaaggattggttgccaataatggcggcaatgacaggcaaacaatttttcaagcatggcacaatcagtttgttgccagtgcttgggccgtgaaaatcgggcatgcgcttgatcctaagcttcaagttggctgcatgttgctttatgccaccacttacggctatgatgccaacccagtgaatcaattggcgaccttgcagcaaaatcagacatttaatttcttttgcggcgatgtgcaggttcgcggcgagtacccagcctataccgacgcgttgatggcggacaacgggtttaaattcacagatcttgatttttcagccgaggaattaacactgctgaaaaatcatccggttgactacattggttttagctactatatgtccgccgtagtcgaaacagttgaaaaagaacatgctgaagtcgggggcaacctgcttagtggcatcaaaaatccgtttttgaaggcgagtgaatggggctggcagattgatccgattggcctgcgcatcgcgttaaatcaattatatgaacgttaccgtaaaccacttttcattgtggaaaatggacttggcgccgttgacaaactggatgctgatggcaaaatcaaggatgattatcggattgattacttgaagcagcatattgaacaaatgggtgcggccattcatgatggcgtggatctgatgggctatacgccatggggcttcattgatctggtcagtgcttcttcaggccaaatgtcgaaacgttacggcttcatctatgtcgatctggacgatgctgggaaaggcagtttaaaccgttacaaaaagcaatcgtttaactggtatcagcgggtgattgcttccaatggaacggatttaggttaataatcgttttgcaaagtgaccttctgatgagagggtcattttttcatgcataaaaaaataaaattgacattttcagaaaatacgcagtattatatagaccggttgttataatagtggaggtagcaaatggatacacgcgaaaaactggtggcaacggctgccagtctctttcaaaaagaaggggtcagagctactggtttggcgcagattttaacggtcagtggtacaccaaagggctcactttattattattttccaaacggtaaagcgcaattgattgaagccgcgattacttatgctggccagcacattcttgagcatgtgcaacgggaccttgatcggtacaaggcgcctgacgctgcgctggctggacaactagaaagtatggcgaccgaaatgcaggaaaaggggcatcttggtggcaattcaattagcttgatagccttagaaacaggcgatgatcgtgagttgcaggccgcttgcagcgctgtttttacccagttagaaacgctgtacatcaaaaagctcacgtcagccggtattccacctgaccgtgcccagccacttggccaatttattcaagccagcattgagggcgccattattcttgccgcaaccaaagacaatcctgacttgttgcgacagaccgcggatcaactgacccgcttgatcaagctggcattaaccgcataaagccaatgccagttgtttgtttttatcatttaacgcgttcgccagcgcagcaacctgcgtgtaaggaccttggtcgcaatggtcaaagtgcgaccatcacgcccgaggccacttacactgcggctcctaaccgcgctggctcgcgctcactaaaaaggaagttatcatgcaattatcacaaacaaaagaaatgccgcaagctcgcgttcacgttgcccatccagcaatggccatgatcggcttgatgattggggcgtttgtcggtatgttttcagagacgtcgcttaatattgcgttgcctagtttaatgacggcgttgaatgtgtcacagggcactattcagtggctagtcacaggttatatgttggttatcgggatctgcatgccgttatccagccttttatcaaaatggtttaacactaaaaagatcattctttttgcacttagcgcctttattctgggctcggttgtgtctgcgatgggcgctgtttttccggttgtgcttattgggcgattgattcaaggcattggcacggggctgattttgccgctgatgttttcagtcgccatgcagattttcccgccatataaattagggacagtcatggggatggctgctttggtgattatgtttgcgcctgctattggcccaacgattaccgggctggtgcttgccaaattcacttggcactacattttttggctattcgtgccattcttggttttggctttcattttcacattaacttcgatggaaaatgtttatcatcaaacgcaaacaccagtcgactggttgtcaattgttgaatcgtcgattggctttgctgggattgtggttgggacaacgatggcgagtgatgctggctggctttcgctggaagtcggacttgctttgctcgttggggttattggtttagtcctttatgcccagcggcaattatcgttagcaaacccgatgctgaatttacgcgtttttgctaataagcagtttactgtcggaacgttactcgtcatgcttgattttggggtgattctggcctcgatgtatttactgccgatgtatctgcaacgggtgatgggcctgccagttgccatgaccggacttgtcatgttaccaggcgggattgtgaacgctgctgtttctgcgattgcaggtcggatgtatgacagccacggtgctaaatggttatcccgcggtggttttgtcattgctatcctaggcgtgttgatattgcttaatagtggtgcacaaagtccgttatggtggattattttagggcatgttgtcttaatgatcggcgcgccgttagcgatgtcacctgcccagacatatgggctgaatagtttgagcggtgccgaaagcgcagacggcagtgccttgctgaacacactgcagcaaattgtcggtgcggtttcaactgctgttgccacaagtatgctcgcactcggttcggccaaagccgctggacaaactggcctgacaattggttcgcattttggctttgtgttcgtcttaatccttgccattatcggactcatcgttgccttccaagtcaaaaaaccacaggcaagtcgcgacctttaattagtatcagaaacaggacaggacttcattaatagccatcaaccaagccaacaatttccctgtacagcgggaaattgttggtctttttggcttatgagctaggagcagtttatcagaaaataaagttcattgtccgtgaccgagtcgtcgtcaatctgttatgcttaagccgttgtcacagacgcactgcacaaggaggatcaatatgagtgaatacgattttgatgtcttgtacttaggtagtggtcacggcgcgttcgatggtgctggaccgttagcggcttcaggaaagaaagttggcgtgatcgaaagcgacatgattggcggcacttgccctaattatgggtgtaacgcaaaaatcacgctggacacaccagtcgtgttgcaacgtatggccgaacgcatgcaaggcatcatgtccggcagcatcacgatcaactggtcggagctagtggcacataaacaagcagtgatcaaaccgctgccgacaaatatcggcagtaacctcaaacaaaccggcgtgacgatcattcacgggcatgggaaattcattgatccgcatagcatcacagttgctggcaaaacttatacggccgaaaatattgtcatcgctactgggcgccgtccgcatcacctcgacatccccggaactgaattagcacatgatagccgcgcgttcatggacttgaaaacattgccaaaacgaatcggcattttgggatcaggttacatcagtatggaatttgcgacgattgccaatgctgccggagctgaagtcagcgtcttcatgcatgcagacaaagcgttgcgcgaatttcaccagccatttgtcaaagcggtgatggcagacatgaccaaaagaggcgtcaagtttatcccaagtgcagatgtgcaggcattgaaacagacggcgcaaggcattgcgatccaatatggcgatcatcaggaacaacaagttgactgggtgttagatgcaactggtcgaattcctaatgatgatcaaattgggttagaagctgcaggtgtcacctttagtcaacgcggcatcccggttgacgatcatttgcggacgaatgtgccgaacattttcgcgtccggggatgtgctcgacaagccacaacccaagttgaccccaacggccacttttgaatcctattacctgtatcagttgctcagcggccagacaaccgaccccattgactatccagcgataccatcgactgtgtacacaactccgcgaattgcaaaagtaggtgtgacgccagaagaagctgctgatggcgattaccaagttgttcgcaatcatattccggatgactggtaccatcaaaccgatcaggaaacgatgggggatagcatcctcatctttgatcgggatcatcatttggttggcgcaactgaattcagcgcccaagcggaagatgcgatcaacaccttattaccagcaattgtcttccacttcagtaagcaacaaatgtggcaaatggcccatattttcccttctgaaagtgctgcggcttggcataaaattcggtgaggctgcagcggcaattttttaacaaataagcggcattcaaaaagacatcgcttttgcaggaactgctgcggtgatgtctttttgaatgttggtaaatttgactatagatttggatccatcttgaaggtgagcttcgataagttagtgcccattgtgatgagcttgaacaggaaatcacgggttgtgtcattgtagtgcttggcaatggcatgattttgttcagtcagatacgtggttaagtcctcgccactcatcccggcagcagcttgatcaacttcagcaattttacgacgtgcccattcattgagatctttttgataagctaagtcgtcttcgatgaactcagcataatgcgattcgacaaccatcgcgagcgcttcatagagccaataagctgagctcagatccatcttctttgggaactcgctataactcttatccgtatcggttgcattggtgaaaaacggtacgtgcgggcaaaaggccgggataccgaagccgacccattggacgccggctgcgccattttgattggcatcacgcatttgcagaatatgcgagttggccgtgcgcgaaagtgagatagcgcgataagtcttgcggtcgtgttcattgccgtgacccaacggatcaaacttggtttcattgaagtgggatttcataatgtactgaatatcttcaacagaaatcttgcggttcgccttgcgaatgaacggcaattcagctgattccggatcctgctcaatttctggattaaggtagcgttgggcgaaccaaacccgcggtgtattgtagtggtgatccttttcagtgtcggtgccaaaaatgtgccgaaagttccagcgatcggcgtcaggattcaagttgtgatctttgacgaaatcttgaatgccatctgcccacatatagttgtccggatcattgaaatcaatgtcctgaatcgcgatttggttggcagcaactgcgtaacaatcgtcaggaatgcgaaccgcaacccattgatgaccggtgacaatttccatataccaaacttcgtcttgatcgttaaattggacaccattgccttcagctgaaccgaactttttgaccagttcgccgagataccggacgccatcgcgggcactgttgataaacggtaacactaaagttgtcatggagtcttccacgagtccatttttgatgaagggatcataagcaagtacccgttcgttggcataaacactttcggtagcactttcgccgacattcttttcattaaaaccgtcttcttcatttggtccggcactttggtcagcatcgggcgtggatgtgtaacgatacccggattcggggagtggcacagtcaggttgttatatggcgatacataagtttccttgcggccagttacagctggttgaaccacaaaacgttttggatagattgcgactaagcgatcctcgttgcgggagatgtaggtcgcgccgtcaagggatgcttttttaccgaccatcatggatgtgcaagctgaaatttcaatacgatcaatcatgttgatttcctccaatagttgagcgcgagcaggagcgtttagaaaccggagcataagcgggcttgaatccaaatggcccaaacttggccattggattcaagttccttatgcacaggtttgtgcgactgcgagcgcgttatcgtgtatttgcgttgagacgctgaataaggtggtcatttttggcaatttggttcaaatagatcatcaggcggtcatcgcggtgatcatctgcttcagggaatttcttggctagttctttgccaataacggcggcgctgcgatgaccattgatcttgctgaatacaaaactaccgtatgcatctaagtgtaggtaactgacggcaggaatcttcatgtgcagataatgccgacagaatttttggattgggtgattctgcggacggataatcgtgatttttccgccttttttagtgtactgaattgctggatttttttcataaatcaaatgttgtaatgtgtcagtcgcagtcatgtgtcacacctctttattgcttttgagccttgcgcgttggttgtttgattcgcatcagtgggatgacgatggttgccgccatgatgatgagcaagatgacagccatgccattactgccagcaaagcctgcaggaacacgattggataacacaccagtgacatgcaggataatcccgatcagaccaatgatggaaccgcccgcgattaaaccgctggaaagcgagacaccggaggataaccgggtttcgcgtaatgccttgtctttcgtcagtttttcgatcaataatttgagcaaggcccccacgaggataatggatgtcgtggagattggcaggtagaaacctaaggcaacggtcatgatggagagaccaagcatccagcagacaatcgcaatgatgataccgacgatgatcatgatccacggtagattaccggagagaatcccagtggttagggtcgcaatcaggttagcttgtggtaaaccgaatggcgggttggcactcttaatggccaattgcggtgcaaggatgacggttgtaccgacgacaacaacaacaccgatcaaggcagcaatcatgaaatacttcatcatttcggagcggcggccaccgaccaaataattaactttttgcgtttgggtataggccccgccgactgaaatggcggtgacaatgaagacaccaaagagcaaaaggatttcattatgcgcgttggcggtccagcccattaaggcaaacacgagggtcatgaccacgagacttgcaatggtcatccccgatacaggcgcattggaacaaccaattgtgccagcaagtcgcgccgaaacgatgacaaacagcaaagctaaaacgagtgacaaaataccggcgatgatagcgatcacgatgttgccagctaagaaagcaccgacgatgaagatcgcgatggcagcaacaagtagggagaccacaccgagcgaattcttttcttcgcggacatcattgcgtgcattcaatgtttttttaatggaagtgacaatgacaggaatcaatttaatggcgccaatgatcccaccgcagagcatcattccggcgccgatgtacttggtataggagccagcgaccatgtcgatgttcatttgagacatcaacatatgggtgtcattccaaacatgggcaccgccaccagccatttgagtgaaataagcgatgagcggggtgatcccgaagttcgctaaaatggagccggcgaacatggtgagcgaaacatccaagccaacgacaaagccgatgccggctagcatgggattgacctcagttgaaattttccagcgatacgacgagttgccgacgaaggtcatcacgctgttcacccagccgaaaacctgagtggtcagcaaagtgatgataccgccgatgccaaagccgatgcccatatgtttaagcgaatcgccgcctgcttcactggcatctaaggcttcggagatagccgtcgattctgggtacatcagcttgccgttttcttcgacaagtaagtagttttcaactaaactcgcaacaccgacagcaaacaatacggccaaagcgccaactgcgatgcctgcgaagaagttgacttttccgccaataatgataatggctggcaagacatagatcatgccgctggcgatggattcaccacctgagctcatgccttgcaaaagatttttgccaaaaatacctttctttttggcaaagacaccgaccatgccggaaccgataatcgaaccgagaatcccagcagcaacagttaggccggctttcatgcctgaataggcggtagatgctgcgaagatcgttgccaaaatggcgcccatgatcatgatcgctgtgctgccgccgctattttccttggcaccatccgttgcgtatggcacataatgtgtcttggcaacggtatgcttcgaaaacgtcttttccatggtgcttccccccttttgaaagtgagcgcgagccagcgcaggtttcagcgctggcgagcgcgttatggtgagagcatgagctagttcagaaaccgcgctagctcacgctctgtttttatccgatgaagtgcccagtcggatcacttttaaagaaatgatcaatgttatctgctacccgttccaaatcgacgttgccaccagagacaagtgcaacaactttcttgcctgctagccattgcggtgcgattttgtgagcctcgagagccgctgttggtaatgcaccggcgccttctgccacggttttggtgcgttggagaaggtctttcatcgcttcagcaatttcttcttctgagacgagtaccatctcatcgactaattcctcagctaggccaaaggtgatatcgccgggcatggcgaccgctgtgccgtcagctagggttgggccagtacattgtcgggtcaacttgcctgcttgcaacgaggccgtcataccgtggacattttctgattggacaccaacgatgtgaatatagggattaaaatgtttcagaacggtggcaatccccgtaatcaggccaccaccgccaactggtacgatgacggtatcaacatcccacagctgatctaaaatctctaagccgatggagccttgtccggcaatgaccaatggatcattgtaggggtcaacgacggttaggccatcttccttggccttttgttccatgaaggcacgagattcgtcaaaagtatcaccggcaaggacaacttttgcaccatagccgctcgtggcttgttgtttggctaatggcgctgttttaggcatcacaactgtcgcatcaatgtcgagtaagtgagccgtcaatgcaacgccttgggcatgattgccagcgctggccgtgatgacaccacgagctttttcggcgtcactgagatggcggattttgttataagcaccgcgaaacttaaatgaacctgtgagctgcatgttttccagtttgagatacacatcaccgtgggtaacggtgcgactaagaaacatggattgaatgagcggtgtgactcggccaacctcatgaatgagatggctagcctcttgaacatcttttatactcacggtttgcgttgcggtcatcatcttatccacctcctaatgttgcgttttgagcgctgtttctaatgaaacaactggtaagtttaatgattcggcaaggcctttgttggtaacttggccgtgataaagattgacgcctgaagccagcgcaggatcatttttgatggcggcatcaattccagacttagcgattgccaaaagatacttgatgttgccaactgccagtgccatcgttgctgtgcgcggtaccgcgcctggttgatttggcacggcataatgaatgacgtcgtatttggtgaaaaccggatcatcaatagaggttggtgcatcaatagtttcaaccgtgccgccttgatcaatggctacatctacaaggacactgcccggtttcatcgactgtaccatcgctgttgtgactaacttcggcggctttgcacccggaatcagaatggttgagatgaagacatcggcggtcttgatagccgcggcgagattctctggcgtcgatggcaggagcgtcagggtttcacctgtaaactgcttcgctaaccagtcacggcggtcttttttaagttcgatgattgtgacacgacagcccatggctaatgccaagctggcggcgttaaaagcagcgttcccaccaccgaaaataacaaccgtgcctgaagcaacttccggtgtgcctggcaataaaatgccttccccgccatgctgtgcttcaagataataagcgcccatgatgacggaccggcgacctgcgatagcgctcatcggttttagcaatgccaactcgccattttcaacgatggtttctccgccgatcgctgtcgtgccggcagcttgcatggctttcacagtggcaggtgaggaggccaaatgttggaatccccagacgacctgacctggtttgaaatactgatattcttcctcgtcaggttctttgactttgacaacgagatcactatcccaactctgagcgtgactgacgatagtgccgccagccgcagcgtaatctgcatcaggaaaacctgcaccgactccggctgatttttcaaccaaaacagtcgctcctacatcaaacagctttttaacattttctggtgtgacagccacacgaccttcgccagctttttgctctttcacaacgccaactttcacaacaatcagtcctttctttccaccagcaatgttaaggccttcacaacaagtagcacaacaactgtgtgatatttctcacatataaaatgtacccgcttacagttttaccgattatttctcaccggatacttaattcatcctctatacgccggtagttaaagaacatgtataaagaagaatattggtcttaaatatcaaacattgttgacgcaaaagaggcataaaagacttgtgaccaagtgaactttggataatgattttacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccttaccgcaacgatggatcattgaacgttcatggagttggctagacaaatgtcggcgactttggaaaaactgtgaacgcgcccttaacagcagtcttcaaatggttgtattggccttcctgaagatagttcttaaaagatactagacgggttctaagatgaaaatggcaagcgctgaatgatcattggttctttcatattaagtgcgattttcttatggctgtgggctttttttatctggactgcttgttcattgatccaccgggtgcagtcagcgtgatgttcaccccgaaaataaatcttccccgtgctaaagccgatgacggcaaatttacgtttttcgcaaacagccgccattttctctaaggtttggtcagaaatactgtcctcagagtttagcaagcgacgtacagtccgatcattgatcttggcttgtttggcaaattctggattgctaagcttgttcctgtcgatatagacttggactagtttacgaaccacttcacaattcaattcgatcactctccattcagttgaaatgagccgttattgtagttaatagttacccctgattgcgtattgaagacccagacattagcttgaaactgtgatggattgttaatcgactgcaccaaaacgtgtgtgccacgcggtaccagttcttggccaacgtacacgggaataacctgataagcgaccgcatcgtcttggtgtgagctaagataattgcgcgtcagagtttctgtgtaagccatacccccgggatttcattggtcattggtaccaacattttgagcacgagtgccaagaatcacattatgagtctgcatatcgccacctagcgaccacgctaacaggtggcttttattatacagataacctcgataaccgttaagttggaccattcggttattgttgctgcggccaaaccattgttgcaggtttttgttatacacgccatcagcgtactcaccggcaaccttcgtggttttaggaaaggctggtcgcttgcgtacagagcttgcgtgactgtgcattatactgtaggtcacaatggcagaaacactttgcgttcttcctagatcatccaagccttcaaagtaagtttgagcgcgtgtggttttcgctttctgggcggcagctactgtttgcttaaaaccatttacgaagattggaacgttttgattaagcgttgtgtagttttgcgggtactcgaataagtaactaaatgtgacaacttatcgttacttgaatatttttgattagtttgctagcatataagaagtattattaaaacatgaataaataaatcggttgacgtaagctcaaggtgttctctttcaggggtgtgtaagaggtatctgggtttacgttttttgtatgaggaggtttttgtttggaatttttaggtaccttggtgatcatcttgattacaactagtctatttggccatctagcctctagggttggtatcccagcagtgatcggtcaattatttgttggaattattcttggccctgcgttgttgaattgggttcacgccaatgatttcatccatattttttcagagattggggttatcatcttaatgtttatcgccggacttgagagtgatcttacattgcttaaaaaatatttgcgtcctagcataattgtcgcgttgttaggagttttgattccgatggtactgatctatccagttggtattgtttttggcttgacacaatttgaaagcttgtttttgagcgttatttttgccgcaacgtcggtttcaatttcagttgctgtcatgaaagaactaaatttacttgatagtaagagcggttcaacagtcctcggtgccgcggtggttgacgatgtgctagctgtcgttttacttagcattatggtcagtttaataggtacaaaggctggtacggatacccagataccgctagctctgacttttttagagcagctaatttactttgccgcaatttatttcgtgatgcgttttatcgcccctctcctcgctagactaggcaccaaattattgaatccagtgggacctactataatggcgatgattttgtgttttggtatggcatacattgcagatctgattggactgagtgcagtgattggggccttttttgcaggaatttcgattgcacaaactcatgtagctcatgaagttgatcaaagtatcgaaccaatcggttatgcgattttcattcctgtattcttcgtttcaattggtttaaatatgtcactagctggcatagaacacgatttgttattaattatcgtattgacgattgtggcaacactgacaaaactattaggagcgggaagtggggctaaatgggccggattcagttcgaatgaagcttacctcgttggtgcggggatggtctcgcgtggggaaatggccttgattatcgctcaaataggctaccaatccaaactaatcagtgatgattactattcggcaattatcactgccattatcctaacaacgttattagcaccattactactcaaacatgcggctcgtcatataaactactaaaacatcttagcggtatgacaccccttctctgtgaaaaataactactagatttcatcgagatattgcctagtttaattaagcactaaattatataatattggttataatggaggattagttatttgatacagcttgtaaaagaaaaatttgacgttactcgtttgcgatttgttttactcggcctgcttgtgggtttaatgagtggcaccgttgttagcttatttcgctattgtattgagatagggctgcactatagtcgattggtatatagatacttacgaatcgcgccatttgtttggtgggaatgggcattgttgattggcatcaaccttggtttagctttaattgtggctcgacttctcaagagagaaccttatatctctggttccggaattccgcaagttgaaggtcaattggctggcgaattggaaatgcactggtggtcaattctttggcgaaaatttatcggtggtattctggcattgggacctggattatttctcggacgagaaggaccgtcgattcaattaggtgcgtcagttggtcaaggtttcgctgctgggtttaagttatcaggaactgatcgccgactgctaattgcatcaggcgccgctgctggattagcagcggcgtttaatgctcccattgctggaactctatttgtcttagaagagatttaccataatttttcaccgctggtttggttaacagcattagccggagcaattggttcaaattttatctcgctgaatgttttcggacttgttcccgtgttacatttaaattattcacgtagtttaccagtatcaaattattggcacttaattttactcggcattgttttgggattgtttggttacttatatcaacgggtcttgttagttatgcctcggtggtatcatcaactgacacatttgccacgcccaatacaaggtatcgtaccatttctgctggtaatcttagttggttacttttcgccaaatttactcggtggtggtaatggattaattgttggatttggccagtatgttccacctttgtttgtactaattgcaatttttattatacgattcgtcttttcaatgatttcatatggttccggattacctggcggtatttttttgccgattctttctttaggtgctgtgattggtgcggtttatggcgtcttaatgaatcaattaggattattatcgcatgtctatatcatgaacctaatcattttttccatggccggttactttgctggaattggaaaagctcccttcacagctatcttgctggtaacagaaatggttggcaatttaacacatttaatgccattagcagtcatatcgttaactgcttaccttgttgttgatttattaggcggtgcaccaatctatgaagcattgcttaagcagatgacaatgcctaaaactgttcagcaacttcatcgacctgatcatttggaaataccggttttctttggcagtcccttaaacggcaaaatggtccgagacatgccatggcctaaagaagcactgctcattggaatccggcgtggtgaacaagaagtgattccacatggtgacaccttgattcatgaaggtgatacgttagtactgttaactgatacaacccaacgaacccgagttaaacaacggattgatgcattattagcaactttagaaaaaaaacaccgagactaagttaataggcaaattggtctatcataataataaatattagattaagtgggtccgttgccagacataaacatattgggaaactatatacaaatacggcgaagtacgaaaaacgctgaaaaagaattagttgaacctatttttgaaaaatacaaagataaataataagctgaaaatgccttgctacccaatttttcatagtcatgctataatgaaaaagaaaaaggaagtcccacgtgaacaggacttcccgtgtagagccgttaaagacggtggcagatattaaaacaacactagttcgccccataaccggtcaaagttatgtggggcggctttttcatttgtggtgtttgtcgatatagctgagtagcgcgattaaaaacgtgccaaacagcaacatcaacgagagtgtctgaaagacgctcattgactgtgaagccttcctgaagattattccatgttcccatgagcctcacctcgcaagggaaaagacaatcattgccattaaagcttcttgcttaatctattatacagggaaatggggatagaatagtgtctatgcataatcagctttctttaatcttcgagccataaatagccaagctattaacgaaaacaacaggactataaataccgtgatgtaactcgtgtttccgtgataagttaaagattcgatccaaaaaaaattaagacaactaggatattcacgagaaaccttgtttccagatgaaaaaacatttgatggtaaatacagggaaaagataaattcaattaataattcgcactaagcttaaaggccactagggtataccctagcggccttttttggtttcaatatatactgcgaattatacatgtccattatagctgtccaaaaaggagcacaaaaaagctaaaatcggctgtgattgctggtaagaatgtaaataggactgataaataacaaaaatgaaattgctggttgccataattatctcccctttagagatataccgtttaggcacaggcctgtgaaatatttttttaaaatgggaatttttaattttttagttgaaatataattccaccgagtttatagtcatcttgtaagcgataacaatattttgggagggaagaacatgaaacatcggcacttgtttttagcttcattcttgataggaacattcgctttagcattaggcattggtcacccagtatcggcacaggcagcaacggctaaggtaacgcctaatctcagctcagtcgttactagtacggtttattccaagaaattgcatctcgactggaattatgatgtctatttgccagcagggtacgatccaagttctagcaaacggtatcctgtactttatatgttgcatgggttatatggaaaccaccgaaatttgcttgaacggtttaactctcagcagatgctcgatggtattgagcatcgaactaataaatccatgattgttgtttttgttgatggttttaatagtttctatgtcaaccaaaaaggcggactccaagtcgaatcagccattattcatgatctcgtaccaaccatcaacaagaagtacaaaatatccacgagtgtttctaagcacgctattggtggcatttcaatgggcggatctggtgccgcaagaattgcattgaaatatcctaatcttttctctaaggctgttttaatctctccagctgtctggtatagtctgccaaaagacaatccaattagaaggaatatgcatgccttcactgatggtaatgtatcctggtcaacaaaacgctacaaatctttgttcccaacccaatacatgaatgatgcgtccaaaggcgttaagctatacatcgaatcaactagctctgataccactgtgcccattaagaatgtgacacatttcgtcaaagatgctaaagctgcaggcaatagtacgaagttcattagagattctggcgataatcataactgggtctattgggcaaaagctgcaccaaaggcttacacctgggccattaacgagatgaactaaggaggggttgaaatgaataacgcagatattgcaaaaaaaattctggataaagttggaggcaaagagaacgtatttagcaacgtggcctgtatgacacgacttcgtatcggtattcgcgatgattctaaagtcaacattgatcaattgaaacgtgttgacggcgtacttgcagttgttgaagccgataccctgcaggttgtgttgggcccagggaaagttaacaaggtggcagaaccatttgctgaattaactggctacccattaggctcagccgatgaagatgaagacacaataagtacagatactaagcaagccaacttgcaagaacttaagagcatggcttctcaaaacaaggcagcaaataaagcaaaacatgataagcctattcaacgcggactacagcacattgcgaatgtctttattccactgcttccagggattattgctgccggtttgataaatggcctgacaaacgttattgactatcaaacaggttcggcatttaacaatgactggtggtatatggcaattaagacgataggttggggcctgtttactttcctgccaatttttgttggtatgaacgcaacacgtgaatttaaagggagcgcaattcttggtggtatcggcggcgtattttgcctaaatgcttcaattgtcggttttccaatggcatcacaggcgctctcaatgcctatctctaacaccccatatgtcacaggtgttggcgttctgttgactgcgctattattgggaatctttcttgcttggttggagcgtagcattcgcaagtttatgccaagtgttctggatactttctttacaccattactgacattgattgtgggttgcttgattgccgttgttttccttcagccagttggactttggttgaccaacgccatctatattgcaatggattttgtttacggtaagctcagctggtttggtggttatattctgtcttccacatttttagggctggtatcagttgggctgcatcaagcgttgactccaatccatgttatgttgaacgacccgactggtccaactcatggtatcaactatcttcttccgattttgatgaccgccggtggtggtcaagttggtgcagggcttgcactgttctttaagagcaacaacaaacgatttaagaaaatggtaatgagttcaattccagtcgccattcttggagttggtgaacctctgatgtatgctgttaccttgccattaggtcgttcattcattactgcatgtattggtgctggatttggtggcatagcggcttctctgttcaaattaggaactgtatcccaaggagtttctggcttgttcggcttactcatcatgcaaccgggacaacaacttctttacctgcttgcaatgctgatcgcctacataggtggattcatctgcacctggttctttggtgttgatgaagatcgtatcgatgaagtcttcccagaataagaaaggtacaccatgaaattaggtttttctgtatttcttcatgattcgataaacaagcaagacgaaattcgaattaagcaatatgcaaatagtggcttttcagggattttcacttcactgaatctaccagaagatgacccagcaacactcatgcataacctcgcagctttagggagatgtgccaaagaaaacaatttggaactcacggtcgatatttctgcttctgcttataaacgattagagcttgatgtctatgatccaactcctctaatcagtcttggcgttaacagactgcgtatcgatgacgggattgatatggagagcattgctaccttgtccaatcagttatcgattgcgctaaatgccagtactatttcagaaatcgacatcagtcgcctgcttcaaaatggagcagacttcaaacatctcgaagcttggcataactattatccaagagaagcgacgggacttgacctcgattggttcgacaaaaagaatcgctggttgcaagcagccggattttcagtgatggcctttataccaggaaactcgattctacgaggaccagtatttgctacgttgccaacacttgaaaaacaccgatttgcaagcccattttcggccgcggttgagctaactcagctttacgttgatgatatctatctcggtgatcctggcgtgacttataaaacactgacacaatttgcgtgtctacaaaaggaacaatgtatcttaattagagcaagacttaagtcgaacgcgccaaagtatttgagtgaagtctttcatcagcgagccgatgtggctcgtgattgcattagattaacagaaggacgccaactcgctactgaaaaagttgaagtggctaatacaacggtacggaatgcaggggctattacacttgataattacctttcaggacgttacatgggcgaactcgaaatcattaagaaatcgttaccacctgaccggacagtaaatgtaattgggtgtgtgattgaagaggatcttgcgcttctacaaatgattaaaccaaatcaaaaattaaagattgagaaagttagtgatgaataatggatctcaccagactagagactgaacagcagaactctagaacaatgaatcttgacgaaatgagtacgctcgaaattgttcgagcaatgaataaagaagatcactatgtacctgaagcaattagccaaaaactccccgtcattgctaattgtatagatgttatagcaaggcaatttaaaaaaggtggccgactcttctatattggagccggtactagcggacgactgggcgttctcgatgcggctgaatgtgtaccgacgttcggtactgacccagagatggttcaaggattgatcgctggtggcatgcccgccatgacattagccgtagaaggagcagaagacgatgtaggccttggtcaacaatacctagtagatcgaaagctctcccctgatgatgtggttgtcggaatagcagctagtggtagaactccttatgttattggcggactagattatgctaagcagaatcatacgcctaccattgctttctcatgcaataaagatgctgaaatctctaaccatgctgatattgcaattgagatttcagctgggcctgaagtgctctcagggtctacaaggttaaaagcagggagtgttcagaaaatggtgctaaacatgctctctactgcttcaatggtccgtattgggaagacttacggaaacttgatggttgacgttcgacaaaccaacggtaagcttatcgaaagggcgatcgaaatgattcagaccgtcactggtgtaagccatgacaaagccaaatctacgcttggtttagctgatcacagtgtcaaggtcgccatcgtcatgattttgaaaaatgttgatgctaatcaagcaaaggcacgactagaaaatgcggacggtttcgtaagaggtgcgatacaatagcgatagaggtgattgggtatggcagagacaattctaacaactattcatgatcaaatagatcgaatgtcagctgccctacaaaaattagggcaatacattctgactcatgttcacgatgtgcctaagatgaatgtctctgtcttagcagaaaaaagcgaagttagtcaggcaacagtggttcgttttgccaaggcacttggttatgagggctttaccgaatttcgtctacaactggcaagcgagaatgtggtcgtcaacgctgaagacgctaacttgttctctgagatttcacctcacgatacggctgaagaactcaaagcgaagctttcatcacgagtagagaatgccatcaccaccacttctagacgtcttccagccaagactctcgatagtgccgccaacttactttcttgggcaaatgttatgagcgtatttggaatcggcgcttcgtcagtcgtcgcaaatgacttctatcagaaatttagtcgattgggcaagccagttctcaaccctcctgatgtacatcaagcaatgacgaatatcgtgacacaaaatatgaaccatgtcatggttttaatctcaaattcaggattaactcaagaagttatcaaacttgctaaggccagtaaagaaaacaacgttcctactattgtgctcacagcggagcaagcaggccagcttagtaaagcagcaacacttgtcatcccaacagatgaaggtaaaagtcccgaccgccttcgtacagctgcaacaacatcacttctatcacagctatacgttgtcgacttaatattctatagatatctacaactgcattttaacgaaaatgtctcagcgctatcagactcctacaagatcatcaaacagtttctgaagtagagacacagctttattgattagaggtgaataaatattgttcaaattcttcaaaaagaatcccatctgggcatcaaattcaattcttgcgccaagtgatggcactgccgttcccatcaacacgattgaagatcccgtcttctcacagggagcaatgggaattggcgtagccgtcaatcctagttcagataacgtctacgcacccgttagtggtaacgtcacaatggttgcagcaacgaagcatggtatcggaatcagcaccgcagaggggcgtgatattcttatccacatgggtgtcgataccgtcgaacttaagggtaaaccctttaaggtgctggtaaattcaggcgatgaagtaaaggctggggaaaaaatagccgttatgaaccggcaagaagttgaagcgaatggtaagctttctactatcatagtcgtggagacgaacagcgctgagcgtaaggataagctgaacttagtcaaaaccgggactgttaagcatggcactgaccttgccaagttttcttattgattttaatcatataccgcagtacggaactcaagcaaaagtatattttcatttaaaaaagagcttctcgagaaattgatctcgaggagctcttttccataaatcacgggtctacactttctagtgttgagaaataatcaatgctaaaaaagtggatcttttcgtgtcttcggggtgataacttaattatgcaatcaaggattcaaacggctcttatgttgtagttacggacacaattaatttgtgcgttcattgacggttcattaatcaatttaaaatgagtttcttcctattatatatacggatatgccaatcaagaatgaaactggttagacttttacggggattaaattaactaaacagtttaaatgtcaaagacatgcaaaaaaactgaccacagtcccttgctgaattcaatttctagaacgtattcgggtcacttatatgtaactaataatattctcaatccgcatccgctacaatagggtacaccctattgtgctcttagtggtgtctcttttttagtcactctttggtaatcaacgattccatatgttttattaacagtgattttaatgatttgcccagatttaaacgggcctatatcgtgctcatctgtttttaacttgagattctttatttttccctgtgcgttcttagcagctccttcgtaagtgtatccttgaatcgatattccaacaggtacttcaacgtttgaaataataggctgactatcaatcttcatgtagtaagaatcaccaccatattgatactcagtgatataaaccgaaaaagcaattgttgcaacaattgcagccaaaaaggatgtcagccacagtctctccttatgattctcattcatgctaccatctcccatgacagtctttgtaaagtatagatatgtagcctatctgatgtatttagcttatggataacagcctttccttgaacttttatttatttaagttcctatgctgtaatgatcgcataaatttttgttcgtaattccagcataggagtctttattaaaaaagtttattatgaagtcggcccaaaagatcacaatctaacggatcaatttttgaaagtttatcagttagtaatcattgagccacaagctgtagccatgttgtcaatatcgccgtcccaatcattaacagtatcttgctgagaatccagcgtttctctcctgcagtattctctactggagaaatattagacagaggaaaagccaacaattttttgtgccgaaattctagcatcatctgcacaatggttaagataacaaacaagacaattgatgtccacaaaatcattacacggacactatcgtccaaagaaattatcagaaaatcgtttattgaatagactatccagccacctaagaaaaacaccaatgataaaatctttgttgtgctttccaatttgactaattggttcaccttcttaaataaagttggattttcacccagatatttagctacttctatataggcttcactacgcttttgatgcgcagcttgtcgccgtaccaatattgtcaaaaaaagagaacttaataacactgtgaatccaagcacaccaagcattaattgtaacaaccccaattaatcgcctccttaaaagctaagcagcaatgaatgtcgctggtaatagtttagcagccgttccaacaagcgtagccgctacttctggagccataataattgttgctattaatacaacagctcctgccgcccaaggaatccactccaggtttggttcatgttcagaaacgggaacataaattggtttataatcctcagctgggatccccaatccatttggtttagtgtatatctcaatactcaatgaggttgtaacattttcctgttggccgttagtaacaactgttgttgtagactcacagaccactttaaaccccaacattccatttttagttgacattccaacctttagatttccattgccaatcattggccctagtgtaccaagcaaagccgtaaagtcaaaattccttgcagcttcgtgcgcctctttgaatttattgatttcagcggatctggtgcaaacagtgtgagagatgaccatctaaccagctattgatcctatgttgaaggttatgcagctaacaatgcttctaattcgtccacgactgagaacccgatgagacttaactctcgtcgggttcttttgcgtattgcgtgaacaatttccacaccgctcaacgttgcactagcggttcgaatgctttgaaagcttgctgactatctgagatcgttcaattaaggttataatggccatgggacctgtccttctctctagatggtatgttatgcaaacaccattttagcaagaacggacaggtcttttttcacattttctgggtggtaactttaattatgcaatctaggttagaactctttaattctaagtactaaaatctcaataattcgggggaactttaatcggtcttgataaggtttttttgagaagagaaagatacagagccttttttattgtttctaaataatatttgcgcgtatttaatcccaaatgcctaaaagacacgtgtttacaaatggtggatgattctcataaatcgtttttgatttattttggcttttttttggtttttttagacggaatttgagatttcttttgaaaaggcatcctagtgcagcacaatgttttacaatctaataccatacccctacactgaatttagggcctaccttctaggtgaccgctgcgtgaccacacgcatgagaggaagagcgagcatgtatcaagacttgaacggaaagattgcaattgtgacgggtggttcaaaaggcatcggcgctgccattgcagaacgatttggcaaagagcacatgtcagtcgtgatcaattatttaggtgatcatgaaggtgcaaagcaagtcgccgacaccgtgatcaaaaacggcgggcaggcggtgagcatccatgctgatgttgccacagaagatggcattgctagcttagttgagacagcaacggctcattttggcggacttgatgtctgggtgaataacgctggcatggaaatcaaggaaccaacgcatcaagtctctttggaggactggaacaaagtcattgccattaatcaaaccggcgtctttttaggagcgcgggccgcactgaactattttcttgaacaccatcaggcaggcaacattattaatatcacctcggtgcatgaacaaattccgtggccaaccttcgcgagttatgcggcggccaaaggtgcagtcaaactttttacccagacgattgcgatggaatatgctaagcaagggatccgggtcaatgcgattggccctggtgcgattgaaacgccgattaacgccgagaaatttgctgataaggcgcagtatgaccagacagtttcaatggtaccgatgaatcgaattggcaaacctgaagatgtgtcagctggtgcagcatggctggcatccagcgaatccagttatgtgactggcattaccttattcattgatggcgggatgactttatatccggcatttaaagatggtcaaggttgaggcgtgattcatgcacgagccttgcttgtttgccaactgaataaagcaaccaaaaagccgtcatcttgctctaagcagcaaggtgacggctttttggtttttaaaggttaaaattctcgccttttatatagataggtactcagccaccaagaaaacgcaaaggcgacgatcaaaagtatggagaacgccgtgagccagggccgcaagactgctaagtcaaggtctaagccagcctcaataaaaacggcgagtaacacaatgccaatcggtaaataagcagctaacggggcacgttggaagccaagcccaatcattaacggaaacgacaatgtcatttgtaataagacaaggccggttgcgaaaaataacatccagataatggcatggtagtcatgtatcgggttgaaacgagcgatcatgccgactgcaacgatgaattcggcataaagatcaatcatcagcatgacgagcaaaccaaataggtagtgactggcgacaatctctcggcggcggataggcagcatcgtgtacaactgttccaagccatgtcgatcaacactggcaaacggcatcatcaagataccaacgctagtaccggtgatagcgccagcaagtggtgtggcggcatcaccattcaagaaggcaatgagcacgatcagaaaagcaaccagatatgaccaccaacggtatttatgcgtgcctgagtaaagcgcacccatgtctaaggcgacaagtttggcaacattacgcatggggatgccttcctttaccaaacgcgatcatcaatgtttctaaatcgacaggttcctgaatcatgttgtcgggcaacattgctgcttggtcagctggccatacaccggagaaaccgaccggactttcctgcaaaccaattaaggtggctttgattgcagcagtcaaatcgttcggtccgcctttaatcaacagatagcggtcaaggagatcgctgagtggaccagtgaacgtgattttaccagccaacagataagtgacataatccgccactttagcgagctccatgatgctgtgtgtcgaaataagaacgctgtgttgctcatcgcgaataaaatcttgcagaatggcaatcaactcatcacgcgcaatcggatctaagccagaagtgggctcatctaggatcaagagcttaggatgatgtgccaaagcggccgctaactgtaacttgattttagtgcccatcgacaaatcgtgatacctaggcttggttggaatatcaaagtcacgcagcagttgctggaaataagccgtgtcccaattagagaaaaacggtccaacataacgattgacagcttctgctggccatgagtcaggataaaccgcgccatctaaaacaatcccaagttgatcgcgaatcgcttcgcgggcttgtggcgtagtttgaccaagtaccgaaatgttacctgagtctggtttgatcatatccaaaatggctttgattgtggtcgttttgcctgcaccattgggaccaatgaagcccatgatgtagccagcgggtaaactaaaactgacattagcaagttgataatcggcatagcgtttggtcaagttcgtaacggttagcagatcagttgtcattgtcagtgtctccctccgtatgcatcaatgtatccaacatcgtgtgtagttcttcaggtgcaatgcgcgccattttggcagtatcgatggcttgattcagataggtctcaatttcacgcaaagcgttttccttcacaagtgcactgtcttgacccaaaacataggcgcctttgccttgcacattcgtgatgaatccggctgcttcgagttcgtgataagcgcgggtggtggtgatcacactgatccgtaaatcttttgccagactgcgaattgatggcagttgttcattcacctttaattgaccagaaagaattgcagtcttgatctggtcttcaatttgctcataaatcggtttgccggattgattcgaaataacgatctgcatggttaacctcgtttcatgatttaacaggtttaggtttgcgggcggcgcgttgtagttgccatgagcgtttgaaagctttcaacatgccgccatctgaatagcttaacacattggtctggtaaaatttgacggtgagccaagtgaataagattaggaaaacgagattgatgcctaatgctgaccacccggcaacagcagtgacctgtcctgcgcctaggcgaaccggcatcatcatggtcgataggaaagggatgtagctggcgatgttaaggatcggtgaggttccgccagcaacaatcaaagcgccgaaatagcctagcattcccagcataacgattggggtcgtggcttggccgatttgttcttgattagcaaccaatgagccagttaaagcagctaaaacggtgtaagtgagcgtgccgacaaaaaagaaagcgagactgaaaagcagcatatttaagctgataccgctgagatcaatgttcgtcatcaaactggatagcggatttttcggtaaacgttgcagtaagagaccaccggcaagcgtcacaacgccgtagatcgccatttggacggccatcaaggctaaaatacccagcagtttaccaaaaaactgtgcttgcggcgtgatggcagtgaggatggattcctcaatgcgggagcctttttcagtgccgatttcttgtgccatcatggaagcgtagctaatgacaaaggtatatatcagcatgccgagaataaacccgaccatggcgcctgatttttgagtcttggcagaccggctgacaagttttcctttatcaacggaaacactggtggtggccagctggggtgtcgcgaaaagactttgcaattgcgtggtcgataatttcaactgagccgcaacttctttagtatgtgcctgtgctaaggcgctttgcagctgggtttggttgataccattgccatcagttcgttcaatgaggctggcatgggtggttggttgcgtactgatggtcaagacaccatcaagatcttcatcagccatcgcgcgcttggccgctgccgttgacgaatagctgatgtagcgttgatcatcatcactgcttgctttcagcgtgctggtcaatgccgggctggacgtcacgacaccgattttgctagtttgattagtttgattcatcagccaaaaaaccccgccgaaaacagcggccagcaccaacggaccgatcacgatccacaaccaggttttacttttaagattcttgaagaagacttggcggaaaatcacatccatttttttcatgactaggcctcaactttcattcggaagatttcatctaaggaaggtgcttgctgactgaattcaggaatataaccttgttgagtggctgctgtgaaaatatcatgaccggcttgaggctcagccaatttaacgagaaaccctcgggagcgttgggcgacaccgaccacgccggggaaggatagcaattgttcttgggtgagaggagattgaatgtagaggcgagtttggccgaattgatcgcgaatatcattgagagcacctgataaaacgacttcgccatttttcaacatcaccaatttatcggaaatggcctcaacattgcccatgtcgtggctagaataaataatggcacttccagcatcccgcaatcgccgaataccagcttcaagcaagccagcattcaccggatctaagcctgaaaagggctcatctaaaatgatgaactgcgggttgtgaatcatggccgcaatgagttgaactttttgctgattacctttagagagatccttgaccaaatcggttggcttacctttgacctgaaattgatctagccattgatccagaacagccatcaccgcagcgcgtttcatgccatgtaattctccgaaaaaacaaatctgatcaacaacggtcattttgggataaagaccacgttcttcggggagataaccaatcgtctcacggctgagcaaagatagcggttgatcgttccaagtcatattaccgtgatcagcttgaagtaaattgagtagcatgcgaaaagtggtcgttttaccagcgccgttttgaccgatcaagctaagaatttcaccgggttggatcgtgaaggaaacatcgtgaacagcagttgctgaaccaaatcgtttcgttaagcctgtgacagtgagcatggcgaacatctcctttgatgtgtctatactgtatatgtgatatatactcagtatatacagtggatgaagaaaaggcaagtagttgaacatggttatttttggacaaaaaaacgatcgacaacattgccgatcctttgctgctggtgccagcagaactgactataaaattttattttcgacgggtctggctcaggctcgatcataaggtgttcgccagcccagaaaccgggctagcgaacgcctaccactattccgcttgcgccactgcttggcttaaggacataacgtcgcggacgatcatcaattcttcatttgtggggatgaccagtgttttgacctttgaatcagctgcagtaatgtcacctgcgttatcgtggatttgagtgtttaagctcgcatcaatccgcgcgccgagataatctaaagattgcatgacgcgtgcccgaatgtcactgctgtgttcgccgatgccagctgtgaagactaggacatcgacaccgtccatcaaggcggcataagcaccgacatatttaacaatgcggttcacaaagatatcaagcgccagtttggctcgcgggttagtcggcgcagcggcttcaaggtcgcgaacgtcatgactaatgccggagatcccgcgtaggcctgactctgtgtttaagatatcaatcatttgatcgacatcggtgatggcaagtttcttcatgagatagccgatgagtgacacatcaacatcgcctgaacgcgtgcccatcgtgacaccggacaaaggggtaaagcccattgatgtgtcaaccgattgcccgttttggatggccgtgatgcttgaacctgccccaagatgcatcacaatcattcgcatttgtgccaatggtttgcgaagcattttggcagcgtgagcactcacatagcgaacgctggttccatgcgcaccgtatttacggacaccatacttttgataatactcatacggaatactgtaaagataattgactggtttcatggtttgatgaaatgcggtatcaaatactgcgacttcaagtgcccaaggcatcattttgcgaaagatggcgatacagtcggcttcaaccggattgtggagcggagcataatcacgcagagcacgaatctgcgccagaacacgatcatcaatgacaattggggcggaaaataattccccgccagctaccacgcgatggccaataccggtaatttcatccaaattttgaacgagtccgagtgtttgcaggttagagagcaagttggcaacagcgtcacgataattgcaaattggggtagcgctttcgtaagcttgatcagtaccatacttgatcttgacggttgattgtttcaggatgtcagtcgcgccttctgcaagctgacgctcacttggcatctcgaacagcttccatttgagtgaggagctgccagcgttgatggagagaacttttgccatgtttgatcactctttcacttttgctttacatacatcataccactgaaaaagcccaatgtttgtgaaaacgtcgggctgaaatattacaatttcaatttttaaaaagttggtatgatgcagaattcggatgtaacaagtgtgtcgggctatttaatacttaatttttcgttaggaagatcacaaagaaagccgactgagtctagatatgctggttctattgttagccgaactttatccgtcggtacttatttttctgtcaaaaaggataggcatatatgaagtccagacgatcaatgatctcgttgcaataattgctgagtgagcttgcgtagttcttgcttaatgcgcgcatcaggcaatggcgcgagggcgttgatagccttatcagtgtagcgagtggcgagttgacgggcttggggcaagccgtgttcactcacaattgccgcaattcggtcgctgttggcagcgatttttgctgcggtcccgaccattggggcgagttgttcggggacgttttgataggcataaattaatggaagtgtgacaatgccgttatgtaaatcttcgagcaccggtttattcagcgtagcagttgtttgggtgtaatccaacaagtcatcaatcatctgaaaggccatgcctagttggcggccaaaacgatacgcggcttttttttcggtaaagtctagttgaccgattgtcgcaccagtgtaagttgccaaagcaaaaagtgctgccgttttgccggctatggctttcaagtattcggaaacacttggaatgagtggcgcgctgggaccattttggtcaacttctcccataaagatgtgcttcatgacgcgcgcattggtcgctaaatcggttgttgctggattttgttcgcttaataattgaaaatagatggcaaagaggaaatcgccagcatagattgcctcacgattgcctgatttagctgagacggtatcggaaccgcggcgcaggtcggcgtggtcaagtacatcatcgtgaaccaaggtcgcgagatgtaaggcctcaatcgcagcgccggcggttatgagatcgtcgttgtcagggttgcctaaacgcgctagcataagcattagcccgctgcgcagcattttgccgccagcgttgatctgttgctggatcaatgcgtggacttgcggctcacgcaaaacagcgacgtgttcaagccgttgctgaatctgttcgagttgttgatagaccatggggaatcggtgccacagtggatgaatcatgcattttctctctttcctatagacatattcactctactgtatgtgattcttaaaagtcaattgttggaggttgtcatgtctttatctgtttttcttgagttggttgagatcaaggccaaaacggcttcagtttttccgtttttattaggtacattgtttgcctggtatcattatcatacgttacatatcgctgaattactggttttcttcgtggccatgttgctgtttaacatggcggttgacgcgaacgataattatcaagattacaaacgatcagagcgcacagaagcgttgcgttttcgcgagaagactaacattattggggtgcatcatctcaacccgagtatgattgggtggatggttgtcggtatgatggtaaccagcggtgtgttgggcctctggatggtgagccgcacggggtggcccttgctggtgatggggttgtttagctttgcagtcggctatggttatgctggcggtccgcgaccaatttcggccacgccgtatggggaatttttctcaggatttacgatgggtttcgtgattttcctaattgccgtttatgtcaacgtctttaatgttgccgccttctcatggccgttgatcggatcggtttatcttgccagcggattggcacagtgtacgattgcggccttgttgctggccaataatattgccgatcaagaagaggatgaaacgctcaagcgccgaacgattgtgcattatctcgggcgttttcgcagcatcatcttcttctatggattatatacagttgggtttttgatgctgattgctgctgttgcgctggggttactgccgaaattaaccttgttgacactgatcaccgtacccatggtggtgaagaacgcacgtggttttgcagccaatccggttaaaaaactgacttttccgaatgccatcaagaatctttttatcacgacgttggcccaggttgtctttctcgcattaggcgtcttcttgaatatctgacccgaatatcacgatggaggttttcatgagcattgcaattcgaccatttgtcaaaaaagatctgaccagatttgtttctgcaatctcgccattgctgtcgccttcagccgtaaactttgcgttgatcacggatacccacgataaggcaaaatttgccaccacttattatggacctactggttactggcatgtacgcgaacagcaatggttaagtggccaattaccactggcactccgggttcatcttggcgacttggtggatgggtccgaggcaccatggctgactcgactgcgattacggaacatcatggctgattatcaaagcggtcctgtcccgtttcttgtgacaaaaggcaatcatgacgataatgacaagtttgccgaaaagcgtgcagggcatcgcggcagttttttgccagaagtgaaccagacgctgatttttaaaccaaatgctgagcagacaggggtggctgtttcgcaagaagggctaatggttcaagactttcctaacttgcggatcattgttttgaatacggcagatgtccctttgattgatggtcacaaggcttttgatgtcaagaaaacacttgcggtctcattcgctcagctacggaattttgcattggcattaaaaggtgctggtaagcgagatgtcttgttgttgagccatgccccggctttgaaggaaaatggccagccggcactgaaatttaatggccgcgctgtccatgagttattgcgagcatttaacttccacgcgagcggggtgttgcatacgggcgaggcaccagcgtttggtggtcgtctgcggtttgactttaggcagtcaagcggccgagtggttggttatttagctgggcactatcatttagaggcagattacattgttaatggcattcattacagcctgcagaatacaagcgcgttgatgggccgtcatcacggtctaacaaccaagttcaatcgccggtatgatcgacgttttggtttgccgagcgaatatgccggttatgtggtgagtgtggatacacaacagcggctgcttagcttgtatggctacggtgctgcgagccgtgttcggcgttttcagtattgatcgcggatggtacgatttttttaaataaattacgtgattagcttgcaaagttagcgcttacatgatacactttaattgaagttaaggaagaaccaaaaaggccgatgcaggaaccgagcattacgatccttgtctagcattaccaagacgaaccagctcgaaagtgatgtgtgtgtcgcaaagcacgaatagacaaatagagcgttggtgcagtaagtatctgcgccaccagtcgtacgattcatgttccaactgaccaaagatgaacacacatggaggtacgaggctaataaaaagactcagtaatccaagcggggcaatgagcttcccatagatgttcaatagggtgtgtcaataggaccaccaaacaacgcctagttatagggcaacatcatttcaacactcgtcgttccgtacaagtgaataagtattttttagaaggtgtcgcagtattaaggttatcgaagaaggttttacaattagtaccaagaaaagttttgagattattgcatcggtcaaatccttaacttaggagatccaagttcacctgtaggaacttggatctctgtttttttgcgttttttgggatgtaaagtgcctcaaaaatcgtacacttactttgcaagaaaatcctgaagtcattcatttctggtcccgtcaaccttcccaaacgcaatcggctcaaatgaaggtgactgaaacaaccaaggtgctgctaatcaaagtcaacaataataataccgatttagcttacaaccatattcaaaaaaatcttagatgccttgttaaaggcgatgttcttcaggtgccaattgatcttaagcgccttatccagtgactaagtatcttgcccagatctaatccataagataggctatgcaaagcattgttaataggattaaccttcggggctaaagcaatgactcatctgccatacattctggggttaaaaatacgaaccagtttgtctaaaatgacagtaggtaacaatttaccgacttgctaagagttagaaaagatagcgtcaaaatgaagattcatacaacgtattttggggctgtgttggtagtaacgcccccgaatgaattcaaagtctcgtaaacaaaaattgttgcgttatttttttcttgtaaaaaaaagattgattgcaatgaacatgtccttctgagggaaaaatgcaagagatgctattactaatatcaataatagcattgctctcatggatgagctaattgcaaacaaagcattgactagtaatgtaattgttggtactaagatgattatcaccattatagaatccgcttttatttttctcatttgtgctcctcatttcgaactttaaggggaatttgtttgaaaatcaatttttttaaatggatcagagatgtccgccattggaaaacaatatacttgtttatgatgatatcgatagtgacgtatagtatgattggcttgtgccgacggttatcagtatctagtattcagaaagtattacaattgctaacaggccagaaaatttttgctttattgttcttaggttgcttagcagtcacaccaatgattgtgtatgacaaagtttacgcggacaaactttccgtaccttctcggggcggtttcttcaacatgactagctggtcattaaatgtcgtaaataatgttgccggtgcaggaggtatggtaggggcttctctcagatatgcgcttttggggcaacatgtcaatgctcgtactgcaactaaaatgtcatttcacatctcacttttttcgttatcaggcctttcgattaattacagcatatccgcattactgattaagaataacaatgtatcaattttagcaggttcgctttcatatatttcttttttgattatagtctatccactcataccattaatgctgaaaacaccatccttaaaatttcccacaaaattgatcttgctaatgacatcggtcatcgaatggtttgcatgctttggtatagtgctattatcaaatgctattttaaatttaaatattgatttatttgttttatatcagagctatttcttctctgctgcactcggtgtggcatcgttgattcctggaagtgccggttcttttgacctaagcctgactgaaacgttaaaacatgcaggcgtactgcctaacacctctgcaagcctgttaattttgtaccggttattctattatgtaattcctaccattcttgctgttgtttggtttattttattaaaaaccaatatcttgcaatctaaagccaacaaatgataacggtttctagtcagcatagtagctgttagaacgcgtttagaatattattaaaagtatccgaataacggctgaaattagctgtatagcagtggcttgtgactagctttcgcaaatacatcacagatcacagcctttacttatccgtctataaattcgttcaactttccgatgttgaagtgtgaaaataccgctttttaaagaatttgttttgcaataatgatagctgcactaatgggataagtatacatttgttcactagaagcattgctactgtattggcaggtgagtgtcttcaacccctagattgcaataataaagttaccacgtagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccctatctgagatcgttcaattaaggttataatggccatgggacctgtccttctctctagatggtatgttatgcaaacatcattttagcaagaacggacaggtcttttttcacattttctgggtggtaactttaattatgcaatctagggactatctgcaggttgaattgctcaggttgatggtgatgaaccgacacaccagtgcagccattttaatgaagatcaccacatctggcgaaaatataagcatgaataaggtcgctagttttcggattcgattgttttaagtcgtttcatcaacttgacatatgtgcgtttcatttctggtcggtgcgtcctcctttcttataaaaaatcccagtccaagtgttggtcactagcttaaactgcattcaatatagtcggcgataacggacagtcacaagataacaactttattttaccgattatttcaataaacaaagcgttggaagcttgtgatggacgcatcatgaaaggagctagggcttgttatctggttgcgaatactcgataatatgaaaagaaaaatagtttcgtcactttaaaatatggcgaagaaaccaaaaaaaagctgcgacgatctcacaaagtagaaaaatctttccaattcatgagaccgttagtctgaaaggagctgctgatgctgaaaggatcgcgagtcgctgtccggccatttgaattgactgacgttgaggattatttcgcctatgcacatttaaaacaagccacattaccagctggcatgacccccttaaagtcacaagcagccgccttagaacacattcgacgatttgcccgtgaaaagcaggatttggcattggtgtatcggcagcatgttgtcggcaacatcggcgtctatccgcgtgatttatcgcctttgaccggggatgatatgacgcgggaaatcggctatatcctgcatccccatttttggcatcgtggtttcatgaccgaaggcttgcgactggtgatcgatgatcaatttcataacggcattcaagccgtctgggcaggtgtctttccagaaaatatcgcttctatcaacttgttacagcgtctcggctttgattttcagttcgaagtgccgctccctcgtgggttgacacctgatcaaccgcgcaatgagcgatactaccgattactccccaatcagtttgaaaaatgagaaattactatagctattttatgaaagccgggtgaattcatcccggtttttctcttttagataggcatcggtttgaaaaatgttataatgaaaacgagtaatagtctggaggtttcaagatgactgtgcaaacagagtatcagcaagcgtataacaagcggcttgcagcgatcgaggcagatccacggctaaccgtgctgtctagcatgaatcaaccgcaggacgcagcccaaaaaaaggtaagccaatatattgtgtttactgattttaaattcgatgagcaaaagcaaaaaacaaattcaatttacgtttatacgccttttgaaaatgttgataaatatggccattccaaagcggattatcagtcacaacttttgtttgaaaccaatcgttgggataacggcatgcacatcactgtcttggagacccttgggtcggagagccggctcgctttctacgattttgaaaatatgggcttggcccagcttgctttgaaagctttcattaatttggcaacgaaagctgacattgcccaagtcgacggtacgattagttcgtttgacaaggttaatttgacaaagctgcggcatattttcactaaatttggttttacaattaaactgactgatccgcagactggtattggcaaaatcagtcgtaagatgcaatgatctgtttatccagcttatgcagtgtatttaatgaacatcgtcttttagaggcggtgttttttttaactaatgtgttgcggctcagcgaagactaggcaaactattgggtcgtgatcaacttttgtggcatgatggcgttagcaaaccattcgtaagaaaagtacgccgcattgtcaatggaatgaaacagatttatggaaataatgtaacagcaatttgctgtttaattgctgtttttcaataaaaatagggttgaatcgaaacacaataagcgtaatatgaaacacatcaatcaggaggaagtggcaaaatggcagaagagaagcgctatggcgcggatttgatcgtcgaaagtttaacgaatcacggcattgactatgtttttgggattcctggagccaaaattgatcgggtttttgaaagtctggagcatcctaaatcagaaaagagtccgcagctaatcgttgcgcgacatgaacaaaatgcggcgtttatggccgctggcatcggtcgtttgaccggcaaaccaggggttgttctgacaacttcaggaccgggagcatcaaacttggcaaccggcttggtaaccgcaacggctgaaggtgatccggttttggctttatccggtcaggtcaaacgcgctgatttgctgcgaagttctcatcaaagcatgcgtaacgccgatctttttgccccgatcaccaaatatgcggctgaagttcaggaccccgataacgtgagtgaaataattgcgaacgcgtatcaagcggctgaatctggcaagcaaggcgcaagttttgtttctattccgcaagatgtcacagattcgccagtcaactcggaaccgataaaaccactggtcgcaccaaaacttggaccggctagtcccagtgatatgacgtatctggcgcacgccatcaaggaagcgtcattgccagtgttgttgttaggaatgcgggcatcgtcaagtgatgtaacagcagagattcgcgaattactttcagtaacggaactacctgttgtggaaactttccaaggtgctggcatcatttctcaccgtcagattgacaacttcttcggccgggttggcctgttccgcaatcaaccaggtgacatgttgttacaacatagtgatttggtcattgctattgggtacgatcccgttgaatatgaaccacgtaactggaatgcggatggcaaggcgcgcatcattgttattgatgatgttccagctgagattgatcataacttccagccggaaactgaactcattggtgatatttcgcaaacgttagatattttggtgccattgttacgtggctatcaagttgcacctggcagcaagcgctatttagaagaccttcaggcaaaactgcaggatagcgatgtaccaccggcaattgctgatcaaaaagtgcttcatccgctcagcattgttgccgccttacaggagcgggtcacggatgaaatgaccgttgctgttgacgttgggagtcattatatatggatggctcggcacttcagaagttatgaaccgcggcatttgctgttttccaatgggatgcaaacgctcggtgtcgccttaccatgggcgattgctgcaacgttggttcgcccaggaaaaaaggcggtctcagtttctggtgatggcggctttctcttttccggacaggaattagaaacagcagtgcgcttgcatgcagacttagtgcatattatttggaatgatggccattatgatatggtaaaatttcaagaggaaatgaagtacggtcgtgcagctggcgttgactttggtccggttgactttgtgaagtatgcagaagcatttggagcaaagggactgcgggtcaataaaccaagtgaattagggcaggttttggatgaggcgtttgctacactaggcccagttttagttgatattccagttgattattctgataatgcggagcttggcgcggcgatgcttcctgaccaaatttactaagcttttgttcattcgtcagcattgcgcttggcgatcgcgtaataggaggagaccatctgtgaatactgatcggttatatcaacatggcacattggcaatgcttgtacccggattgtttgctggtacgcaaaagattgaagaactgctgcagcatggcaatactggtattggcactttgacggggctagatggcgaacttgtgatcattgatagcaaagtttatcaagtcaatgcacaaggcgctgttcgcgaagtcgggtcagaagaagaagtaccgtttgcaaacgtgcattatcaagctgataaatctgtaggcaaactacaaggacttgatttgtcaggctttcaaaaaacggttttggaacgccttcaaacggccaatctttttgctgcagtacgcgttgaggggcggtttacgcagatgcatacacgcgcggtgttgccacaacagccaccgtatccaacgcttactgaaacagcttcaggtcaaaaagaattcaacgctgagaatatcaagggtacattgattgggtattattcgcctggtctctatgcgggtgcggtgtcaccggggttccacttgcattttcttgacgctgatcatcacatgggtggccatattcttggcttcgaactcgacagtggcgaattgtttctgcaaaagtttagtgacttccagctacatctgccgacaaccaacgatgcttttttaaagcaaaaatttgacacggcaacactggtagccgatattcgcaaggctgagaattgagttaaagccttgtgagaggcagttgctgttgaaggccgaacatgttaacgtgtaaaccaataacgattagaggttgcatctgtcatgaatcttaaccgcaatggcctgaacgccagatgcgcggttgcaaaaggggtggatgccgaaatgccggatttgttcagaaatccgacattgggccagttggacaacatccgctggactgtcgcgaacatcgcggggcgctaatgaatcggatcacgtttagtcattgcaagaaaaatgataagctgatgggttgattctcgcccgttggctttttttgtgagcgcgagcaggagcgcttagaaaccggaacataagtggccttgaacctaaatggccgggctttggccatttaggctcaaggtccttatgtgtaggtttctgcgactgcgagcgcgttatagaaagctagcacagtatcagttacggccgccagtcgaaagatgccttaaatctaaacgggcggccgggttttgaccattgcgtccaaggtccttatgtgtaggtttctgggctggttcgcgcgttatagaaagctacccaagagccgattatgagccactcagtcgaaaaatgctgtgagaatctaaacgggccagccgttagggccgacgtccttatgtgtaggtttctgcgactgcgagcgcgttatagaaagctagcacagtatcagttacggccgccagtcgaaagatgccttaaatctaaacgggcggccgggttttgaccattgcgtccaaggtccttatgtgtaggtttctgggctggttcgcgcgttatagaaagctacccaagagccgattatgagccactcagtcgaaaaatgctgtgagaatctaaacgggccagccgttagggccgacgtccttatgtgtaggtttctgcgactgcgagcgcgttatagaaagctagcacagtatcagttacggccgccagtcgaaagatgccttaaatctaaacgggcggccgggttttgaccattgcgtccaaggtccttatgcgcaggtttctgggctggttcgtgcgttatagaaagctaacctcactccccgagcctcgcattctcaacctatcaaaaacttcaaaggagcaaactattggcacagtcagaatcaaatcaagtcaaacgtgaactcaaaactcgccatctctccatgattgccttaggcggcagcattggcactggtctctttgttgccagtgggagtgcgattgccaccgctggaccaggcggggccattgctgcgtatgtcggcatcgggttgatggtctttttcctaatgaccagtcttggtgaaatggctacctatgttcccgtttcggggtcgttctccgagtatgctagccgatttgttgatccggcatttgggttcgcacttggttggaattattggtttaattgggcaatcacggtggccgttgatgtgtccaccaccgcaatcgtgatgcatttttggctgccaaatgtgcctggatggctgatttcaatggggttcttagcgttgatttttgtcatcagcattatttctgttaagtcctttggtgaaactgagtattggctttcattagtcaaaattgtcacagtgctggtctttctcgttgttggtctattgaccatcgttgggatcatgggcggcaatggcccgattggtttgaaaaattacacaaccggagcggcgccatttgttggtgggttgccagctaccctagccgttttcgtcgttgctggtttttcttttcaagggactgaactgattggcattaccgcgggagaaagtgccacgccggaaacgagtattcctaaagcgattaaacaggtgttttggcgaattttgctcttttatattttatctattgcgatcattgctgccatcattccctataccagcccgaatttattaggtgcgagtgtcgatcaagttgcgatttcgccattcactttggtatttgatcgcattgggttagcaggagcggccagtgtcatgaacgcggtcatcttgacatcggttttgtcctcggctaactcagggatgtatgcctcgacccgcatgttgtgggcaatgggtggttccggttttgcgccgcgcgttttccagaaaacgaataaccgggggattccagttgcggcactgctgttaacaaccttggttggtgctttcacctttttaaccagcattatgggaccgcatgtctatcaactactggttgcagcttctggtttgactggatttcttgcatggttaggcattgctgtctcacattttcgctttcggcgcgctttcgtgaagcaaggacacgatctgagtgaactcaagtatcatgcaaaatggtttccggttggcccaattctggcgattattatgagtctcattgtcatcgttggtcaggatttgcaggcagttcaaaatttttcctggggtcgattactggtttcctacatgtcaatcccgctttttattgtcttattcgtctggtacaaagtgaagcatcggacaaaaatgattccgttagaccaagttgatctgtccgctcaccgagatcaccgaaattaacgatgcaaaaaggcagtttccacacattgaactgagtgggaactgcctttttaggtgatgctatcaccacttgaaagtaccagtttctgatgagcgtgctgaagctgttttgccgagataaaggcggcgaatcaacatataaagttggaaaatagcactgtcgtcatcatcaataatccaagtggcaacctcgcctttgaaatccgatggtgctgctgctctaatggcggcttcattgtcgacactggtaatcaccaggtcagcttcctgacaaggcgcatcatctggcaacaaatcaacgacactaagatcgtccagaaagtttaccaaacggcgattgaggagatcatgtcctaggtaaaccagcttcacttgcacaactggtgtttctgagaagtatcgcaaataaggagccaaaagataatgaataatgcgcaaaaatcctgcatttttaccaagaaaacgacggtaggcaggggtgtctggcaaaccagcgatgaacgtttgcaaggtatggtacagcttagcctctgtgtatggcagcccttcaggttgatagtaatccacgatgtgcatgaaatcgccgcccagaaactcattgttcaacgcgatccgagctagattcagaactagctcgtgttcgtgataaacatcgaaatcactgtcaggtcgaacatgagcattcaaaaaagccaagagtcgcttagtgaaatctgtcgtcacggtttttttgtcacttaggtagcggataaaagcatcactcgtggcgtcagttggtaaaaatgtaatggtgcgattttgctgaaagtagaagaagtcgttttcgcttttcataaaccgtgtgtcgtaagcaggaaacatttctttcgtgtaaaccggatattgaaaaggtgaatactcatcgaaaattttgtcaaatggcgccgcgccgtcaacgaaatggttgccacttatgcgcacgcggctgatggcccaaaacaatacttcttcaagaatatcgaccggattctttttggcactgggtaaggcggtgtattcctgaacaattttttgttcatctaaaactttgaatggccaatcgacgccgtggtagccaatccaatagaaggcgaacaagaacaatctgatgcggctttcctgaccggcaaagcctaagtcgctaaaggacaacttaagctgataccgtttaagaagattacggagagcagacgtcttgcgaaccaacgtggaacggctgatataatgggcacgacagaacttgtctgtggacgggtgattagcttgcacaatgtaatcgacaaattggaaggcgatagcgtgctgcaacaaatacagatgataatcgtccactgtaatatcgatatcgaccagaagactgatttgtttccgtttcattttttctggatgttttgttaaaactgtcaagtcgcggaaaagttcctgcaagatgttatacccttgctgataggaaaggtctaggtgctgactgagggtattgatcgtgtatgtttgcacattggtatctttgatcgctgcgaacatttggaacttctgcagatcagcgcgatctaaaaaagtttgttcatacagcatggtacacccccttatctaaaagcaattcacccctacctacgtcaattataacaaaaaaagtaaaaatgatgacagtttgttagtgaaacattgaactttagggaaacccgctattttctaaagccgagtaaatgaacaataacaatttggtatagtttttagacccgacttgtacttgtaacaggggtgaatgcctgcgtcttgacaaagtatgacgtataataaaagacacaaaatcgtattttaggggtggggagtccatggaagccaatcacgacatctttttgtcgatgtccgatgctgaaaagctcaatttgtttcacgccattatctcggcacgaattgcgcagacgccggtgagaacgcagttggctggtgatcacgcacattattcggttgtcggcgatgtgaatttaaaacaaattgcggcgattactaatcgtaactatgggagtgtctataatacctacactgggttggttaactctctggaggagatactgggtcgcaagcatgcgtccactaaaatgttgtttgccattccaattgatgaatttcgctatgatctggtgaaaaagtcgaacccatatcgttttttggacgcagttttatataagcgctatcaaaactttgatgactttttaatggcgtccgatagttccaaagccaccattttgcgacatctgaaacctattcgtggttacgccaaaaccagtggggttcaattttcatatgagacattgtcgtttattgggtcagaattaaatatccgaatttttttggggttaacatattggttagcaacgaacggggcggattggccatttgaaaatatgacgcatgagcgtgccagcgaaattcttgatgccgttcttaaagcctttaaaggcggcgatgtgaatgtcgttacacgtgaattgttgctctattacattgcggtggcacatcaacgcattttgacagggcaggtgttgacgcatgatccggattcacagattttacggtatccaatgccaaatctgttttcaccaattgctgaagcgctgactgacggacatccagttttagatggcttatctgagcagcagcaacaaggggaaagcgatgcgctctattttctgtttaattttgcgccgctgtatattgtcagtgatggcccgcttgagcgacgtgtgatcgaacggtacaaccgctataatcccgaaatttatcagttgattcaagccttctttgcgtgttttccatataactttaagctacatctgcagttgccagaagagacgtataatctgttgttagccaatatgctgagtgtcaccgtcagcgtgctggtgttcaaaaaagacttcacaacaactttactcgctgagttcagttccaacatgcagcagaccaaagatgatccggctttctatgctcagatcaaagccacgcttgaaaaagtagtggatgaagaacatctcgaatcgtttgacgggtacattgatgttttggccgaagcgctgtatcgcaacttgcaccaactactcatccaatttcagccgccaaagaaaattgtggttgcgccagttgttgaacaaacgattaccggctatattgacttgctagcgtttttgcacgctatcccatttgtcgaattagcgtcgcccaatgctaatctgaaagatgccgatttggtcatcacgacttcggttgcgccagtcaaaaaagtagccggcaaggcacagatattcccatggcatatcaatgttagcaatgaccactacggccaactgtatgccttactccgtgaactttgggataaaaaggttttagaagatgcccggttcatttattaaaagacaaatagctgcttgcatttgggccaagaggactggctcccattatttttgaataaaaacactataggcgcttgttaatcagtgctaaatgcggtaattttaagaatgaatagcaaacacgtctgaagcgtctattggatgatcaagagagacagcggttggtgaaagctgtcagccatccatattccagcgccttagtgggtagtgatgaactgcacggccactgaccgttatcagttattgagggtggcgcataggcgtcaaacttgggtggcaccgcggaatggcctttcgtcccaacgagatggaaggctttttgtgtgcactgaaatttcagacgcatcatgaccatatgaggaggacaaaccatgttagatttaaaactgatccggcaaaaaccggaatgggccaaggaaaagttagctgcacgtgcgattaaaggtgaagagattgatgaattattagctttggatacgcgccggcgtcaggtgaccgttcaaactgaagagcttaaagccaagcgcaatgatgtttcaggccaaattgcggttatgaaacgtaacaaggaaaatgctgacgatcaaatcaaggccatgcgggaagtaggccaaaagattgcggctttagacaaagaactcgcccagctgaatgaaaaagtaacctacattctcgtccgattgccaaactttccggctgatgacgtgccaatgtcgttaaatgaagacgattcccgtgaagaatacaaatggggaaacatgccaacgtttgattttgaaccaaagcatcactgggatattggtgaaaaattaggcattctggattttgaacgcgcggcgaaggttgccggtagcagatttgtttactataagggtgctggtgcacgtcttgaacgcgccgtctataacttcttcttggatgagcaccaaaaagaagggtatgaagaaatcattcccccatgcctcgttaacaatgattctatgttcggtactggtcaatttccaaagttcactgatgcgacctatacgatcacgaatgatggtgaaccactgactctgattccaacagcagaagtgcctttggtcaactattatcggaatgacattattgatgctgaaaaacttccagttaatttcaccgcacttacaccggcttttcgttctgaagctggcagtgccggtcgcgatactcgcggcttgatccggatgcatcaatttaataaggtcgaaatggtcaagttctgcaagcctgaagactcttggaaacaacttcaaaacttgattcacgatgccgaagatcttttgcaaaagctcggattgccttatcatgtcatcacgctggcaagtaatgacgctagcttcaccagtgcgaagacgaatgatctggaagtatggatgccagcgcaagatcgctatcgtgagatctcaagctgcagcaattgcactgatttccaagcgcgtcgtgcacaaattcgctatcgtgatgacgatggcaaattgcagtttgtccacacgctcaatggctcagggcttgctgtagggcgaacagtagcttctattttggaaaattatcagcaagctgatggttctgtgaaaattcctgatgtgcttgtaccatacatgcaaggacaaaccgcaatcaccaaggaagattaattgtttcatgcatctttatgcagtgaatcgcaaatgattcactgcttttttaatgcaaacgttcggactttaaattcttagcaaaacctcatttaaaaagtgttgacgcgggttcgtaaagttgataatatattctccgttgtcaaattcataaccgattccgaaattcatatcggttgcatgtttattcaaaaagttgttgacatatttcaacagctagtgataatatatgaaagttgtcttttgacaaggtcgtcctttgaaaactgaacaaagtttcgtttaaatgtgcagggtccttggtacttcggtaccgaggcaaaaagtaacatttgcgaagtcaattcgctagaacaacaaatcgagctattcgaacagctcatatttatatgagagtttgcgctcacatccgagttgaacaacacgattacgctgaaaaacaaaacaccgcacagttatcgctatgttgagaccaatttgccactaagcaaatcgaagaaaaagctaaccagtctggctaaattcaaaaccacgcaagaaacagccaacgcacagtcaagcactgtcagcagtgcaccggtcatcgttagccaaccaagcgagccaccatcatcagcggcgccagcgccttctgttcagccgagtgtggaaagtcaacagagcacggttgataatagcggtagcaatcataatggaaataacaataacggtcaaaacgagtcccaaactgacggcaattcgaacgcatctagtgaacaaccatccccgtcaccagacagcagctcgtcagcttcaaacagtaatcccagttaattgattcccttcaaaaatcttactgacacccgatttttcaggtgtcagtttttatatgatcaatgacatccttgtgatgactttaaaaaacatgccatgactgacatcaatgatgccaaatgatggttccactttgacgccgccaactgcctgcgctaaacttgcaaccatagtgggaaaaatcaagttgatgaccacacccaaatgcgacccactcaatttaacgcacctgccgcgttaccaactttctggaggaccacgatgttcaaccttgctgccgccgacttatccgcgcgtgatcaatataaattgctggctggcagtatgatcccgcggccaatcgcttggattaccacgcaaaacacgactggcctcattaacctagcgcctttttcatttacgaccgggatttcaaaccaactgccactgttgtcagtagcagttttacgtgatcggggtcaggcaaaagataccgctgcaaatctattggcgcgccacgaggccgttgttcacatcgtgagtgcagatctcacgaaggccatgaatcaaacagctgcccgcttagcacctgatcaaagcgagttctcgttgattgacctgccgttagttgcaagtacggacattcaggtgccggggttgcaggcagcgcgtgttcgatttgaaaccaagctttatcaatacgtgccgattcgtaacgctgatggtgacattttgactgatcttttcattttagaagtgcaccgattccattttgccgatacggttcttgatccgacaacgcttcacattgatcccaccgctttggcgccgattgcccgcctcgccgggccgacatacgccgagcttggacgcacctttacactgcggcggccaaaataattttataaaggagtgtcagtatttgaccgcatttatttccagtgtttttggtgttcttgaaattttgattctaatcgcaatcggctattttctgacagcacgcgggtggtttaatgaccattcaagtaaaatcattgccaaagttgtcacccaagttgctttgccagcctacatgattgtcacgatcgcttcaaaattcacggcgccaatgttgctgcgactcttgccagatttgtttttcccagtcctttccatgatgatcctatttgccctatcatttctggtttgctacttattgaaggtgccacatgcacgtaagggtacctttaagtcaatgttttttaactccaacacagtttttatcggcttgcctgtcaacttagccttatttgggccaagtagtctgccatatgtgttggtctactacatggccaacaccaccattttttggaccatcggcgtttaccttattcaaggtgacggcccgcgcccagctaaatttgatttgaaaaaggcacttgggaaagtgttctcaccgccgttgctcggttttatgttagggattgtgcttgtgcttttaaaaatcaaattgccgactttcttgatggccgatctgacttatatcggtgccttaactgttcctggctccatgttcttcattggcatcgctttgcatcaagcaggctggggtaaattaagaatcagcaaagaagctttgggtattttcagtggccgcttcctctttgcaccgttactcatgacggcgcttgtcgccttcgcccctgtcccaactttgatgaaacaaatctttattttgcaatcttgcatgccggtcatgaccaatgcgcctgttgttgccaaactgtacgatgcggattccgattacgctgctatcatggtcaccgaaacaacgctgctttcgatgatcgtgatcccaatcgtgatgacttgcatccagttcattcactaggagttgctgtcgaatgaaaaagcgctatctgctactagcagcaatcttgatcttatcaggctgctcacaaactacctcaacccccaaaaagacaacatcatcatcgagcgcaacatcacaatcgcacacggtcaaaaaaactgttccgaaagcgaccttaggtacattggttggccatgcgttcgtccaaacaaaagatgcgaccaaagcaattcgagtcacctcatccaccagcggctactatcttgaaacattagccaatcgagatggtgtctttgaaagtactgatagtggtatttttgctgctgatttgaccctcaaaggccgaatcttcaccttcactggtaaagcgcagccgcaagcctctgctaatacgatacaatttcaattaacaaaaaccggtaacttaaagcagttgcccgatggtcccgtttataaaaaggtgccacaagacgatctcgatcgcctcgcccaacaaaaccaataaagtgtctgagcaaaaagacatcagccgtgatcctatattttgtgggatcacagctgatgtctcttttgttgatggtacattttaattggatttaagttgccagcctagtcattcacgacttcaaatggttaaactaatgcaggccgatataaactcacaacgatgccaagaatcgttacatccgggaagaacatatcatccatactgtcattttcaggatgtaaccgaatgccgttcttttctttataaaatcgcttgacagtggcttcatcttcctcagtcattgcaacaacaatctgcccactctcggcgtcattctgcttcttgacaataatctggtcaccatctaaaatgccgattttgatcattgaattaccttgaactcgcaacatgaataattcgtcagcggcatacggaagatcgtctggtaccggaaaataatcatcgatattttcgatggccgtaatcgggacccctgcagcaactgtgccgacgatcggaataccgtgatcctgaacgccaatgaagtcacgtccggctgaggtcacttcaagcgtccgcggcttcgctggatccttagcaataagtcccgccgccaacaatttctccaagtacgctgccaccgtgcttgacgaacttagaccgactgatttgccgatttcgcgaaccgtgggcgggtacccatgatcctcgattgcatcatagattgattgtaaaatttgtttccaacgtttctgacttgcttgtgttggcatccgctcaccgcctcagttctaattgattacacaaagcataccaaagcgaacgaacgtttgcaatgattttatgcctaaatagcaaaaaagtccacagataaaaagcatctgtggacctcatccttaaattaattatgcaataatggcatcttatgcatctgacgccgatcacatctgcttttgatgaccgcgtagaagaaactcaagaaaatatcaagcgcgattaacaaaatgccggctgtcgcaaagttgctgaataacagcaaggttgccacgagggtcagagtaattaatgtccattttgcgccccgtaggattgtcatgtggggtcactcctctccgtatcggataaaccgacatatactcaccgttttggttgtgactctaatcatacccaatttttgagttttgtaaagcctttgtatacataaaatttacatttgatgcctttatttagggtttttaaagatttgtaacgattattccatgttgtttgtaaattttatgtaatcttttttaacatcaaatcaatccgcttttaacacggctatcctcgaaatatgaccatgagtcgagtatcattaatggtacagagcgtgaacaggcacgtttagaaatcggagcataagtggcctccaacctaaatggccgggcttgggtcatttaggttggaggttccttatgtgcaggtttctgtgcctgtgaacgcgttttaatgagcgtaaacaggccctgccgcaaatctggctagtcgctctcatcgtttgttattgtcatgaagcttatacatccaacaggtatcacaattgtagaggagggtacccccttgaaacataccgactcgtggctctatcgccgctttcttaatagcaagtttatgatcctgctagttgacttgttactggcattgctcgtgattttcgttttcactaaaattgcgtgggttttccagccagtactggattttctcgggattatcgcgccaccgtttatctttgccggcattctcttctaccttactgtcccgattattaatcgattagaaaaattcggacttcatcgtggctgggcaattggcctgttattcattgtgctgatcggtttgttggcgtggggattgttgcgtttcattccggcagtaagcaatcaaattaccagtattgtccattcagcgccgcaaatctttgatgaaattggcaaatggttggataatctgaatgaccagcagaatattctctcacagcatgatctcaatgagattgcagcagaagtgcaaagtttcttcactggtaaacaaggtgccttcgtaaccggcacaatttctcaactgcagaacttaattggcattgttggtaatgtcgtcatcaccatttcaacagcgccaatcattcttttcttcatgttaaaagacggcgacaaatttacgccgatggtacttcatatcgtgccaactaaacttcgccggtcagtcaagcaaatgttgcatgagatgaatgaaaaggtcggttcttatgtccaaggtcaaatcaccgttgccttatgcgttgcagtgatgttcatggtcggctattcagtgatcggtttacgttatggccttatcttcggcttattggcatgcccactgaatttgatcccatactttggctcagccttggcgatgattccgccgctcatcatgggtgccctaacctccccgcgaatgattttagctgtcatcatcgtctttttcattgaatggctcatcgaaacacaagtcatctcaccgcttgtgatggggagtaaacttgaattacatcccatcaccattgtcgtcgtgttgttaacagcaggtaatctattcggcttagtcggcgttattcttggcattccaggattcgccgtgttgaagatcgtggtcacccgcttcttcagttggtatcaacaggtttccgggctctatgaagccgagcatgccacagatgacacgaagcaaaaaggagttcctcatgaataattttaatgtttttctgatcggccttgacgtcatcctgatggcgcttgccggttactatctttattggcaaagtaaaattcaagttgcttcacgttacgctgtcacccagctgatgtgggcagttttcctaggcttttggtttatgaccactcgggtcaacaatttgccttacattgtcttcatctcaatctttttggttttgtcgatcatggctggtaccggtggattggcgccaacgcgcttaatcgcgaatggtattctggcgcgcgttattccttacgcgaacatgtccagcatcacgttgacgccggttagtttgcctaatggtcaggaatgggttgttgccgttttcgctcttagcaaacggcgcatggttcgcctgactttccaagcaagtcttcaaaactttatgacggaactcacgaaagttttgccaaaaacagtgcctgtgactgtccaacgcatgaactagcggcgcaataacaaatagcgtttgccacaagttgttaccatcagcaagtatcgacaaaaaactccctgaaaattttcagggagttttcatttactttcactaggcttataccctattcatctgactcttttagcaacttactcatcgatttttctaatggccagcaatgcgacaatcgccagagcgacccctgctcctgccaccaacatctgccatggtgccgtggtatctaagaagaaataatcaatcagggtcaacatcaatgccgcaaaaagtagatcgacccagaatcggcgccagcgcgtggtcgctgccgtgtctaaaatcaggacaatgccaatcaatgctgacaaaacaagtccaaaagaaatcgtggcaatcgtgccaatggtatctgttggccgcatcgtataccaggcaaagagcgcaaatcctactgctgccaacagcaagacaatgacaacaccgatcaattcgcacttagtaccaagttttttcactatgcagcctccttaaatgtgatcttcgacttagaaacactgccgcgtcacacgctgtcttcatcatggtaaccggtagtatgacaatcaatggttcataacctgcagattcatcaaccgccaactgtgccaacaccatactgttccttgcaatatcttgcacattttaccaaaaaaaaaccggaacttccaactattcgtggaaaaaggttacaatcacagtaggtctttatttacagaaagggcgatttcgatgacacaaaatcttgcaattggctttacagaagggttgccaatcacggcacccaacagtcttcaacagttcacgctgccaatgccgcagccccagtcaggcgaagtgatcgtggctgttgccggggtctccgtcaatcctgttgatacgaaacgccgacaagttgctggaaagcatcaaacaccgcaaattcaaggctatgatgcagtcgggacgattacacagatcggtgccaatgtcaccggcttcaagcctggtgatcgcgtcatctatgctggaacaacacaccgtcccggcagtaatcagcaatatcaggcagttgatgcccgcttactcgctgccgcgccagctgatgccccagatgccgatcttgctgcgctgccacttgtcggtttaaccgcatgggaattactcttcgaaaaaatgggctttatccccgaattcaacgctaataaaggacaacacttgttagtcatcaacggtgctggcggcgttggctccatgctttgtcaattagctcgttggagcggtttaaccgtcctagcaactagcagtccaaaaaatcatccttggctgcttgatcacggcgttgcaacaccactggattaccatcaggatttgattgcccaagtccaacatgccggcttgcaaacagtcgacggtatcgcgttgctttatcaaccagaaccttacttggcagcagccagtcaactgattcgtgcctttggccacataggctgtattgttggcccacaaactggtttggatttggccgttgttaaagataaggctgccagttttgattatgagtacatgtttgccaaaaccgactttgattatcatgtggcttctcaaggtgctattctgagccgtctagtctcactctatcaggaccatcaaatcaaggcatcagtgaccaagcattttgacaccatctcggttgacacccttaagactgcgaccgctctagttgaaggtggccatgaagtgggcaaggttgttttgactggcccgtttgcttaataccactcacgaccatcaaacaaagctaaactgccgataaccatcacaagcagtttagctttatttgcggaaacctaaggcgtgctgtaaggcgatcttggcaccttcagagttcagctgacccggatcataaatgatcgtgccgttacccatgtaatagtgaaattgctgtaacacggtacgattggtcaccgtgcgcaagcgcaactcatcattaacagcatcaagaagttgttcgctccatgttttgctcatcatttccggaatatcccgctcagtgacgtaacccttatccataatcgcatccgcaccttcttgcttttgagttcgcgtcacggtgttctccgattgttctgccatcgtaatcctccttaatctgcttgttttcagaaaatttttagagccgcttatccgcggtctgtcgccttcttgattctatcacacccagacacatgccttgggtttagactaatttagtgttatggttatttttatccaaaaacgaggcgttatgaatgcgcgttgacaccggaaagtatcctgaaggggttgaccccgttcgagtgaaacgactcaagttattgagtaaagtcgcgacattcacctgtattttaatgtatgtttcttatattcccgaaatcatcgccaacttctccgggaatccggttaatccgattcaaccactggttgcgatgatcaatgccactttgtggaccttctatggttggactaaaacatacaaagactggccgattatcatctcaaatatgcccggtattctgttcgggctggtgactttcatcacagttttcatccactaataagccgctattcgacaacaccttcatcttagatgagggtgttttttactttacctgatagagtaatcgtgctagtattacttcaacagatgcagtactgatgtaaagcactctgaaatgtgctttgcatcagtccataacgatagagggaggtcatgctgtgattagcagtgacgccatgcgtgggtataatgatgcgctcattcttgcgattttacagcaaggcgattcctacggctataaaattggcaaagaaattcgtgagcgcacagatggtcaatacctcattcgagaaacaaccctttacgccgtctttaaccgacttagcaaaaatggctacatcgatgattacccaggggatgtcaccaatggcaagccccgcacttattatcgcattaccccaagcggccgtaattttcttgctgttaaagcagccgaatgggaacgtgtcaaaaccgttgtcgatccattcttaaaacagccgctaacgaatctttaaccttggaggaatcgcccatggataccatcaccacctacctagatagtctttttgcttccttacctgataatgacaaaacccgacaagccaaagccgatatgctcgctaacatgcgtgattattaccgtgatttgttgcgcgaaggtaaaagcgaagaagccgctattggtgctgtcatcagcgcatttggctcaattgacgagctacgggctgatctgggaatgccagcacaagcaacggcgacaacaacacaggcggaccccaccgatgctgaggaagaagccgatgaagatgcgattactgaaaccgaacttcgcagcttctggcacatggctgatcagtttgccacccaaattgcccttggtgttttgctttgcgccgtcagtatcgccttgcctgcctacacaggcgggggccgctgggaaggattcggtgggattggcatgtttctgcttgctgcacttgcagttggtctgttcatctggggcggcaccgtcttcagccagcaaaaaaagcagcttaatgaccggccgatcacagccagtgccaaacagctagtcaacaagaccaccggggaatacacccggcaatttgccgctgggttgattgccggtattatgatctgcatcggctctctcatcccacccatcatttctgcctacattcctggttttatcagtgaaaatgctggcggagcgctatttctagcaattgctggcctaggcagctacctgatcatttatgtctccatcaattattctcagctaaaacgttatgcttacgcgacaactgcggcaaactcaactgcttggtaccatggtactgatgacgatgccgctaattattgggaacagccacacaagcatcatcagaacacccgagcacgccaagatatagcactttttcaccaagtctattggccgaccgtgcttatcatctatcttcttgtcagctttctactccacggatgggcatactcttggctcattttcatcattggcggtgtcatgcaaaacatcattactgccgtcatcgcacgccgggactattcagaataaagcgtttcgattcattgtgcaagtccgtcacggcagcttttcttctctgatattcacaagcatgcctctttacagcagaccggaagttcagtacaatgaatcttgtgttttgggtccatagctcagttgggagagcgcctgcttcgcatgtaggaggtcgacggttcaagtccgtttggatccattttatatcagctttcatggcgggtctttagctcagttgggagagcgcctgcatggcatgcaggagatcgacggttcaagtctgttaagctaactctatgaaattcactgaagttcataccagccttcgaacgctgatatatcaaccttttaaactttaacaactccatagagaatcaccaaagcgaatagaaaatgtaccaaaaatgcaccacttttacaagacagagtgcgggcggggtgccacttcattatgaggtggcttttttgattcttttagtagtgatgtatacttgcacaaaaagaggggcatttgaaatggatgatactttgtttgtactagggaatggatttgatatacattcttgtttaccaacccgtttttgccaatttcgaaaatttgtttgtgagagagcggacattaatccgggaagggtttataacgacatggataaactttttccagaaagcatgaatttccaacaagatcctaaaggtgggctaaatggtccctatatgaagatttggatatacttgttagatagcgcctctaaggaatgttcagcttatgatcccgataaatattgggctgattttgaagaagacttaggtgggttgccatacgaagacgtgctggatcagccagaaatccaattcgatagcgaaggggatgaagatcctttccaaactggggaggcaagtcaatcaatggagcaatacatatccgtaaatatgttgaccaaagagttacgagaatggattgagaacgttgaagaaactagtcctgagattgataaaaatctagctgaaagatttaaaggccataataatatgtttctttcatttaattatactaacacattagaaaaatggtatggaatagattatacacaggttacgcatatccatggatttgttgacaatgaaacacaggttcctgatactattatttttggacataaagataacgatagttataatatgcctgctccgagtgaagagtatatgtcagacattgaccaagaaaccttgaaacctgttcttgatatcattagtaaacacgaatatttctataaaaagatcatggcaagcaatcttaagagcctgttcttttatggatttagtttttcagaagtagatagtccttatattgaaaaaatacttaaatcaattactacatcaaaaccaattatatatatggtagattgtaaaattaatccgaacgctgttcggacaaaaaagatcagcttcctttaaaatggtgtttaccacaaacaccactgcgtccactccttatggtatgatttggttgggtttgtaggataagcgtgccttcgtggtgcgcttttgttttttgtgatatacctgctgttcaaataattcgatttgttagactgagtcgtcctgttaatccagggcgacttttgctatactatctttggagatgctttcttatgcgtgttaaccttataagttgggggaacaatctgattcaagcacctcccgcgcgttgcttatgcgacgcgctttttggtatactgcatacggaggccaactccttttaaatgattccatttgctatcaatcacgtgtacgtttggcctccagagcgcgtcaacacccggcgcgcttttttgatgcttttaaatgtactttcaacatgtgcgtttgctatactgtcattggaggccaactcctaatctttgatttcatttactctcaatcgtacgtctggcctccagcgcgtccctcatcaggcgcgctttttatttacattgaatcaggattattcctgctaatatttaagttcgtttggatcgtcaatgttgattggcaaggttaatacaatcccgccagaaacttctgcagcagcttcagcgtcatgccttagcacaaatagtttagatgaatcaatttcgcttgatgtattaaattccttgctacatttgctgaagtaagatacatattgctttttgccaattctgacgatgaagaccgtgctgccaatttgaaccgtcttgctgcgcctattgctaacaaaatgatcaaaaagcagccaaaagaagtatgcacatatgactacagtaataaccgcgcaaataagtagctttattaataacgaattcatttcattttcctctttcccagttagcccacgcccatattgaagcaactgcgatgagcaagatgacggcaatcattgctttgcttccagcctacgtccgcacatcggacaataattgattgcaatcggttcatcaacctcagcattatcaaatccgactgcggtgcaggtgtgtattgccgcaccatttattttttcaggatgaactccgtcccaacagttcccaccagacatacctattcgcagaaaactaccatcttctgcttcaataggtttatgcggctcttggcaatactgacagcttttctgtttcttggttaagggggtcgaattcgactccctttccactttattagccatgttatgtctccttacgcaagtactgtcacgtgcttgctaaattttacaagcttctcactaaggtattcggcaacaagatcaattgctgtgttccgccacgcatcaccgtcagcactaaagagcgccaattttggaccttcatgcatccgaaagacaaaatcactttcctgttgctcaacttccagaaatgtacgatatggccgtagtgagattggattcgggacaactaccttgccaacggatgccacaccactgcgtgcggttgcaacttggcttacaccgtcatcaaccatcgtctgtgcagattcgtctttaagattacgaacaaatttaagcaacactttgccatcctcagtggtcatgaattgtgccggcaatgcgatgatgaatgattccgaatccagccattgaccgtatgggtagcagggatgcattgccttggccttgatcaagacttcccggttgccaaaatcatcgagctctcctaatacgaatacgctgttctcatcgactacttgcacaattaagggactggcagaacgttcgctgaccttcccgatataatcgacaactgcagtcaatgtgtgaacttgtaacgcttcgtttgctccatcatttggtctaaattcccttatatcaccgttaccattaatcaaaaattgacgattttttgtttcgataattcgtttaccatttgcagtaactgcctgttctgctgtgaatttaagtgcatctgcttctgttgtcatattagttggcctccttggcgttcttgatttttcggaaatcaatcggtgcgtctgttaccttatcgtctttaattgggatacctttgtcgtcttttagcgtactatcatctgggtcgaagtattcctgccctcgtgtacctgactttaactcgttcatttccatatatccgtcctcgccacgtccaagcaatacattggtggtgacactgatgtctggtattagcgttgttttgacatcggttgtaagcttaacgactccgctatcgtcaggcttaaagttaagcgcaatggtaacttttcgtgctttgctctgatcagtattaggatcaagaatgttattggcaacctgggccaatgcctttgtcaacttttctttaatggccccatcagccagttcgttcagattcaaatttaatttatccatagtatttcctcctactttttctttgctaaattcaagcttgttctcctcaaaataactttccgtctcgtgactccaatgccttgataactccaaatgtccttaaacagtcatctagcgcgttgtgagtacggtttactggtatgcctagaacattcgccagtccttgcagcggaggcgtagcattaaagctataccgcttttcaacgatgtctgcgatgtcgataaacttccagttcttggggatgccatgtgacccctttttaaatgtttctctgatgcggcccgcatcgccttcaatcgaccaccccacaatgtcaatcgtagttctcatccaggccacgtagtcacgcactgtttgctgcaggcttggtaaagctaaatagtcgctgtatcgcatgttacttgtcctaatgatgtgaagctgatcaaatttatctggtgatggaatgaatcggttgaactgatctgcaatgtgcagaccgtctcgaattctgactgctgatatttgaattgctcgattactggttgagttaaactccgtgtccataatcacgtattctttcatcaaggcaacgcctcttttcgctgatctaggattcctttaacgccaaagctatttccttggccgtgcttggccatacgggacatagttcgctcgccgtacctcttattcagatcttgtccgtgcaaattggttgtcacgatagttgctttgtcttcccgcattctgaaaacatcatcagccgtctggcggtcaaaatcactaccacgctcggagcctagatcatcgatcacaaccacatcagccttgccaatctcatgcataattttctcgttcttcattcgcacatcttgtgcattagcactcatgccagacttgagtctctgcattaaagcgttccagtcaataaaaaggcatgttttgcgataaccggtcttggcctgagtatcaattaatatgccgttagcaatatgtgacttgccaactcctgtgtcaccgataatcaatgcgtgtacaacctcgttacggcatattttgttagacaaaccgacagcgaagagtttcaactgctgctgtccaaggctgccatctgtatggaagttgttgaaatcctttgcaataatcgcgtctgtactaaataccgaataagctaggtagtatccaacggtgcggttcttgcgggcctctttttccatatctggcgtgacgtttttaggctccgtgggtggctgtttatagccacaattcatgcacactccggccatttttttaccggttactttgctcaatcccttcgggcgatacaagaggctgccacaatcgggacaacgttcagcaaatgtttcgatcgctgctaagcgtccttgattagtttcaagattgctcatcacacgcctcttctctaccaaggtaagtcttcatcttggacatccccttggttttgataaacgtctgtagatgcttgccgtgacgttgattttgacttttggcgttgtgttcgttgggcttcataggccgtcactgcctctaaactagtaagccttaaggattcccaattttttaaaatggcattgacatagctataacgacgcacgttattgtcaattgcgttgctcatggcctgtttgactacctgaactgcctgctcgtcagttgagccaatcttcttgaaatcatctacccagtatatgaggtcttcacggttctttgggctgataaaaccaaaaccgtttttctcccaaaaattaatgagctccggttcccctaatgttgttgtattattaatacttgtattattctctggacagttttctgaccgggggtgggtcaattttctgaccgaggggctaaactaataaatctttgttcaacctccttacttccacttttatatttgatgactctgcggatatatgaattgtcttcgagacactttagccaacttttgatagtgccgatgctaaccgaatagagctttgcgaaatagtcattcgatgcccagcagtaaccgttcttattggtgagtgccgtgatctcgccatacaagagcttggctccttgtggcagctgtttgtcatagcgcacacttgctgggatgattgcatagtaaccaggcttctcattcatgatcgacaccgccttcatgaaagcattgatcggcaatgttttggcgaacatccattaagtctgcttcgaatttgatcatatcgagtgatgtttgacccaagatatccatgtattttttaaagttgtcttttaggaacagccggtcttgaatcttctcaccatcggtcatgtgaggatcatcatccctgaatagatcgcacttggtttctgcccattctctcaaataatccaaaaggtactgatcagttcttactttgtatgcaagtgattcaagacggtcaagttgcttgccaatttctctggccattgttttacctcatttctttctgtgatataatgatgtcaatcaatgtgaaacctcatttttggccgttaagtgtgctagcgcttagcggtttttgttttgccaattatttcgttgattaagctgtgaatagagcatattgtttgctcccttttgtgcgataatcacgaagaggtgattagaatgaataaatacgaactcttttccagcgtcgtacaagctctgacttcgatagtggctgttgttctatcaacaatcgctttaatacgaagttctaaatcagaacgtgatgcaaacaagccgtacaccgtttcttttcttaaagttgtcagatcttcgcaaactacaataatttacctaatgatcaagaactttggccgaacaggagcaacaatcttatcagtcaaggctgatccggctattgacagtgggcaactaaagtttgaaaacaacccttttgaattattttctaatcagctgatagcacccgaccagacctatgcagccgttatttcagtcaaaaactcagaaattgagttaaaaaccagaaagttttctttgtccataacttattcagatgagtttggtaaaaaagaaacaaaagactttttgcttaacgctgatgtggccacgtccttcgaccacatcacgccggtaccaacaaaaacagatgaagtagcgaaatccatttacataacgagcgcggaaagactatttaatcagttttaattcagcgtattgatcaagatctatcaagtctaaaattgcttttgcttccgcaagattgctcgtatgcctactcaaagtcgcgacaataccatcaactgccatttgaacatcattggccgaaacactaataccatcgccaaatattggagaatattttttgttcaatttggtctccgggctattcaatccacttcctccaatttccgctgtggcctaagcagtggccaacgatcacgccgaagccaccagcaattagtaaataaccaatcattatttacccttctctctaagcgaccttgaaatctctgggaaccatttgtctaagaagtcgagccatggtttcggatgaaacagatacccctttttgccaggcggtggatatgaaaccacggtatcttgcaagaacttgtggaagcgtgggacgttcaagatattgttaactacccacgtgttgttatgtccttcgacatagcttgttgcggtggtgagcgtccacatgcctcgtgctgctagcttgcgttttaactcttggttctcctcaatcatctttgccagttcttcttcttcaaccgctaaatactttttgcttgaaatctgatcatcttcaacaacctgcaacaacggcatggcattttctcctttcctgtgatcgcctcctgacggataatgaaaccgaaaggaggtgaatcttcatggtgcaagtcccttattatgacaatccgggcggagctctagctgttacagtcgaacttccgcacgctgcgaacgtttacttggtggatcaagcaaacttcaacgctcaccaacgtggtgaccactttacatatttcggaggtcactatgatgagtccccagttacaattcgggtttctggagctggccgttggtatctgattgccgaaaatgggtcaggcgaacaataccgttacacctggtctaaatagttgcgttgttctgatagtgagacttcacacgtgctacaactgattcaaagttggcaaatgtgaagcctttttgtttgagaagatcaatgaccattccagttacttggtcttcaacatctttgtcctgtactttaacgacattggttaacttttcctttgggcgttcattcatttagatagcctcctgttgttggtcctccaataatgaaatctcgcgtgctttcatgagagttgctgttgatggcgtccaattctggataaagtcatcagccttatcgaagtctttcttacgtaactgtgtacgtgtcttgattccgatgtagtcatttagtccgtggttaatatcgcgataaaagaggctgcgctgttttgcgttgagtttgcagtgatgtacgtccagataatttgcaacagctcgattgacttgtttgctgatgtagttatattcacctggtgccagcaaagccttctcttccagatcagttacacgaccatcaagcttttcaatccgttttacagttcgagtagcaacttccatggttaaagcaagcttttcttctggcgtctgtggaagccgtgttttcggattaaagtagttctcctccagactgtcgaacatatcccaagcctgatctgtaccaagcatttttgagtgacgtgcggcgccgcggcgagtccagagatatagagcacttgcatttttcccaacgaacccacaatttgtcggttcgttcttgaatgcccgaagttgctccccttccagcttgaagaagtgctttccttcaatgaacttattcgagtttcgtttaaagttcatttgaacgactccaacagtcgttccgtacaattctgcaagttgttcggtggtcagtacacgctggccgttttgttcaattggttgtggttcattcaatgcgtttccttctttcatgaattttcatagtttgctgccctccgtcagtgggataatagttcataaggagggaatgtaatgtccaaaccaattgatgccgtagctgttgaaaatatatctaaaatcttgggagaatatacgactgggcccaaaatcaccaaaatgttttctttgcttggatttttcgattatgatcttcgaagacaaactgacaatcaatggttcaaagcgtctaccaaatggcgtcgtttagacgaaacaattaggcacgagtgtaatgcttcacacaatagtcgccccttttttagagccatccagtacattgctcgacctcaagactttatttcaaagccagaagaatggggccgcctacgatatgagataaatgaatgccttattttttatggttattatttggatgacagtggaagaatcgcatcagcaaaaaccgcgactacgttttctgaagcccagctacgcttaaaaactcttagcgctcgacttacagaactcaatgttcaccctctagtgatgaaattctgcaacgaacaatttcttcaaggcgactactttcacgccatcttcgaagcaagcaagggtgtcgttaatcgaattcagcaactttcaggcatacaaaaagatggcaatagtttggtaagcaccgtgttttcggacaagcaaccaatactcgttattaagggcaacatgcttgcaacggaaaccgacagagacatatattccggattacgtaaccttcttagaaccgtaatatttctttatcgaaatcccaaagcccacacccctaagatttacgatccctccagtgtcgatgatgctgtccaagcgtttgttatcatgtccgcagcacagacaatgcttgattcagttgttaatgtcagagacttcctctagccttgttgccaccagaaggcccaataccgccatcccaaggatgctaacttggaatgtggcttttgggtttcttttttgtagttcttgactaacagcagactcaaatagatctaacgttttggacgtaaccactggaagctcattgcgaattgcatcaatcggcttgatcatttatcttcctccctattccacatgaagtttgattagcccgttcataccgtcatcttcttttgctgtgactgcttatatttgacgtattcaatagctcgcttccaacggtctttgtcgatctgattagcagttaatccctgaccgtcagtcatctttttaaccagaattgccattacctgatcactgataccgagaaatttcgcaatgtcgagctgtgacaaattcaaatgtaataagtagcctttccagtcattacgattagcagtccaattgagctgaacgtttaccatgtactcacctcccttacatttaaagaatcaatcaagttgttgcattaatttatcacgagtggtaaattaatggcatagcaaataagacagatgatctacttatccaccgttatcgccaaagacatggatggattagcttgttgatgtttgcttaattacttgatgaattcatagtaaaccacacgtgataaattgtaaaccacttgtgataaataattcgtcatgaccgggagaactcgtctcatgagtacttacgacagaataaaaacactagcttcaaatcgagggtggtcactccaaaaattagctctgaaagcaggtataggcattaacagcatctatcgatggaaaaagatgaccccatctaccgagaatgttcagaaagttgctgatgttcttcaagtttctgtggattatttacttggcaatacggataaccccaatcctgacaatgaaggttctaaacctgttgatctgtcaggaacaaacatctttacctatcaaggacagcctgttcgccaagacgattgggaaatcattcaagctattttggaacgacgcaataatagcagcaaaaagcgtgatcgtcatgaatgatcatatagaggacttgttgaatcaggtgattgactatgcttgggatcacaatataggctgctcgactatccccttacacgaggaccaaggccctttggttgatacagaagctcgcctaattattcttaacaacaaatggccgaatgcaaatgagttgccatttcaagcagctcatgaatgtgcacatattctcaacggggataacggtaagcttcgatacacaaatcaatacactaaaagccgtacagagaatggagccaaccaacgtgcgctatcaattatcgttccaatgtatttcgcagacattccagaagaatcagcaaacattgaccaattcatgaatgatttagcgataccgcaatggttagaggattctgccgttcaatgcattgaacggttttatgaaaactactgactgttcattgttgaattagcttgcaaccaactggtaaaagcagatgatatcagtataatcggaaaagtcattaattaattgtagaaagatgttgatgttggattatgacaaaaatatgcacattattagatactcaagactctcagatttctgaatgaatgaatctgttaccggaagaccaggttgatgcagggcaagcatatgatggtctcggcaactccgaaattattgatactgcttttgaaaataagatatggcaactaagtaagtttgctgccttaaatcaaccagtttcagtcgatattgatgggaaagtatatgccgaaattaggcaaactaagtacttcattggaaagataccgaacgacaaagtcaaaacattctcagccttgtatctaaatgacaaagtggaactgtgggtatctatacacggggggacatataaacaaacaagtacacgaagcgatggttctattactgtcaaaacttatagagacccagtaactttaaaacttatcgccgaagatcagcaaccagctaagacgctcaacaataattccggtgaagaatggtctgaagtcggcaaaaaaatgtacgcagcaaaaagaaagccttattgcctgaattgtaaacatcagcttaaaggcgagcgcttttgccccaactgcggggctaaaataatttatccaggtgaacatcagaacggtatgccaatcaattcatgggaaaaagttgccaatggtgctgataagttttcacaatcagttgacaaaaccgggaaattttttagcgacttcggttgtgcgatgactttaggatgcacaataccaattattataataattatactgttcggtcttatttagtcccttccgcaacgcaagcggcgtctccgtgcaagccggagagtggggcttgtgccacataccaagtaaaggatgtgagtcatcatgctaaaaaagatagttgccatcttactcattgttttgttggctggcgcaacaaccgcttgcgctagtgatcaagacgatgatcaaaatgtcgagcagtttaactgagtgttggctggatacaaaaaacccccggccgctgtggtcgaggagcaattagattatgtggaggaaaagaaattgcaaaaagacaactcagataaagctaaaagtttgccagataaaaaatccggcctctttttcgacagaaatgtacaaaatcgttcaatcaaattagttcacaaagaccctgttccccccaaaccaaagatgccggattcggcatcttctaagaataaggattgattccgataatataaattttccctggattattcacctcggtattggggacatgaaatcgcatctggccggtctgaaagcaacgtttggagcgttgcgagtgtctttttgcgttatccaaaaagggcctacacgttcagtgttgattatttctcaacaccagaaagtgtagaccctctttttcgttactatgaatgatgtctcaacttctcgtttgatgatcaatcaggcttaataataagtccgccgattaccgaaattcaatttagcgatgatggtgttcggttcggtttgatcaggtgattgcagccacaagccgcgagaagagagttctttgaataaatagttagttgccgcaatttcttcagccgctggatcgtcaatcttggcgccggcttggtgcgccttagcgatggccacatctaatgacagcgtcaccgtatctgcgaaagtatcattcaacgttgtatacagttcattaatctgatcatccaaataggcttctaacgccttgaagaatgctgcatgatcagctttgcgatcaaaatagcgcgccacgagctgattattgtcgattcccatatatatataacacatcctttttaatgattttaccacgagtcgctttttgtggatatgcgtttccatctaccccatgcgattccacagaacaaaatcatgcagaccaatgctatactttacccattaagcgaaggaggttttttcgatgagtgaaaccgcactgccaaaacgtcaagaggttgatccaaaactgacttgggatttaacgccgatttttgctgatgagtttgcttacaccgaagccattaagcaagtacgcgctttgaccaaggattttgtccatctatatcaaggaaagttgaccgaaccggccatcattgttgatgccctgggcgactatggctcgattatcgaacttgatagtaaaattggacactgggcatttatgccgtattcgacagataccactgatcctaaactccgtgatcgccaaatcaaagccacggctttagatggtgaaattggtggtcaattgagcttctttcaagcagaactaacccagttacctgaagaggtccttgatgccgttgttgccaaggcacctgactatgctggctttttccgccaaatcaaaattgctaaaaaaggcgctttggctcctgctgctgagaaggtcttagccgagttatcacctgttttccaagcgcctagcaatattcgcgaccaaacgattttcggcgatatggattttggcaccttcacggctcacggtaaaacctatccgctgtcattcgtgatgtatgaagaaaattatcagaagcatcctgataccgaagtgcggcgtgcagcctatgcaatgttcaaccagacattgcgtcggtatcaaaacacgatggcggctggttatctagcacaagtcactcgtgaaaaaatcactgccaccatgcgcggctatgattccgtcatcgattatttgctggccgatcaggaagtcagtcgggccatgttcgaccgccaaatcgacgtgattatgcacgatctggcaccgatcatgcgcaaatatatcacccacgtaaaggaattgtggggacttgatcatatcggttataccgaccttcagatcgatatcgatcctgcctattctccaacgattacgcttgatcaggccaagcaagacatcgaacaggcgaccgccatcatgggccatgattatcaagcgcaaatgatgcaggcgttcaccgatcactggattgatttccctgccaatcaaggcaaggactccggtgcttacaccgcgggtccctatggcgttcacccttatgttgaaatgacgtggagtaattccctgcctgcggtttacaccttaattcatgaacttgggcacacggcacaaatggttcgctctgaaaaagcacacaatattctcgatgctgatttcaatgactatttagtggagagcccttcgaccttcaatgagctcctattaacccactatcttgatcaaacggctaaagatccgcagatgaaacgcttcgccttgtcccgcctactcaacgacacctacttccataactttgtcacccacttacttgaagctgcgttccagcgcaaagtttaccaacgcattgacgccggcgacagtttcgatgcagcggcgttgaatgccatcaaacgtcaagtgctcactgatttctggggaccggctgttgaactagaagaaggcgccgagctcacatggatgcgacaaagccattactatatgggattgtattcctactcgtactccgctggtctcatggttgctactcaggcattccaagccatcgaacaacaaggccaacctgccgttgaccgctggttgcgttacttaagcttaggcgactcactcaatccagtcgctgctgctcgggtagccggtgtcgatgtcaccacagatgccgccttgaagcaaaccattgccttcctcggtagaacagtggatgagattatttcactgagtcatgaaatcaatggctaatgacaaaaactgcatcacacatttagcaccacaatttctaagtagcccctcatcatgaaaggctgggaaaagccatcaccgctaaattgtgccattccggcgcaatgaacggttgatcgctaatttccagtctttttcttcgttgtaaacggtttcgcgtttattgctgactagcaagctcgtcaagtcgaatcacctgatcatattgtttttgccatgtctcgctaatatgatgtgcgacctcaatgagcgtcccaggacttttcaaaagatgagcatgtaattgatcgcttaaatgctcatccaaggctgatgtcgcttcgtctgccaatagaattggccggtgacgtaacagggcgcgggcaatctctaatcgttgcgcctgtccacctgacagattgtggccttcatcgccaacttgatagtcccaccctttctctgcgatgagtggtgtcaaaccggagtcagtagctgcctgatccaaagcctcttgcgaaaacgttcaccaagcgtcagattaaagcgaatcgtgtcatcaaacataaacggtgtttgcttaatgaggccaaacaattgccgcaattgatgcgtattttttgcggtcactagggtcttaccgatccaatactgaccggctgctactggcaactccccagcgagcagccggagcagcgttgacttgccatatccggagggagccatcactaaaattttttgacctggtgtgatcgtcaaattgagtccgtttagaatcttgtggccgtcaatcgccacctctgcgtgcttaagcatcatcgccccagtcctgatcagcaatgaggattcaactgttggtgcatgattcgccgcatttatttttgcgataagcggctgtgctgtctgccacttgttcacagcaccaatcatcacaacgagcggatttcgcatgtcatttgagagctgcacgatacccataaacaatgctaatgttgacgcgccgctaatgacgcgataaataccaactccaaatggcagtaaaacgccgaaacaaagtgctaataacatccccaacgaatccatgctactagtcaaaatatttaacaaccgcagactgttttcaagctgatcggctagttgatggatgcgacctttaacaaccccttctgcttgataaacgctgattgtatcgcgcccgctcaaataatttttaagccctgacgtccagttaccattagcctcagaccaatctgacgctgctgtgcgcaagcgtccttgggcgacttttgaagcaactaacggcaccagattccctaggaaaaagatcaatgccgtcaaccagtcaaacgcaaacgcgccaatcattgccccaacaaacgtgataagttgcccgaccactgtcagttcactggtcacgccattggtttcgatcattttaaggtcattggtcataaacgacagatctgagccttgcgaacttgataaatccggatgatcaatcaattgccgtgtcatcactttcttgatagtcaagttcacttggcgaataatggcggcctgtagcaacattgtggcccatgtcgccacagcagctccggaaaagaccaataaacttggcagcaatgtttgtaataataacgttgcggatttcgccgtcgccgcttggatcatagctgttaagcttgctgcaacccccacattcatcgcactcatcaaaacactcgtcccaacaaatagaatcaattgccatttgcgcccatatcgccatgtcatcatcttacatttccccctttggcctaaccttggcgacttggtgttgaccaataagtcgctttagtacttgctgttcaatatagtcaggtataggctgagagaaacaataaatgtcatatatgaaaggcaacctgtcatgaagattggtcaattgcttcgtaccattcgcaccaacaaaagtatgagtcttgcacaagtcgccgatgcacaaatcagcagttcctatctttctaagatagaacgcgaccaaagtgacattacagtcacaaagttagctcacttgctcgaacgacttagcaccacgccggaagagtttctatttttggtaactgctgggagagagcacgactatgccacccgagacagattactgggaacttattttggccagactttggaactgtccgccgacccaaaagacttccctaaagcgattcaagtaatgaaggaggaaattagccgtgctcaagccgctttagaccgacaccctaatcttaagcaacaattggcagtcaatgcgcgcgtcgtcattcttgcaacttttcaatcactcgtcgttgataaagcccatcagttgcccatcagacctgatttaacccatgccaccgagcaatacttgcaacgtattgagaattggggtgaattcgacatttatctcttcatcatctttagcattgccatgccgcctgtaacgcaacggcgattattgacgctcgccttaaaaagaagccgccactacagtcactaccgcagtgccccaaagttgatattccatttactagacaatcagataacgcttgaattcctgcgccaaaattatgacatggtcgcgacttatttaaaccagttaaaggtcgaactggttgagcagcaagatgcagaattcgccttacgtgccaaatttcgcactggggaattacaggttcgttatggtcagcggaatacaggagcagcaatgttaaacgaagccgtgcaaattgccaatacactcaagttgtcaaagcttgctgactattttaattacgctcgacgaatcatcttaaatgagtcggctacatctgcttacaaatactttggcatctatatcgattaagtaccccagccaaaaaaagccgctcaagtgacggcttttttttacgattttatcgatcataaatttgcctgatccaacaagcgcaccactgccctcaaaagaggttgaatggtttcatgaattgccgggcaatgactggcgcctaattgttttaaagcaaggctcgtctggatacgccgaaaaaggttcatttgacttagcttgggttggccttgtaagtaataaaaatcgattggcatgacgcagcggttctgatactgtagcttgatttgcttaattgccacttgttcccgtcggataatcccgctaccaaagactatcaactgatcaggtaaagactggtgaaattcgcggtagaaggcctttagacccaagactttttcacctacgagatggccgccatagatgataattttgcgtttttgcaggtctgcagtggtgacaaattgcacgtcaattaattcacaatgcagtgcctgggcaatgccaagggcaaatcgttgcgtgaaccctgtctccgaagcgtaaacaaccaatgcttgttccattcgaccacctccttctcgcacctgaagtgccggttatttgctcgctaacatttccgattacgtcaattgtaaaaatctggcatgattttgcttattgttaatgtacataaataattatattcgcgtcaatatatatgctaatgaattttagcaaatttaattgtttgaatttcgtttcatccaaatgcatgctacactgatggcattcagaatcgtggtacactgatactgaacttgaacgattccacattaacgatataaggagtgagccctttggaaataacccgtcatggcgaagcattaacaacgaatggtacaccaatcgaactcggcgagcagttgccgacgttcaccgttactaatgcacaggcaaaacccgttactacgcaggatttaagcaagcgattaacgttaatcagcgttgtcccagacatcaacacacgcgtttgcagtatctcaaccaaacatttcaatgaagatatggatgcgtttgatcatactgacttctatacaatttcaaccaataccccacaagaacaacagtcgtggtgtgccgctgaaggcgtgaaaaaaatgcagttgttgtctgatcaaaatggcgactttggcaaggctatgggcttgtttgtggccgataatcacaccgatgctcgcagcgtttggatcgtggacggcaccggcactgtcaaatatcgtgaactaatcaccgaacagacacatgagcctgattacacaagcgctttagcctatctagaagctcatcaacattaatcgcacaaaaaaagaagccatgatcggcttcttttttcgtacgtttaagctaagccctgaacgagcatcatcaaaattggcacgacaaccacaaacaagacggtagatgttgtgaccacgtttgtcgcatactcaacatcggcatgcgcctcagtagcaagaattggcaatacagccaatccaggcgcagcagcttgaatgatcaaagtttgcgcttcaagacctggtacgttgaacccagcatgcatccccagcagaatcaaaccagcgattaatgcaggcgcaatgacaaaacgaccaatcaaagccacgatggtatcgcggtcaaagcggatcgctttcagaccggcatcggccaaaataatcccgatgtaaatcaacgacaacggtgtgaccaaactgcccacataatcaagggcattcactgcaaagcttaaccaaccgacgtgaataaacggaatcttcaacaacaggaaaaccagagcgactaagaatccgactaacggtgctggcaacaactttttccagttgaagccagtactgcttttttctgatttcttctgggttggatcgtcccacgccatgatgaaggccccgacagtccatgtcgacacggtgttcaccacataatacatgagaaaataaggaacggccttatcgccaaacaaggcgaggttaagtggcagaccaatgaaaatggtgttcgcgttcacaaacatgttgatgaacgtcccgcgccgacccgggcgcacttttaataaccaaaccagtaagaaagcgatcaggtagcctaaaatgacggcaccaaagccataaacaaggcctgatgatagactcaccaacttatccaacgttaggcgttgcaagaccgagatgaaaatcgatgctggcaaggcgattttcattaacaaatcagaaattgttttaccaaattgatcatcaaagcgtccttgccgccgcaacacataacctacgacgatcagcaaaacaatcgtcagaacactttgaatggatgtacttaatgcagtcaacgtttattcccccaagtccatttcgagtgaatccggcagtggccggtattctggttgccatgtcatatttgcaaccgcttgtttagcatctttgatcggcttttggttcaggccatgcttcaccgcatcttcagcaaccgcaattgccacagtctgactgaactgatccagcttggaaactggcggcaataccgctgcaccaggttcatcagggtcaacaataccgcctaagctgtgcgctgctgctgagatcatggaatctgtcaaaaatttggctgttgaagcaatggtgcctaagccaaggcccggataaaccaaagcattatttgcttgaccaatcgcatagctgacaccttgatagtcaactttagccgctggtacaccagttgcgatcagaccacggccatctgtccacttgatcaaatcgtcagccttggcttccgcaagcttggtcggattggacaacgggaaaataatcggacgttccgtatgcgcagccatttccttaacaatgctttcagtaaaggttccaggcacggttgatgtcccaactaggacagttggatggacagccttgacaacggcttcaagattcgtcaacgcatcggcatttgcaaattcgctgcgtttgcgagcaaatggcttctgttctggtgtcaagtcagacatgtcatcaaaaagtaagccttgtttatcaaccaagtaaaaatgctttttggcttcttcaggacttaagccttcttcgataaaggcttcatatacccgcgaggtaatgccggcaccggctgttccggcaccaaagctcagataaacttgatcggtcagcttctgtttagaaatattcatcgcaccaagcaaaccagccaacacaatgatccctgttccttggatatcgtcgttaaacgtggtgatctggtctttgtattcatttaaaatatcggcagcattactgcgaccaaagtcttcaaaatgcagatacaaattagggaatagcttctctgccgtggtgacaaattgatcaacaaagctacgatacttcgggccatatacccgcttatgccgattgcccaagtaaagatcatcattcaatagtgcttcattattggtgccaacatccagcacaaccgggagaacttgactcggatcaatgccagcagcagcggtataaaccataagcttgccgacagaaatatctacgccttgggtgccccagtcgccgattcccaagatgccttcagcatcactaacgactaacaagcgaatatcacggccattggcactatgcttcagcgcgctttcgatatgatcaggatcgtcaatcgacagataagtggcgttttgcggattgacaaacagcgcactgtaattttcgatcgtatcggcaatcgttggatcgtacacgatcggcatgaattcattgatatgctcggaaaaaagcttatagaacagcacatggttctcattaaaaagcgtcatcaagaactgacgcttagccagatcagtcggcttggtcgttaactgagcataagcttgcttaacttgttggtccaaggtctggacagctggtggcaacaaaccattcaagccatactgattccgttctgcttgagtaaaggcggtacccttatttaaaaacggatcgttaataatttgctctggtgtatatttcaaaatcaacactccttctaagtgagcgcgagcaagagcgcttagaagctggagcataagtgggcttgagtcaaaatggctcgatcttggccattttgactcaaggtccatatgcacaagcttctgcgactgcgagcgcgttatagttgagcgcgagcagaagcgcttagaaaccggaacataagtgggcttgaacccaaatggcccgatcttggccattttgactcaaggtccttatgcgcagcttctgcgactgcgagcgcgttatagttgagcgcgagccagcgcggttagcaaccagccattgctcgggctttcttctttacagcaggtcacattacacgccgacaaatcttatagtcaaacccagcaggagtgataaaatatttttatatgctttaatcaaagaattggtcttctattccccatcaaccgtttcatggaggtaacactttgaacacacgcgattttgaatattttctggcgctaacgcagacccgcaacttttcacaaacagcagagcagtttgccgtcagtcaaccaacgattacgaccgccatcaagcgcctcgaagacagttttcaagcgcaactcattattcgtgatcggcgtcatcacgacattggtgtcacgtcagctggcaaacagttagcagcacacgcccaagtgatccttcagcagttgaccttggcgcagcaggaaattgcgtgggatcagaccaacaaaattcgatttggcttgccaccaattattggtaactacttctttccaaaaattgcaccgcagcttattgccgccggcttaatgccacaattgcaaacagttgaagcaggatccgccgccttactaaaccaaatcaaacaaggcgatcttgattttgccttacttggcgccagtggaccattacaggagccagatttgacgatcagccaaatcggcacggcgccatttgtcattattacccctgaatcagatccgttggcccaaaaagacaaggttcgattcgcggaactggcgatgcaaaaattcgtgacgctcagtgaagccttcgtccacactcgcgccttcacatggtttcaacaacagtcggcattcatccccaacgtggtctatcaaaccggtgatgtgcaacttcttaagcaaatggtggcgcaaaatgtcggtatcggttttttgacaaatctcgccatcaatcctgatgaccatcttgcggctgtcaaactcactgatccaaaacagccggttttcaccatttccattgtccgccgcaaagaccgcgttttgacaccggcaatgcagcgctttaatcaaatccttgcggcaaactaacgctgtcatgtcagtcgtgaaaacggactaattcgtctgcaacatcgtgcctcaccaacccagaaagctccgcataaggatctagttcgcaaggattaaggccggccatcacgttcctcgtacttgcgccggtttctactcaggctgacggacgcacacaaaaccgcactgaaccatcgtcccagacgtattctgaactatcttcgcccatgcgattactaccgatgcatggcgtaacagcctagaccactatcaagaattcgttatcatcgttgcacttgccttgaaaattgaggatatgtatctcattacattcacgttcttacttatccgcattcccgcctctgttttgctataatcacaactgaacacaattgttataaagaaagtatgatttcatggctgacgaatttcttgcgcatcctttgatcacgattacgaacgttatttggagtttttcgcggacaacccaccagttgcaggtacttttgattcatcgtgccggggcaccgtttgccggtttctgggcattgccggaaaccactttgcgtgaacgggaaagtgcagacacagcggcgattcgattgattcgcgataagatcggaattcacgttaatcgtggatcgacagagcaacttgcgacatttaccgatccgacgcggacccctggggagcgcgcactggcgttgacttacattacttacttaccaacgatgccgaagttgcaaccgggttacggtgctaccgatgcacgctggtttgcttttagtgctgctgatgaagcagggtatcaactgcaaaatgggcgaacgatttttccgctaggcacatcgacatctgagctagcgtttgatcatgcccggattttgacggtggccattcgccgtattcgtaaccgactagactatcagcctacgattcttcaagttttggggacgacgtttacgttgaaagaggcgcgcgaagtgtatgcaccatttttaatgacgactgcaaatgcgattgataattctaattttaagaaaacccaccaacagctgtttatcgaagtcggcactgctcatgatcgcacgcgtagtggccggccaccgaagcttttcaagctggcagagttgaaaaatccgatgtgaccgcgtatcgtagagagcaaataaaagtcggatctacttttatcgaatgcaagtttaagtaaaaaatacttttattaagaaaggatactaattatggcacacacaaatgaagcgctgctgatcattgattacaccaatgattttgtggctgacgaaggggccttgacctgtggcaaggctggtcaagtgctggcaccacaaattgttgctttggccgatgaatttctacagcaagatggctgggtgtatttgccaacggatgttcacacgccgcatgatccctatcatccagaaagcaaactgtttccgccgcataatgttcgcggtacgtggggccgtgctttttatggttcgcttgcgccttggtacgacgcgcatcaagccgaagatcatgtcaatatgtttgataagacccgatattctgcttttgccgggacgcccctggatttgcgcctgcgcgaacggaaaattgcgactgttcatttagttggcgtgtgcacggatatttgtgtgttgcatactgcagtggatgcctacaacctgaattaccagatagttgttcatcagaaggcagtcgctgcattgacaccagctgggcaagattgggcacttgatcattttgctcatgtgctgggagcaaccgttatcgattagtgttgagacgtcataaaagaaggttttattaaaatgaatatgaatcatgccatgttaactgatttatacgagttttcaatggccaacggttattgtgcgaccttgccgcatacagatcaggctgtttttgatattttttatcgcacggttccggatcacggtagttttgtcatcgccgctgggctgcaacaggtagtggaagctttgcaggcgtttcattttgacgatactgatatcgactacttgcgttccttgaatctttactcagaggcttttctaaatgagcttgcgacgatgaaacttgcttgcagggtgactgctttaccagaaggcacgccggtttttccacgggaaccgctgcttactgtagaagggccactgatgcaggtgcaattgctggagacgcttttgctaaatttggtgaatcatcagtcactgattgccacgaaggcgcggcggattaccgcagcggcagaaggtcgtcctgtgatggagtttggtgcgcgccgggcacaaggcccagatgcttcagtatatggcgcgcgggcagctgtcattggcggctgtgccagcacatcgaatgttttggcagcccagctattccatattccggctgcgggcacaatggcacacagttgggttgaatcgtttagtgacgagctgacggcttttcgcgcatgggctaaggtgtatccagataatagtgccttgctggtcgatacttatgatgttctgaagtccggggtgccaaatgcgatcacgatcttcaaggagctgcgtgcaacagggcatcagcctgtgggtatccgaattgattcgggcgatatcacccagttagctaaacaagcgcgagtgatgctggatgcggcaggttttcaggatgccaaaatcaccgcttcaaatgccctagatgaaactgtgatccaatcgttgctaaaagaaggagcaccgattgacaacttcggtattggcgaaaagctgatcactagtgcctcgtcgcctgttttgagtggggtctacaaaatggcgcctctgcaaacggatggtcaatggcagccgaagatcaaagtcagcgctagtcgcgaaaagacgacattgccaggccataaacaagtttatcgcttataccaccgtgacagtcatcgtgcttttgctgatgtcattgctttggcagacgaaattttaccggaaacaatcgccgtcgttaatgctaatcctttggcaacccagacacgggtcacgcttgctgatttcacggccaagccattgttgcaaccggtgttcgcacctggccacactgctgatgtaccaactgatgttttcgcgatccaaaaatatacccgcgaaactttagcggccttgccagaagccacccagcggcttgttaatcctgatttttacccggtttatctcacgccgaagttggctgagatgcaacagaaattgattgcggttcatcatggaaattaatgtggcttgatagttaatgaacgaacgttaaaaagcacacctgctccaaaaccaccattcttgctgataactggtggttgtgaagcaggtgtgctctttttttatcgcaaaaattaaacaatttctgaaaaaaatctctgttttccggcataaatagctagctttacagaaaacttacagaaacaatacagcctcttgccgcggttttttacaaacgaccgttaaccttagcattaaggtaaggagttgaggagaagtgagtattcgattagcgaacgtgtccaaagattttggcaatactaaggtgctatccgatgtttccgtagagatcgaacccggtgagtttttcgtcatggtcgggccttctggttccggcaaaagtacgcttttacgaatgatcgctggtttgaccagcgtaacagacggacgtatttattttaatgatcgcgatgtcacggacttgccaccaaaagatcgtaagttggcaatggtctttcagaattatgctttgttgccatttatgaatgtagcgcaaaatatcaggttcgggcttgaaaatcaggacctgaatgatgatgaaaaaagcaagcgagtcgattgggcattggatctggtgcatctcagcgacttacgggatcgtaagccaaaagagttgtcaggcggccagcaacagcgggtcagcttggcgcgcgcgttagcaaccaaggcgccggtcgtgttgatggatgaaccactgtccaacttggatgcgcagttgcgtacggaaatgcgtgaagagattgcgcgacttcatcgcgagattgggatgacactgatctacgtgactcatgatcaggtggaagccatgacgatgggtgatcggattctcgtattggacgatgaaaaaattcaacaacttggcacacccctagatctttacaatcatccggctaacgagtttgttgcgaagtttattggctcacctgagatgaatctcatgccaattaccattaatgacgatggcgatcgcttcagtatcggcgacaccttctggactgataatgcgtttgtcctaccatttgatttgccagctggttcttaccaccttggtattcggccagaaaaattggtgccagtgtccatcgctaatccagatacaattacggcaaaggtgaaaagcctgcaacagcttggcaatgacaccttgattttctgtgactttgatggacagacattagtcagtcgagtacccgagcaatttactatcgctgttggcgccgacctgaatctactgttgccggcaaatgctgatgaatggcatctttttgacagcaacaatggggtgcgaatcaccgctgctgcgccagcacgggaggcggttgaatatggagcttaacaaagaactcaacaaaaccgcaactgaatccaaaagtaaacttgcagcgacgatcaaagaaaacaataaaccggccttttggtttttaatgccgtctttattgattttaaccttattcacgttctatccgatgatcatgaccgtttacaatagtttctttgcgaccaatattcgcggagaagcggcgaaattcgttggtttggggaattacttctcgatttttcaagatcccttattcctgaagagtctcgcgggcaccttagtctatgttgttgcctttgctgccattacgattgttgctggcgttgtcttggcacggttggcaaccatgaagctacggcgaatcagttggttccaaacagcttttgctggcacgatgggaacgagcgctgcggcagctccattctctggctgtttctttttaacccgtctgttggtcttgctagctttgctttgaaagcaatgggcatgacgaatgccaacttattggttgacccaactggcgccatgattgtcatcgtgctggccagcgtttggatggcgttggggtttgccttcctgattttgcttagcgcctttcaaagcgtgccaccggaatattatgaagtagccgacattgctggttggtcgcaatacaaacagaccttgaaaatcacggtgccgatgatttcgccgactttattcttcctgtttgttgttgaaattattgacgggttcaaaatgttcgcgcagatagatttgattactggcggcgggccaaacaatgctaccaatttcttggcctataagatctatcaagacgcgtttaccttccacaactttgggaccgcaagtgctgaatcaattgtgctgacggtgatcattgccttagcaacttggattcaatttcattacacggaacggaaggtgtattacgcatgacccacatcaaaaatggttcgcggtatcttttattaaccgtggttgcagtggcattgctgttcccgattttattaggtatatgggcttccttgttgccaactaaagacattgcggcaggcaacttcctgtcgaccaacatttcacttaacaattactggcaagcatttgtgaccacgccgattatccgctacatgatcaactcctttgtcactgctggcctgattaccattggccaactggtgttgtgtacattagcagcttatgcgtttgcgttcataaacttccgctataaaaagcaattgttcttcgcctttttggtcacaatgatgttgccttttgaagcgcaaattattccaaactttcaaacggttaaggcatttggctggttggacaattatgctggcctaaccattccattcttcacctccgcgttcggggttttcatgctacgccaggcttttcttcagattcccgctgatctagtcgattttggcaactatctcgggcttggtcgcttgcagtttctgtggaaaattgcggtgccttatagtcgcagcatgttaatcacctttgccttgtacacatttctgactcattggaatcagtatctgtggccgttgattacgaccttctccgatgatttccgccccgtgcaggttggcttgaagcagttgcaatctgaagatacatttgccaactggggcatggttatggcaacagccatcattgtgttgctgccaacgctggcattgctactgattggccagaaattcttcaagcggaatttgaatgcaggggggactaaggggtgaaaaccacatacaaaaaaatgatcgcaattgttgctgcgttgatcgtcattttaggccttggcttcttcttcacgcaccaacaacatactgaggctgctgacaatggcactggtcgcacgactattacgttctggcattcaatgaatggcccaaatgaacaggtattggagaacttggttaatcaatttaataaaagccagacgaaatatacgattaaaccaatttacgttggtagttatgaactgtcaattatgaaatacgcgaatacggttggcagcaatgtctcgcctgatttagttcaaagcgatcaagcaaaccaatccatgatgattggtctaaacgcaaccgtgccggttcaaaagtttgtcgaccgtgatcattacgacttgagtcagctgtatcctggcgtaactgccgcttataaaattaacgggaagcttgcctccatgccattcaactcttcaagttcggtgatgtactacaacgaaagcttgtttaagaaatacggcgttgcagatttaccgttgtcaccaacatacagtgacgttactaaggcagccgtcgctttgaccaaaaagagtaaaggtgccgtcaaaggcatgacgatgcaaatttacggctggctgccagaagaaatggtggctaatcagaactcattggttgttaatcatgacaacggccgcaaagccatggccactgcagcaaccctcaattcgcctgaaatgcaaaagagcatgacctggttgcaagacgttattaagcaaaatgcgtttgaaaactttggcactggttctgccgctgcgaacaaccaaagtgcagcatttttagcgcaaacggacttttgcgatggcttcatcgtgttcagcttttttttgaagatcattagcggaccaagcatatcttcggttgaagaataaaaagaacaactgatgaagaacgtctttggtgcagtcaatgtgatagcagaccgctatttttttacttaacttttctgatagtaaaagggaatactgttcgtcgatttgatcgtggctagctaagcggcgtccttttttaagccttttaaaactgatgaacagcatcgtccgaagtttattcaagtaggaaaagacctgccgctcggggctctgtaaagacggaaattgggcgaaaaactccgaaataagctcatctatgacccgaagttcctgctcaggcgcgacaagatcaaggacatcatacttttcaagcaaatagcaataataaaaaaagcgaatctttctctcatcgccgaccatatctactgacttggtatcaatccaaaaaccgtatttttccaaagtttgattgatgaccgctatcttcctttttaaggttgactgactaatgaaaagtttttcggctaaaacagccagcgttgcatatcgatggatacaaatattttcgatgattaaaaagtgcgccgattgtttatagatcgatgcgtagatataaaaagaattgagttgagcgtcataggtcaatcggataccaaatttctgactactttcaattttagcgggattaatgtattgattaatttccccgatgctttggcgaatcgttctggatggaatacgcaatgtatgagcgagttcgccaattgtcacccattctcggccaagtaaaaagcgaacaatccgaaagtgtctaagcaaattgctttctaaaagttcttccataaactctctttctttgcctaacgttaggcaaaaaatgaacttcaactaggcgggaaattagattatactaaatttcattgttagaaattgctaatattaggtgcattataacaccgtttcgatttggaattcaattgggaaggttgaaaaattgcatgcaaaaaaacaaaaaattgaaactggtagtcttactgcttttattagttgggattgtcagcattggaagctacatgtacttgcacagaagcgttcccaatgttgttgcaaatggaggtggtgctgaagacacttccttcgtgaagaatatgacggatgaagaactcaaagaatatctgcaagaaaaagccgacaaaagcaaatttcatttgaagcttgatacgaatatggttttcaatgcagcaaatgaagtcgggacggtcaatatcttgaatcctgcgagcaaccagtacggtattcgggtgcaaacacgattagaaggacagaacaaagtcatttacgattccggcttaattaagcccaaacaatatgttgaggctggtgaattgaaagccaatcttaaaagaggcgtttataagacacaaagcaccgttacctattatgaacttgccgattcttcaacaaaaatcggtgaaaccgcagttgtcggtcaattatcagtgaataactagtctgctagttatcaataaaagcaaacccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgcttcttgtttagctagcactaacaagaataggtcttcatggcctttatggtctagtcgtcagggtgttgcacttgaattgtaaactggggagtcattttttctgctatcatattgtttattaacttttgaccctaccgaattttcgaaggagtccctctctatatgtcgcgatttaaaaagcatcgaacatggccattattgctcatcagtttcagcatgaccttcaccatcagtctgatcgttttcgccgcgttaaaaatggcgccttttggctcgtcatctattttggcaaacgattcagccgttcaatatgttgatttctttacttatctgaaacacgccttaatgggcacagctggcaaagcttattctttctccaacagtcttggcggcggtatgtatgcaaattggacctattacctgttaagtcctttcaacttgatcttcgtgcttgtatcgcgccaagccattcccgtggccatgctgtttgtgaccgcgcttaagtacagcaccgcggctcttgctgcgcaggtattggccagccatcgctatggcaaaaactggtacaccttggtcttcagcgtcagttacggcctttccggcttcctgattgccaactttctgaatatcatgtggatggacggcgtgattttattgccgctcgtgattttaggcattgaccgcctctttgaagaacaccggctcatcccctatgttgtgccattaagcctaagcttcatcacgaactattatattggtttcatggtcgccattttctcggcgctgtatttctgctggcaatgggcgagtcaccatcagcctcaactgctgcgcaaaatcgcgcttttcgtcggcgggtcgttactgagcggtatgatcggcgccatcgtcttgatccccacttatctggccttaagtgcctcacgtctttccagtgctggtgcggatttcaccatcaaaccacttttctcgctgatcgatctgccgtcaaaattgattcctggcagtttcaactttgcgcagttatcaaatggcctgcccaatttatacatgggcatgatcgccctcttaggcgctgtcttttacttcttagctccagcaatctcggttcgcgagcgtttgatttccggcgtgatgactgtgattctgatgctgtccatttggctcaacccgcttgtcatcatgtggcaaggttttcgcgcaccggtttggtacctttatcggcattcttttattgtcattttctggttgttattgctcggtttacgcggtctcgccaacctgccatcagtctcacgtctacgaatgatcatcgccagcgtggttgtcggcggagtcgtcttcatcccaaccgcttggcgcatgggcagtcacaagtatgtcaccttgaccaacctcgtcctcggcggcgtcttgctcttagtagcggccatcttactgtatagttgggcgcatcacctgttcccacaaaaatgggtggttggcggtctcctaaccttgctggtgctagatatgggcgccaatgcatacgcgagtttcaaagccatcagtttcatctcaaaagcagacttcaccgttacaagcaaggcgcttaacgcggcttacaccgaagcgaaaacactggcgccaaatactttttaccgggtaaacagtgatacccagcggtccatggacgatccttatcagtacaattttaacggtattagcaccttctcatccgtcctcaacactagcacgatcaatgcgttaaccaatgtcggtgccattggctcagccggccgcgtgaaaaacaacgatctgacttggccgctcgaaagcctgctcggtgtccggcaactgttgctggtcaatacgcaaagcacgaaaacgacaacgcctgaataccagcagatttcttctcgaatcattgacaacccccgttatgatctaccggcatacaagttgatcggtcataacgattatttcaatatctaccaaaatcctgatgcgctccctgtggccacccagatttatcgaaaagtaccgacacaggtgcaagctaatcccgtgcttcaacaaaatgcctacttcagcaccttcacaccggaaacaatcggcgcaattttcacaaccaccgatttctccggcatcaccgttgacaacgtgaagccgctgaccaccttgaccaatgccattgccaccaaaaaggataaaaagctcggcgcgacgattaccttaaacgtcaacccgagtaccgagcagcgttacttggtcatgagtgaaaacatgcgcaaaaacatggccatcagcatcaataatgtgccgctcaaaaacgatcctgacaatggcagcaaaacggtatcattacctattgacgcggaaaaaccgactactgtcaccttaacgttcaaccgcaacattgatcagattgatctcgatcattttgctttatataccctcaatcgccaaccattcgaacaggcggttgcggcggcaaaacaacacgcgcctaagcaagtcgtcaaaaacggcagcgtcactttaaccacccgtcaaaacaacagcggctacatcatgttaaccatcccctatgaaaaaggctggcaagttgataacaagcaagtgaaaatccaaaactatcgcggcttcatcggactcaaagtcccttcaacaaacctgaaattcaccttgagttatcacacccctgggatcaaagctggctggaccgtgacaagccttgggttaatcggcttaattgtcctcgctttccttgaatactggccacgaaacgggaaacatgccagtctggttaactggcccgcgcgctttcggaaaatgtggcagtgatcagcaataggaaaaattgaaacggctaggatagttgaggtaaaaatcctaggccgtgccaaactccgccagctccgccttggcactaggatcttaaattccgactgctgacaaaaaagctcaatttttcaaagggtaacgattttgttcgaaagcgttcttaagcgatcattcagccccaaacgtgctgaaccagtctttaatataatcatattcatatttataatctttcctgaatcaaaagattaatgattaaaagataaaacaataaaaatatgtgctttcattcatcgaaatggttgcgttttctatagtcatcatgctaaaatacattgaccagataacgcatcacaagcgcatgttactgcttatgcaggcaagacttggattatcgtttcatcgcaaacgattttcttcagtctgcctgcttttttgtgccaccaaacaggcgcttcacaacaactggcacgcgtcctttgcaaaacttgcggtcagtggcggcccgcaggcatcacacgaacgacttatgaaaggggtgtccgatgtttcgcatcaaaaaagtgctcaatgtcaatgtcgtcctcgctgaacaggacggccacgagtatatcgcgtttggcaagggcattggctatcggcaaaaagtgaacgcctgtcttcccgacaacgcgatcttcaaaaaattcatgccgctggatgacagtcgcaaaagcgaaatgatccaatcgctcaataacataccacctgtttacatcagcattacctcacagattgtgacgtatgctgagcagcaactgcagctgtcccttcttcccagtatctactacgccttaacagatcatctggctttttcagttcagcgctatcacagcaagcaatcactgggtaatcggatttattgggaaatgaaaacctactaccccgaaatgtttgccattggcgaatatgggctgacggttgtcgaagcgaccttgcaattggcactcccacgggaagaagcggctaacattgccttccacatcatcaatgcaacaccagccgcggccggtaaagcgaatattttggaagtgacccagcttgttgacaacgtcttgcaggcggtgcgtgcgctgactggtggcacgattgacacgacgagtttgaattacgaacgttttgtcacccatatgaaattctttgctgagcgttaccttggtgataccatgctcgctgatgatggccaactactcacaagtgtctacactgtgtatccggaagcggccaaaatcgcacttaaagttcaaaaaaccattattgctatctacgaaaaagaaccgactaaggaagagttggcttatctcattattcatatccaccgggttttaactaactagtcatctcatgccttaccccaaccataacgcgcccccagcgcagcaaccgcgctggctcgcgctcactatccgaggaggaacacaacatgtctgaccatcaaaaaatcaccgatcgtatcatggcagcggtgggtggtaccaaaaatgtcaaaacgctcaatcattgtgcgacacgattgcggttcacgctggctgataaaacccagttcgatattcagcgacttgagcaaatgcctgaagtgctgagtgccgtgaactcaggcgacgaatcacaggtcgtcatcggtgccaatgtgactaaatattatgccgaaattaccaaaaactatcacatccgcgaagctggtgatggtaccaaacctagcgcggatcatgaaaagaacattttaaaacgggtcctgaatgccattgtcagcatcatggcgccaattatcactgtcttgatcgcaggcggcatgttcaaagtcgtgatcgcgattctcgccttgttcggccttgattccaaaggtgtcccctacctgaccctgagcttcatggccgacgcggctttttactttctgccattcatgctcgccgtcagtgccgccaaaaaattcaacactaatacttacttagccatgatgatggccggcgtcctgctacacccaaacttcaccgcgatggtcgcagccggcaaacccatcgccttgtttggcgcaccaatccgcctcgcttcatacggtggcagcgtcatcccaatcattctgatcgtctggttcatgagctatgtcgaacgattcgccgaaaaaatcgcaccgaccattatcaaaaccatgctcaaaccattattagtcgcgctgataacggcccccgtcgccttaattgtcattggcccgatcggtagcttgctaggagatggcctttacacggcagttaccttcatcaaccaacacaccccatggctggtaccaaccgttgtcggtgccttaaccccgctgctcgtcatggtcgggatgcacgtttccttgttgccgctagcgacgctgtcaatcaccagattcggcagcgaaaccatcatgggccccggcatgctcgccagcaatattgcccaagccggtgctgcagccgccatcgccttccgtgaaaagcaggcacgtggccgccagatcgcgctttctgccagtgtgaccgccttgtcagggatcaccgaaccggcgctttatggggtaaccttgaaatacaaacgggctttaacctgtgtcatggtctcaggcggcttggctggccttttcgccggactcactggtctcgtgcgctactcgtttggctcacccggtattttcaccttgccagttttcatcggcaataatcccgccaacttccgcaacgcgcttttcactgttgccattgcgttcggtctaacctttgtctcaacctatctctttgccattgtcgagaaaaagacccctgtcgacacgaacgagccagccatcaagtgccaaaacctgaaaagtgtggttactggaaaactgattcccctcaaagatgtcaatgatgatgtttttgcttccggctccctcggccatggcgttgcaattgctccggaagacgacctcatcgtggccccagtggatgctgtcgtgaccatgacctatcccaccggccacgccatcggcctcaccacagccaccggtcaagaaattttgattcatgttgggatcaataccgttaaaatgaacggccgtggctttaaaacgctggtcaaggcagaccaacacgtcaccgctggcgaaccgctgattcaaattgatctgaacctgatcgagcaggaaagcttcgatccaacggtgatggtcttgctgctaaacaccccagctgaccggattaacattcaaaaaaaagtgactgtgacgactgacgaccacttgttaatcgtcacccaagccgtttcagaagcgtaagacagagcgtgaacagccgcggtcagaagccaccttatgtgcaggcttctgagccagtgaacgcgttaaggagaaaaattatgacaaaccaacaattccccgaaaatttcctctggggcggcgctactgccgctaatcaactcgaaggtgcttttcaaactgacggcaaaggactctcaactagcgacttgctgctgggcggcgatgtcaacaccccgcgtaaaacgacccgtgagttagtccctgatgccttttacccaagtcatgaagccattgatcattttcaccgcttcaaagaagacatcgccttgtttgccgaaatgggcttcaagctctatcggttctccatcgcgtggacgcgtattttcccaaccggattggaaaccgagccaaatgaagctggtctggccttctatgatcaaatcattgcggaactcaaacgctacaacatcgaacctttgattacgatttcccacttcgaatcgccaatcggcttaacaaaggccttcaatggctgggcggctcgcgatatgattgccgcttacgtccggtttgccaaagtcatcatcaaccgctatcaccaagacgtcaaatactggctaaccttcaacgaaattaacatgctcacccgccccatgggtgcctatctggcaggcggtatgtatgtggacgattctgatcgcttcatcagtccagatgtcgactccgaacagctgcgtctgcaagcactacaccaccaattcgtcgccagtgccttagtaaccaagtttgcccacgagctcgatgcaagcttgaaaattggctgcatgctggcttatcgcatgttgtacccattaaccagcaaacctactgacattgcgctcgtccaaaccgcgacagaatttaataacttctactgtggcgacgtacaggtaaaatgccgctacgcctactttgccaagcgctattggcgtgatcacgacatccagctagatatcggcgctgacgatgagacgattcttgcggctggcactgttgatttctacaccttctcctactaccaatccagcaccatgaccaccacgggtgaaggcgagcaagcaggcggcaacttcttcagcggcgtcaaaaacccctatcttgatcgtagcgactggggctgggaaattgatccacgtggcctgcgcacagcactcaatcaaatatatgatcgttaccatgtaccattaatggtcgtcgaaaacggcttcgggacacgtgacgaattgatcgaaaaagacggcagtaaaaccgtcgaagacaccgaacgtatcaactacttgcaagcccacgtagccgccatggcagacgcgattcaagacggcgttgatcttatcggctatacttcatgggcgcccattgatctcgtctctgccagcacaggtgaaatggcgaaacgatatgggtatatcttcgttgataaacatgatgacggcagcggtactttggcgcgctatcgaaagcagtcgttttattggtatcagcagattattcagcaaaacggtttgtaataacaactgtttttaatgcaaccttgcttattctcgattttccgggatgaacaacaaaatgcaaacagccgctcattctctgacttgatgccagaagataagcggctgtttttattgatatccatcatcaaaaatgtctttaaagacaaccgttttgtttcaaagcattgtgttaatcaatggaaaacggcttttatcaaggtgctttgacaagtgtccaagtagcagttgattggtaagtaccgggtggcaagaatgtcaatggtccgtacaaaaattgtccggttctgccgaatgcgtatggttgtcacttaaattcacgcattatcagatcttttatcagcgtttaatcttgtttaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctaagcactccacaacgaaccgggttgaatcttaaccattgatggtatctcagatccctgggttcaaacaaaaatagcgggcgaccaacgcagttttctgcgttagtcgcccgctttggtttctctattaaacacgacacgtggcctgaatttctggagcccccggtaaataagcctcaatatctggcgtgttacgttgcgtgtaaaccgttagtaatggttaaaaatacttaaagacgtccagtttatttaatttttccatttgtacaataccaaaccagatcgtattagcctttgcgcctgccgttggttttgtgaacagacttattctttcgcaccagcgtggtagagtggatctgttgctcatcgtggttattgtgtaaaggtagatcacaatgctcaaagatctggtaaacccggtcctttagattaagggcattgttaatcacattgcgtaataattttaacggtgatttcttgattttttcctcgattaactagtcggctttgtgtttctagtgcgttagcttttcacaaccggggtcttaaaaagatcattcaaggcttcagacattgttggatgagtatagatcatgtcgcgtaatctttcgtaaggtaatttggccttcattgccaatgcaattagattgatggtttcatgagcctcagcggcatacaatgttgcccctaaaataaggtgtgttttttgatcaacgcttaccttataaagcccgcgttgatcctccaagacacgggcctttggaatcgccttgactgatagcttgaaggtttgtaaatcataacctgcactcttagcttgacgttcatttaagccgacgttagccagtggtggatttaggaacgaagcagtcggtatcaccattcgatcggccgttgagcgatcccccttatcaaacaattgatctacaataatacgaaaatcatccaatgagacataagtgaacataggaccgccattaacatcgcccaaagcccaaacgttttgtactgtggtccttaaatgatcatcgacctgaatagcaccacgactggttaaagcaatatcggtattttctagccctaaactatttatattaggccgccgaccgactgcaactaataccgcatcaaattccgcagtgttactttgatcaccttgttgataatataatgtaaccttctcaccattatcttttacttgagttagttgagtctccggtttaatctcgatccctgcgtcagtcagatctgctacgacctcggtcgcaatatcaggatcttcgcgctctaacaatctggtatgttggtcgaaaatcgttacatgcgtaccaaaggaattaaacattccagcaaattcaaggccaatataaccgccaccaataattgctagtcgtttcggttgtttctccaattccatagcttctttagacgtaaaaatccgctgaccgaattctaaccctgggattgatggccaatttggaaccgctccagtattaatgaagatgcgctcacctctcaccttcttagttgttccatcactcattacgactgccaaaacataattgtcgataaaacgtgctgacccatcccaaattgttgctagtggctcatcagccaccatgtgatagtttttgtctcgcaattgtctagtcatctcaccacgcttattaactgccgtagtaaagtctaagccacgttgaccatttaaaattaaatttttagatggtaggcagccaacattgatgcaagtccctccatacatttgttttgaccgttcgatcagaagcacggtctcatcatgctgcgccaagtacttagctaatgtcttacccgccttaccaaatccaataataatatttttaaatttatccattgttttacccgccttttactagtcatttgttattgcacttattataagtaagtaaagcgtcaaaagcaagttatatgctcaactacctatttatctgacttgactttatagtcatcatttcaccatcttatttgtcttttaccacagttttccctctagtagctgattttatgaccttctttacttttataatcgtactgtctggtagggtttgcgcccgctcttggaccgccctactggacgcttgttatttcccattgcagcagtattattagccttgcttgctgaccttgctagtgttgtagctttcctttgctgtcaagagcgttttattgctcttggttgatttttaatttccctgtataatggattgagcaagaagttttaagggcggtggctgtcttttcccttgtgaggtgaggcccatgggaacatggaataatcttcaggaaggtttcacagtcaatgagcgtcttccagacactctcgttgctgtttggcacgtttttaatcgcgctactcagctatatcgacaagcaccacaaataaaaatgccgccctgcgtaacttttgtcggttacagggcgacaatgtagttttgtaatctaggccaccgcctttgaagcggcttgcacgggaagtcctgttctagcggggcttccctttttctgtctacattatagcatgactataatggactttcgactatttttaatcaactttctgccagtttttagggaacacacgtttgcattatatgctacaatacaggtaaaagctaacggaagcgatctaaatgttttttgatgatgaaccgcatggcgtgttcttcttaatcgataacaagtccttttatgctagttgcgaagccgttgcccggggccttaatcccttaaaagtcccgttagtggtccttagcgaagctgaaaatactaatggcgggctcattttagccacgtcacccgaagctaagcacttatttcatcttaaagccaacgtctcccgtaaacatgacttacccaatgaccccaggttgtgggtcgtgccaccgcgcatgaacctttatattcaacgtaatttgcagatcaatcagatctttcatcaatttaccactgaacaagaggtttggccgtattcgattgatgaaagcattcttgatatgacctatacttggcggctttttggcaattccgttcgcgaagtggcgcgcttgattcaaaagacagttcggcaaaagctaggcttgtataccaccgtgggaattggtgacaatccggtgcaagctaaattagccttagacctttacgctaaacataatcatgaattgatcggtgaaatccattacgaaactgtgccagataagatttggtcaatcaacgaattaacggacgtttgggggattggcccccgtatggctaaacgtttgaaccggcttcaaattcacaatatgtatgagctagcccacaccaacccttatttactcaaacaacaacttggcatcattggtagccaattatttgctacggcctggggaattgatcgcgcaaaagtcacggaaccaattaatgttaaagcagctagcctggggaattcacaagtgctaccacgggactattttaaccaagccgaaatcgaaacggtcattaaagaaattggtgaacaggtggcggctcgtctccggcaccatcataaactggccggttgtctatcgctaagcattgggttttcctatgccgcagctgaagcagatggtcgcggtggttttaaccaggctttaaaaatggaaccaactaatgacaatcaagttttgacacaacaattattgtggttattccgtcagaattgggacggtcaagctgtccggaatattggtgtttatagcagtaaactaagtgccaattccgaccaacaacttaatttatttgaaaccccgcacaaccaaattcgccgtagccggttaaaccaagtgattgatgaaattcaccggcaatttgggttcaccaaactagtttacgcgaccagtttattaaagggaggcaccgctatcaagcgggcttcactagtgggcggacataatggaggcaatagctatgaatagcgatatcgagattattaagggtcggttaaccttattgtttaagcggcgtccccaaacccgctattggttaatgttgactaatgacacctacgatcagacctataatttgtttttcaacagtcaacgggctaatgagcgcttgcaatccgttcccttgcataaattagctaactatgatttagctgatttagaaaagttactaaaagcattacgacaagatataaagctaacgatcgaatttgtcggctttacaggagatcggtggccagcaagtcaacagctgattcaacgaaagcgggtgccccttgaataatcaagaatttgatttagccacggttaagcatttttttgaacatgattaccatgaccggggcatgatgaaatggcagggattctatttatccgatcatactgccgcattaaaccaacagaaccagcagttgaatgcagtatacgttccaagaccgcaacaatccttagcagtaattaccgaggtattggcggacgcatatcagcgtcagcaaccagtgaccattcaattaaaaacggttgaccaaaacaaccgtcatttgccagatatcaccaccttgatccgtggctacaatgccaatgatattgtgattgacgctgatcggtttatcccactacaagaaattcgcaatctggcctttaaaaatacggagaagctataaaattctagctctccgtatttttcttaacactttatttgctggctctgttttttctaattgctttattttagacagttttacttcaatgtaggcaaaagaattcacagaccattgccattaattgataacgtttttcagatctcctgataaatatgcttttatattatcaacagtcatatgcaacaaccgttctcttgtctcatatggtgcccaagcaatatgtggggtaatataacaatttttggcctgtaataatgggctatcactagcaatgggctcccctttaacaacatcagtggcgtaggcataaattttgccttcattcaaggcattcttgatgtccgcttcattagccaatttgcctcgggccgtattcaatataataaccccagttttcattttggcaatcgtatcattattaattaaatcaattgtttctggtgtttggatcacatgcagactaagcacatcagattgccttaatagttcatcaaatgaaacctgctgaatccatgattcaggaacctttttaggacgatgattatagaaaataactttcatagaaaaagcgtgtcctattttagcaactttttgcgcaatatggccataaccgattagccctaaagtttttccttttaattctaatagcggtttttcccaaaaagtaaaatcaggagcctgtgcccaccggttttcatgaacaagctgattatgcaatccaacttggctagtcacttctaataataacgagaaagtaaattgtgccactgcgtcacttgcatatgtgggaatgttagtcaccacaaccttgttctggtgtgcgctctcaatatcaacgacatcataaccggttcccatgattccgatatacttcaatcgtgatgttttgctaatcacttcatgatctagcggtgttttgtgtgtaatgacgatatcagcatatttaattcgttttatgatttcagcgttatcgttaactggtgtacgatcatataaagtgcagtcgcctaatttttgcaagcttttccaatttaaatctttgtttagttcatatccatctaaaagaacaattttcatagtgttacccccctatcttttcaatgttttagctgcattatgttctggttgtttaattgccgggttttgttcagaaaatgctttcagttgtttttgcgttcgattactgatttcatggtgtacatcatttaacttattttttagtcctaacttttgttgtggattagtcgcttgctgaacttgttgttgcaagccttgataggacttattaagatcatgggctgatagcttttttagatcatgcgcaggctcttttggggcttcttgtaagcctaattgtttggttaagccatcgctaagctcaatcactttgttgctcacttgctggatctcacttaaagcgctatggattacggctttatctttggcccaggtggccacgtaaccgagtgagtagttgctggtatcaacgccaatattttgcatggcaacatatgcgaccgcttcggcttgcgtttcttgataggctcgccggcgatctttaaaggctgattttaacccatgtaactgactatgcgcatattcatgatataacgtcttcaattttaaagcattatcgggctcatcgccaccaatgacgatttcattagtgctgggttgaaaataccccttagccccatttagcgtctctaaaggcacttcactgactttaaggtcggtttgctggtttaaataatctttgaacgcgttatacaagctcgttacattctgatgatcggctaaattttctttgacaaaatccttggcacttaacactggctcaccgctagtttgtgccacatcaaagacgggtagataacggtaaccgacaatggcgcgttcatcggtggtaccaagatgcttctgctcggctggtgttaacttcttaataatcggggccgcaatccgaatcgcttttgcgcctcgtttgacggtgcggttaaaagccgtctgccagtgcttaaagcccgcgacttgagtggctttcggattttgcgcataaatcaaatcaatgtttctggcgctataatggtgaaatttagccagggtattaagatactgtttaaatcggtcactatcggttaattttcggatttgttgttcggcttgggcgactaattgtgctttccaggctttaacgtctgctttactcggcattgtctacccctcctcatcttcaaaaatatcattcaatataggggctacgttgatttgaatcggggtcgtgccataaagggcgatgtagccatcagctaatttttgccaagccacttgataataggctccgttaccagtgatttcttttaaatacttgtaggttcctttagcctgtaaaactggtaattcactcccaatgactgctaatttattatccattttatgatttcctttgctttgctaatctcacccgttgtttgggtttacttttagaacctgtctagtatcttttaagaactatcttcaggaaggccaatacaaccatttgaagactgctgttaagggcacgttcacagtttttccaaagtcgccgacatttgtctagccaactccatgaacgttcaacgatccatcgttgcggtaactatctgagatcgttcaattaaggttataatggccatgggacctgtccttctctctagatggtatgttatgcaaacaccattttagcaagaacggacaggtcttttttcacattttctgggtggtaactttaattatgcaatctaggaaagaatgacattcaatcaaatccgatttattttctcgaaatatctaataagactaaacggtttgtgacactagctctcttgcctgaagaggttgctgcaaatctttaatcaccacacacattctaagatccggaaactgattgacaaaaagaggttctcaaattgatctcccagatgccaaaaaacgcaccaaggtctggctgctatgccaaaccttggtgcgctgcatgttttcctgcaaaactgaatgttcaagttaccttttcaaaccatcttctcatttcaaagcactatgattcatcgtcaaatcgtgctaactgacgttccagtttctcaatttcgccttcagtttcttccagcgcccccatgacttcttccaatgtcaagccctcagaactatagcctttgtacttggcactaatataatcttcgtctgctaggcgccgtgcacgttcacgcaagtcgcccagttgcgtcacaagcgtatcgaaatctgcttttgccattcggtcacctctttacgctaaggcatcaggtgctgctaattgtgggatcttgccttgtcgcgccaaaacccaattatcgtagttccacatttcggttgcccgtcgatttctgaagtaatcccaaaacgactcgcgctcaatttcaataatctggttgtctggcccgatggtgacccagttataggaaccgttgcgatgggcaaacttgatccagtaaactggcgcgctgacctgcatcccgttatcttcataatggcgctcttgctgctcggttcgcatgtagcttaaaccatctgcataattttgatctaactgactaaataacgttatcgcctggcgtagcgctttatcaggtgacggcagtttaccgccatttttgaaggtgctggcattaaaactgatcaagttgccgtttctatcagtcacaagtgtcagatgcttgttattcggggtcacttcatcatcgctttggtaacggtccaccgtcacctgcactttatttcgcttgcggacgtctgtttgaaccacgtgataatcttcaggaattggcaataaagccatcatatcgtttttcaaaattccgaccccttttcagtttcgttaagcacatcaagcatcctgacaaattcaattttgttagcttcagacagttttgctgtcaaagtggcttcataatcggccacaatttgcgtcaccatcgggatcaagcgccggccttttggcgtgaggctgataatccaagcacgtttgtcctcgtcggatcggcgttttgcgacgagtcccaacgcaatcagctgggccaatcggcgtgtgacgttgctgggattaaggtgaatcgttttaaaaagtgtttcctgccgcatttcatcgactttgccaagcttcaagataaagtaatagttactcgcactgagcgtggttggcgctaacgcaacatccaagtcgtgttgaatgtggcgcgctaggatattgactcttgaaagcaattcatccggttcttttggcattttctaccttctttcgtaacaacatgacggcgatgaaaaacagagcagctgctagcatgaagctgacaccctgcgcaacgaacaaagcttgcggagcggcgtggacggcggtggtgtgcgggctgacgatcccgagggtttgatagaacactaaaccggcaaccgcgctaccgatactcatccccaactgtctagcaagtgaagtggccgcgccaacctgcccccgcatggtcgcatcgacactttgcatcaacacgacactgttaggattcgtgaacagcgctgtgccaaccgcaaacgcgactgacacgataacaaacggccaaattgtcgtttgatgaggcagcaaggcaaaggccacattcgtcagaaccagcatcagcaagccgattcgcatgagtcgctggcgatcaaagcggtcactaagcaccccagccactggattggcagccaacgaaacaagtggtgtcagcatcaacaaatacccagacaaggccactggcaagcgtagcatcaactgtagataaatcggtgcgagcagcgtaaaaaaataagccgcaacatagttcaaaaacgaagccgctaaattccgtgaaaagcgctggttgctgaacaaccgagtatcaagcattgcttgatcagtctgccgctcgtgacgccaaaaccaataggcgcagctgccaatcaaaatgaccagaattccggtgaacaacggttgcttgttgatctggatgagcaacaacaacccgccaatcacaatcaattgaaggaagccgcggccatcgacgccccttttcccagagggtgcgtgtgttcgcggaaaaaccgcccattcgactagcaaacacacgataccaatcggcaaattcacccagaaaatgtagccccacggcaactgactcaggatcaggccaccgatcccagggccggccagtgcgccggctgaaatgaagatcgattcaatgcccagcgcacggcccaaaatggcgggtgggaaaacgtccgtaacaatcgcataactcgtggccatggtcatactagcacccactgcctgcactactcgggcggccaatatcaactgaaagttaacgccaaaaccagccaacccagagccaatcagaaacagataggtgccccagatgaacagccgcgttcggccatattgatcagccaactgaccaaagaacaacaggcaaacgctgatcgtggtgagataaaccgtcagcaacaagttcacctgactcggactcaccgccaaagccgaggcgatggtcggtaccgcaacgacaacaatggtgccatcaataatcaccataaagaagaataaaccaagtgtgatgagtatgagccagcgtttgaacaatcactcacctccctgtgaagtattataggctgttttatttgcttgcgcaagcaaatttactgatctttaacgccaacctttcaaccaatttaactcaccaccatttcttcacaatactcgaacgagtagaatgaccatatacacggagcaaaatcaggaaatggggaaactatcatgaagaaatcgaccctcaccattattggcggtgtggccgcggcgattgtgatcattgctggcggatttggcctttaccattggtatcaaggcaaaaccgaagctgacgcggttcaggccactgcgcaaacttatacgcaggcgtttgctaagcgccaatatgacaaagcagttaaacaagttgataccagccacttgactggacctggttggcattatacggccaaaactttagcggcgcgcaatcaggcggtttttgatcgggttggcgccagtgatatcaagattactaacgtgaaaaccaagaagtacgacagcaaaacctacgagctgacgtttacggccaacatgaacaccaaaatcggcaagctgagtgcgcaacactacgaagcgccgattgttaaagtcggcgataactggcgaatacagtggtcgccacgtctgcttttcccgtcaatggatggcaaagacacggtgcagattgacctgattgcggccacccgtggccagatttatgaccgcaataaccagttgctggcaaaaaatggcgatgtgacccaagctgggctggttcccggtaagctcggaaccggtgccgatcgcacagccaacttagagaaaattgctgccgcgtgggacgtcaaggtcactagtcttgaaaccttgttaaagcaatcttgggtcacagatgataccttcgtgcctgtcaaaatcgtcactgattcaccagtcatgacgggcgcggcctatcagacgatcggctcgcgcacctatccccttggcgaagccgcggcccagctcattggctacgtcggtaccgcgacggctgatgacattcgcaaagatccgacgctaacagctaatagcaaaattggcaaaactgggttggaacaaatttacgacaaacaactgcgcggcacagacggtggtcagatttcaattcaaaacggcgacaacattcacccgcttttaactaaaaaagccgttaatggtaaaagcctgaagctaaccattgatgccaaccagcaaaagacggcctacacccaacttgctggcaaggctggtagtgttgtgacgatgaatccgaccaatggcgaactactgactttagcaagctcgccaagttatgatccaaacgcctttgtcaacgggatcagccagacggactatgataagtatgccaacaacacctcgttaccattcctcagccgtttcgcgcaacgctatgctcccggttcaacatttaagatgctgacggcagcgattgcccttcagaataagacgatcaccccggacaccaccaagtccatctccggtctcaagtggcaaaaagacagctcctggggtgactacaaggtaacacgcacagttgatgccgcctctgaaaacatgacgcaggctttggtcaattccgataacatctggttcgcccaagtagcactgaaaatgggcgcctccgcttacctcaaaggcctcgcaccgcttttcaaaacccaggccgacttaccgctgaccatgaaaaaagcccagatttcaaactctggtaagctcgcttccgaaacccttttggccgataccgcctatggtcaagggcagctcctcttgtcaccaattgaacaagccgcgatgtacagcacgattgccaatggcggcaccatgcagcaaccgaccctcattcaaggcacgaaaggcaaacgaaccagcagtgtcttgcaggccaacgcagctaatacggttaaaacggcgctaacccacgtggtttctgatcaagccggaaccgcccacaatctcgcaattgacggccacaccattgctgccaaaaccggcacggccgaacttaagcaaaagcaagacactgacggcaaagaaaatggctttttagtcgccatggatgctgataagaacacctatctcacggtagctctgattgaaggtaccggcagcgacgatgtggtgacagcgatgaagccttatgttgctagtctttattaggtttgaataacagtaaggatgacccccatggaatgcaatgagctaccatcactttaagcagcatcttaaagaccacctgaaacaagtcaatgaagatgccatcccattagtcgtcactttcaagaatccagacgacaatgttgtggtgatgagcaaacacgattttgacgctaccgaagaaaccatgtatttgcttagtaacccggaactgatggcccgaattcgccgtggggacgcgcaaattacggctggtaaagccaagcgccagatctaccaaacgtataatcagggcgcgatagatcaactctcagttcaactaaaacaagaaagctggcaatcgtgtgaggtaagcacgactgccagctttcttgttttgattaaggtaggttttgctccagtgatttactcgttataccctcacttgattttcgctaacgccgcccgcacctcatcccccatcggaatggacgggaaggcgccaagtttctgaaccgtgaaagaacttgccatgctggcgtaggtcgcagcggtgacaatgttcttgaggtctgtctgcaagacgcttgccaaggcaccaatgaacgtgtcgcccgcggcggtggtgtcgacagccttgactttaaaggctggcacgatggttgcttcgccatccagcgagatgaaggagccttttgatcctaaagtgatgatcaccccgcgaatgcctaattcatgataataagctgccgaagcccgcatgctgtcttcatctaccaccggaatgccggtgatcagctcgctttcggtttcgttcggtgcgatgagatccacatttttcagcaaggctgctggcaaatccttctgtgctggcgctgggtttaagatggtcatcttcccagcggctttggcaattttgaaggcctctgccgtcgcatccaccggtgtttcaaattccgcgaccacaaagtcggcagactgaatcaagtcggctgctcgttgcacatctgctggtgtcacctcaaaattagcgccatgctggatgataatggaattttggccagaggcttgcagcaaaatgtaagcctgaccggtttgcgtgccaaccgttgtcgccacatattgggtgtcgatttggttcttgacaagttcaccgcgcatgaaggcagcgttggcatcgtcaccaactcggccaataaaactggttttggcccccgaacgcgcagccgcaactgcttgattcgcacctttaccgccagccgcttgtgaaaaggtgtccattttgatcgtttctcccggttgtggcaaccgttgaatgtgcaagatgctatccacattgatactgccgatgacaacaacatgattaggcataagatttcctccaattgaaacgcgctcgctcgtccagaaaacggcctgctcacgctctaattaaaaagggccgataagtcggcccccttttctaacttaactaccaaagtgccggttaattttaagcgtagcatgcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagctccaaattaaccagcgaccgcttaaaatactcgactggcaaacaccgtatcaggttatgctgacaaatttgtccaaaaattcggattaaatttgcaatctaccatataaacaaaatgtcattcgaagcaggaatatattatttaaagcatgtgtgtgctaaattaggattaaatgcagtgttctacaaaatttcggattaaagaacatgttatggctaagaattttggcctttgagtagttctcattactatacattgacagtataaggatctcaagcgactaaatgtttctcgcttctatttcaagcaagtagcaatttgatatctggtcaacaaggcccgaaattcggactctgttagctatttagatattgtcgaaacagtcattgaactacggagggagtcgcgaatcacgaccccctttttacatgattatcacagttcgcgacaaccgttcctcaaggtaacacttttagtttggtgatccagtgtgcaccagaatccgtctctcagcacacaaaaaacgggcatctctgcccgccaattgaaaacgacaagtcacgtagtcagcttctcaagcagaacgatctgctaaacaagaaactggctatttttatgaccaaagaggttagtgtaatgatgatactgtactgcctggatttcagcgaggcaaaaagtaacctggtctataaaatgcgccaccggttagctatgccgtgcgtcggttaaaacggatctacccgcttatcgccgaggactatcttaattagatcataacctgttggttatcgatactatacgtctgctgcaaacagccctcttaactgctggatcatgctaaccactaaatacggtggctcttgacttgctgtggtaactgctccacgattctgataccagaattcggtcaacatggccacagcaatgtcaaattgtgagtacgcttgtaacgcatcaattgccgctgtgctgtcaacggcattgtgaacatagtcttgcgccgctgtcaggtagttgctgatcaaactatcgtcagtatcagtctgcacacgcaggctatttttaatgtcatcagtagtgacagtcatgtgctcatctcctatataaaaataggggcgtaccctgaggcacacccccactaaattatgcgcttaggcctttaccggtgtgatgtcaacaattcgaacagcgtctggatcaaccacttcatagtcgttgcggatgacaaccgccaaaccttgactataactgtcgaaccgttcgaactgggtgttgacttcgttcttttgggctaagaaaatcgcttgggaaaagtccccgatgatgatccgataggtgcccgccttatcagtcggcaatactttgttagcaatcacgatcactggtgccccaaacagttgcttgcctgatggtgcagtgattgaaggttgtaacaagtatcggccctcgctgtctttcagtgtatcaaggtagttgaaagcatcctgattgacgataacagacaaggacagtgctggatctaactcaacattgaaggtttgcttgatgtcatcgagaccagtacccgtgatgtgcttgaagttatcgttggtgcccgtcttgccagtcagaacactgataatgttgctattgtccgtgttttataccagcttcttgagttgattcttaacctcggcaacaatatcaacttcactgtcttctaccagttcattagacagatagatcttgccagcacgggtagcaaccttgtagtcaacaccacggaatagggttgcatcgatctctggcacgtctgcgagttcttccttggtggctaagacaccattgttagtgagggcaattgggtaggtgccaaccggggtcccgacctgcttcacagtgacgtatttagccagatcataatcggattcctttagattccagacatcttcgatgacttctttaggaacgactgtaccagcagtggttgtcgttaaaccgtcacgttgctcacccatgctgcggatgtaatcttcatacgcgcgggactcagtgtgttctttgttgtcgataattgttttttcggtcatggttttatctcccttttctggttgttcagtattagtttttagccactcagtgtagctgcgtttgtccacttggacgttggtatcgtcatatgctggaatagccaccagtgagacgtcgaacagactcttcacttgcttgatggtacgaatgacttgtccgctgtcgtctttagtgaacgtgtcaccgtctggcgcagcattgaaagtaaaactcatggctgacagattaccagcttggacgttgttataagcatcattggctgtggtcgtatcgggcaaagttgcttcaaattgcaagcctttatcatccacgtttaaggtcaaggtgccagccttagtactggctaagacttggctaaaatcatggtttgaaatcatatagacgtctgatagatccatattgtcgaatgcgtgcggatcaacgacttctttaaaaccaccaagatccttacttggactattgaaaactactgcataaccacttagtttctttgacccgctagtggtgtcgtcctgttgctgtgtgtctggatcgtcttggtcttgactgtcgtctgctgtggcaggatcagcggtagttagatcagcgtcaggattcaggcgtttttctacgtcatcttgattcattagacgcacttcctttctgtttatcttgataagtgacaaggttgcttagtggcgtgtagttcagactggccataatctcatctccaccgggaattgatggcaggtttaacttggctcgtgcttcattagtggtcagaacaccgccttgcagccccttaactgctagttcttgcatcgtggctgggtctgcactgaacagcttgtcagtgttgaaactgaatcgattatcgccagtcgaaagcttagcgtccatctcactagtgaagcaggtaaaatactgaatcacgtgttttgcagatagatcaaattcgactgtacggcattagagtgctcgctttcgatacccagccgatccagtggtaacccgaacgctttggcaatctgtttcgttgtccaatcgctaaaattgactagattcagcacgtcagtattaacttcgagttgcttgtaatccatatcattatctaaaatgatggtcttgagggcattatcaccactgttggcagcttcaaatttattacggatgttttctttggccttggtgtctagctggatcttgttgactttaagaatgcctgtcccttggacaccggtgttaaagaatcccttcagtaacgcatgtccagacttttgtaccccaacctcatcacggaggctatacagtggtgatagtcctttgtaaccgtcttgtgtgaagtgtaagacctcactggcatttaaacgctgtgaacgaccgctgtcaggcgtgtattcgtaactgataatgccggtcgtatcatcttgtttaaccaccatttgactgttggtgactaactcgaagccagtgacttgtccgctaggatttttagtaacccgtgcaaagctgttaccattcagcagcatgttagcagctagggcaaacttgaacccccacgcggtcatgtggtcattgggtgctttgttaaggagcacgctgatgcgcttgtcactgtattcaatcggattggttgcaagatcactggcaatcacgcgcaccgccgtaaacacatccgaattacgtaaagcaccaatccccacacataagccgctgtcattgctggtcatgctgacaagcgcagctaggaacggttcgcttaagaaacgctgttggctggtcaaaaagtgagacggccagacgtattggtgttatcgttggaacttattcaaactgggaatatgggaaccgattcccagctcaagagaatattaaaaaaatttttaagacatatggtatttctcctactttgttaatatttggagatccttatagcaatgatgattattattttgtagccaagggacgtattttaaagtttagtgaggatgctcctgacgaagatctatatactgctcaagatggggaagaaataaagatcggcaatagtaacagagatctttttgtcggcattcaaagggggtctgaagatgctgctctttacgacacgaagcagggtataagaaatactagaatggattataaaagtcaccacgcgttttcagatattatttcaaatgctcgacttctgacaattccttacattcctattgatgaaaaaaggaagtataaagaaaacatcgtcaaagccgttgatatacttttgcaccaatctaattaaacagctactctactgcttccttacataccccgcccgcaagctggtacggagggaaaaaatggcaacaatcaaacgttacaaaaatagcagcggagatacacgatatgaaatctttgtctctgctggtactgatgaactaactggaaagaagcgccgaattcataaacgaggcttcagagacaaaaaagaagccgccctagcagcatccagatttaccttagacgctgatgcaggcagtttatcgactattagaagcatgacgttcaaagctgtttatcttgagtgggacgcagcatataagaataccgttcgagaaagcacgtacgagcgcacctatatacaagttaagaaacacgttttaccgctttttggtaataaaccgattaataagatcaccacagcgcagctacagcaagccgttaaccaatggtcaaaacaagtcactaggaactaccgaagatggcttacaactaccagtcgtattcttcgctttgccttacgccgtggttacattaataaaaacccggctgaccttgtcatcattccaaaagagaaggaacaaattggtgatgttgctgcgaacttttgggataagcaagagttaacaaggttcttcagttatattgatgcaaagcaagaaccacagaagacttcgcttttcagaatactagcctttggtggccttcgacgtggtgaatgtctagcactgacttggaaagatattagctttaccgacagcacaataacagttaacaagacactatcgcaaggcatgaacggccgtcagcttgttcagccaccgaagacacggaaaagcagacgtactataaccatggatagcaaaacaatgtctgcattgaagcactggcgacttgttcagctacaaaagtatatggctttaggatttaacaccaataaacccgatcaactagtattttcaaaccgcaagaataagcacctgctgttacacaaacctgctgattggcttaaatcgattgaggatgctcacaagattaaacaccgcattacaattcatggcttcaggcattcacacgcaagcgccctgttttctgccggggccactgtcaaagaggttcaggaaaggctaggccactcggatgttaaaaccactctcaatatctacactcatgtaacaaagagtcagaataaagaggcagttaacaagctagtcgcatatctcaatttttgaccaaagtgcaccaaaaagtgcaccacgcaagttttaatggcagcccaaagccgcactatcgctgatataacggactcataccaggaagggggttcaatcccgttaagatccatgagtgattttcttctggcaattagcttcaccgagcatcaaacttgcgctcatagcctaaaaggaatagtcaacatttcttgctgggcaggcagtgttgatttcgaaaaacgccagcgacagttagacaatttagtctactgtcgctggcattttttgttgttagcatttaccaaaacaataatcatcttttccctgaaacaaaaaaatgcccaacccttatcaggtggacattttctctgattatgcaaaagtagttttaatctgcatctgcttgacatcagccatcgtttgacaaccggttagttgcatagcgatgttgatttccatcttcatgtgatcggctaccgccttgacaccttcccagccgccgagggctaagccataactgaatggccggccgatgccgacaagatcggcgccgagggccaaggccttcaggacatgggtgccgcgttgaacgccaccatcaaagataattggtacgcgatgatcaactgcagccgcaattgctggtaaggcttcaatcgcacctggcgcaccatctagttggcggccaccgtggttggaaacatagatgccagctgcaccagctgtgatcgccgcaaccgcatcatcaggatgctgaatgcctttgacaataattggcagccctgaataagaggccaacttatcgatggttgcaagatccagtttctgcatggattctttaaacaaaccgccagcgccaactccctgctgcccagtattgtaaccttcaagattagctaagcggcctttgagatgacaatgattcatcacgtctttttcccgatagccgccaagtgtcgaatcggctgtcagaatgatcgccaatgcgcctgcttgttttgcctgatctaacagatattggcaatacgaccaatcttttggcatgtaaagttggaacatataagagcctgtttagtgtcttttgagcatgaagcgaagaaaggctaacgttatcatcattgtactagtgtgaagcttgcctatctgagatcgttcaattaaggttataatggccatgggacctgtccttctctctagatggtatgttatgcaaacaccattttagcaagaacggacaggtcttttttcacattttctgggtggtaactttaattatgcaatctaggcaacagtaaacagcgaccagttctcgctccaccatcatcctgcgattgtcaattgctcatcaaaaccaattcggtaacacctaaagcatacgcaccaaggtctcctcacccataactggggccaccatacgctaatcaccaatcgcatcaaaaagcacaaaaaaaccgtctaaccatagacggctttcattgaaacaactagcaaaactaacttaactgtgcgcgtttttaaacacttgaggtactgagcaacgccgcccacaacttctggcgccgaacttcgcgtggtaaaaatacccgcaccgagtcctgattaaacccaaataacagacgacgatcgtccacaatgatcggccggcgcaaaatcgctggatgctcggacaaaagggcgaccgcttccttcaacgacaacgcatcaaagtcaatatcaagggcctgaaacgcctttgaacgacgggaaactaaactatcaatgccatcttccgaacgagcgagcaattccaaaatctgcggcttgctaataccttgctttgaaagcgaaatctcttgaaacggtaatccatttgcttcaagccaagctctagcttcacgactcgattttgacgagcccgatgtatacaacttgatcatccaatcacctctcaacgaaacaacaattatttattattgtttctttgccaataccacccacacattagatgccaatcacattcacaagtcaaaaagatttactcacgacacgtttttattctctttataataacttaccatagtcagatgattttcacaataatggtactcataatttcgctcatagccatctgtgacagccaatcattgaaaagccatctaaatcatctttcaaaatgagaagtccctcctgaataaaagtagtaaagcccataaataacaattgcacgaacataaaaatcgtcatgatttcttgtgaattactagcacaattcttgatacattatttttgcatcagcggttagtacacaacaaacttagcacaagcttatatcgctttcaataacattttttcgaaaatgtaatttcaaatactaacaattaaataaaatcgatgacaggaaaacagcaaattccttagaggctcatggcatttcgaattgattcaaaatcatcgactgtcaaaattcacaaaaaaagctgtgcacaatttattttaaattttattatacggcttattgtagaccaaaaaaaccgccaagtgcatgtgcacttggcggcagacgcgaacattacttcgcaccatcggctactttctttgatttaccagttgtcggatgcttctcactaatcacaattgcatcatcaaccagatcagcttgcaacttcttagcctttaaatgatccaaatagaaatcagtcaccttatcacggatgttgcgttcgatcacacgccgtaatggccgtgcgcccattgcttcatcataaccttgttcaatcagccaatctttagctgctgcggtgacagttaacgtaatccccttcttggtcaaggtggcgttaacgtcatcaagcattaagtcaacaatcttacccaaatctttcttggttagatgactgaactcaacgatcccgttaaaccggttcaggaattcaggacggaagtaaggtgccaaccgcttcatcagatcttcgtcttgctccttcttgccagtcagcgtctcgttgccaaagccagcattggaagtcgcgatgatcactgtgttcttaaagtcaaccacgttaccttgaccatccgtcaaccgaccatcgtccagcacctgaagtaacagagtcaaaacttgcggatcagccttttcgatttcatcaagtaaaacaatcgaatatggattgcgacgtacttgttcggtcaaggtgttgttgttgtcgttatagccaacatacccagcactggtaccgatcaacttggacactgccgtacgatcactgtattcagacatatccaagcgaatgatcgcatccttgctgccaaaaagatctaacgctaattgcttagccaattcagtcttgccgacaccggtaggcccgacaaataggaaactgccaattggccgattgccttcatcaaaaccggctcgattgcggcgaatggcgcgagcgaccatctcaacggcttcgtcctgaccaatgaccttgcccttcagacgcttaccaatgctcttcaaacgttcaatatcggaagcgccaagtttggaaactggcacaccagtcaagcgttcaaccgcagccgctacatcattaggcgttgcaacgacaggcttctcgtctttcgtaccatcaagctgatgttgcttgtcggcaatcgtcttcttaaggttagcggctttttcgaagtcctccgccttggctgcagcatccttttgagcgttcagatccttaatctctttctcgagttcaaccttatcaacaatcggatgcttgcttgccaaatgcgccgccgtcatgtcaatcaaatcgatggctttatccggcaatgaccgctgtggtatatattggatactgtaatcaaccgcagccttcaaaacattttctggcaattgaacgtgatgatgctgttcataaagcttcttgatgccttccaaaatcttaacggtatcagccgcggtcggttcattaatggtgacatcgttgaaccgccgtgccaacgcgctgtccttcatgatcgtgttgcgatactcatcttgcgtcgttgcgccaatcacagtaatctcaccgcgagatagcgccggcttgataatatcggccaaccctttgccgccagactcttcgccgccagtcgcaccggcaccaagaatttgatggatttcatcaaagaacagaatcacgttgcctgccgctttgacttctttgatcagattctgaatcttctcttcaaaactgccacgatactgcgtgccagcttcaaggttcgacaaatcaatcgaccaaatctgcttgtccttgatcgactcgggcacattgcctttgacaatcgcctgcgccaaaccttcaacaaccgccgtcttgccgacaccggcatctccgaccaaaatcgggttattcttcgtccgacgactcaaaatttctgctgtttcttgaatttcatgctcacgaccgatcacaggatcaagcaaaccatctttagcttcctgcgttaaattacgcccaagcttttcaagaatgccaccttttttaaccgcctgttcaccagtcgtttcaactggaatttcgtcaccttgcttcggcaactgcccagttgcccgatactgtgcgaattcatctggcgtcatttcgtgaccatttaccacataacgggcagattcacctttgcccataccttgtaacatttgattaaaaacatcatccatatcatgattgaaaaacggatcgttaaagtttgccataacttcattcctccttgttgggaaagtgctcggaaaaggcgtggatgctgagaaagtgctgtgcaactttctaaaacgcgctcacatgttgcagaaacctccgtgtaaggaccctgaacccaaatgaccaaacccgggtcattgggttcagagccacttacactccggtttctaaccgctcatgttcgcgctcttccatagcaaaaagtactcccaggcgcactggcagtacttttgtgtcgaacttattcacttgttggcacgtttgccgttgcgccttttccttgtttacataaagtagtatagcacggttttagcattcgcgcaacgagagtgctaaaattttccaaaactattttcatagacaaacagcaaggctgtctaataccgtgacaaaagccgcttttcaactttatgctcattaaagcgcaccaacggatccccgttaacaagtgctcgggcattctcttcaaaaatgtgtgctttcttctcaccacgcttgcgagttaaccgcttgaaggcatcactcatttcgtagctccggcctggcaaatgatgggcgtcggacgcaaaaacatgtgccaaccctgcatcaatgatatcttcagaaaattgctgcacctttttgccaaacgtgccaacataactgctggctgtcacttgagcaaacgcaccacgttcaatcatttggtaaagcaaccccggatgcttcatcaaacgggtattgcgctcaggatggacaatcacaggaatcatcccacgctgcatcacctcaaacaacatgttctgggtatacagcggcacatcatcagacggaaattcgatcaacacataatgacccgacgcgtcgcaagtcaaaatatccccatgatcaatcgcgtccaacaactggccattaatccgaacctcttggcatggaaaaatcgtcaacggaatgttgttgcgatccaactctccttgaaactcgtctgtcatacgaatcacatccgcagcgtgattcgtataccgtccattcatgtggtgcggggtcatcaacgcatgcgtgatcccgtccgcaaccgccgcttgtgctaaatctaatgaagtcatcaagtctttcgacccatcgtcaatgcccggtagcatatgacagtgtacatcaatcatctttcggttccccttccaatatgtactagtatctaatgaagcgctgacaaggtcaaatctttttttgtaacagtttgttaacgatttgcaataaagccccatcaaccgcgcgagattctaaactttgcggtataatatttgaatattcagacattatggaggaaatgaggtttagaaatgaaaaagattctggtacgcgttttactcgtgctactcgttgccgctcttgggtttggcggtttcgtgtattatatggtacataattccacgtcccagatttattcttataataagaagacgaataagtcgtcggatgataaaacagctagcaaaaaacctgttgcttacttgttactcggtacagataccggggaactaggaagatcatataaaggtcgaacagataccatgattgtcgttgttgtcaatcctaaatcaaaaacaacgacgatggtctccgtaccacgtgacactaaagtcaattttgacgatgtcacgattaaaattaacgcagcctactcttatggctcttccgatacagccatggctgcggttgagaagcttctaaacattaaattagacggttatctgctcgtgaacatgaaagggcttgaacagctcgttgatgccgttggcggcgtcacagtgacatctccgcttagcttcgattatgaaggcaagtcattcgttaaaggtcaatcctatgacctctcaggtagtgatgcactgaagttttctcggatgcgttatgatgacccgcaaggtgactacggccgtcagatgcgtcaacagcaaattcttaccgcggttatcggtaaagttaagtccaacccaacaaccgtcatgagtcagaaattcttagatgcagttggtaagaacgttcgaacagacgtatctttgggttccgttaagaacttagcaactgactaccgtgatgctggtaatacgattaagagcgatcagttgcatggtacgggtcagaacattgatggtcaggcttatgaagtcatgtccgactcggaaattacgcgcgtgcataatgtgattcaaagcgcaattgatgcaaaatagtcaaaaccaagagctgcccaccaatgttgatttgtcaacattggtgggcagctctttttaaatctacattagacgatttagaaatttatttttcgattatctgcaaaaattccttcaaagcatcctgccaagtctcaatcttgaagcccgtcgctttggtcttgcttagatccaagattgaatgccgcgggcgccaagccttttgcgggtactctgcagaggagacgggcttcaccgtcacgtctttgtcggcaagaatcgcactcgcaaattcataccagttacagctgttgtcattggataaatgataaatcccataggccaacttttgatccactgcgaaggtcatgaattcggctagatttttggtccatgatggtcgaccatattgatcatcgacaaccgtcagttccttatgcgtcttagcgagatccagcatggtataaacaaagttgtgaccatattcgccaaacacccctgaagtgcggataatataatacttcttgaggtatttctgaacctgttgttcgccttcatacttggcccgaccgtactcattacgcggtgccggctgatcatcaacggtgtaaatatcttttttgtcgccatcaaaaacataatcggtgctgatataaactaaagtggcgtcaatggccgatgccgccttggccaaaatacgggtgccgtcaacattgaccttctgattcaacgccttgccttcatcttcagccttgtggtgtctttttgcgttatccaaaaagggcctacacgttcagtgttgattatttctcaacaccagaaagtgtagacccgtttttattatgacaaaatcaacaaatttcaagttttatcaagctgacaacgtttatggggccttgttctttcaatttcccaaagtattgatgtatggtcagcaatataaaggattaagtgatacatctaagctggcttatatggtactaaaggaccggttagagtattccttacgcaatcactgggttgatgaggaagggcacgtctactttatttttaccaaccaagaacttaaagatttattcgattgttcaaatgataagctagcagccgtgaaaaaagaactagaaaatgctgaactactgtaccaaaaagctatgcattttaatccaaaaaccggtaaaaatgaacccaaccgactttacctggctgaactagatatgcgatcaacggacgtctatttacgtggcgaatatggtcaaaaaggaccgcaaacccttgctacgagcgaaaatccgaaaatcggacgttcgcaggagaccgttgaaacccttgctacgagcgaaaatccgaaaatcggacacaatctagatagagaacctaaagaaagagataaaaatagatacaatatagatactcaaaagttggacttttccacagctcatttctcaccagcagaactagaaaaacaaaaccatgatctcgtgaaccatgctaatgacttcttaactgatgaagacagtgggttaccagttttcttagaacccgaagccgtacaactacttagcttttggtgccgaaccccacaacaaatgcggcgcttcattggcattatcttaaatgctaagtatcgagttgagaaggatcacaaagatattggcgttctaatcccgcttgacgacgaagaacttaaacctttgatgactaaagcactaagacgctactttaacgccctaagaagcaatgagaagcacatcaagaacgttgagaactacttgtatggcaccatgcaaaacttatttggcatttggtggaataaacaggcggctagagattatgctaccaaacaccccgaagaacagaacactgacaatgagcgctcttggaattaaacggcatctaagctcatctaagccgttttaaacagatagagcatagttatattaaacgagttttaaaatgtgcttacgggcactttaggaacgttgtataagtgccattgcggaaaggacagcaaacttaaattcacaacttttaaagaagcaggctaattgagatggtactcaaagattagtataatgtgagtagtaataaaggggggcgagaaaatcatggcagttaaggaaaagaaacgcgtacaagtccagattgacaaagaattggcagataataccgaagccgttttaagccagttaggtctaaacccaactaccgcgatcaatatgttttataagcggatcgtagctgacgcagcattaccgtttaaaccagccctgagcgaagccgaaagagctaatttaagccttttaaaggctaccaaagagacaccagtaacagagttcaaagacgctaaagaagtcgctgattggctcaatgatccagatgaggactaatggcttatcagattaaataaattaataacttggaagtgtgatgaacatgaaagatacaatcacaattaatgacttttttgaaattgccaaagaaactgatttaaaagatttacttgataagtcattacatgagccagatccagaaaagcgcaaagtatatgacgctttatatacctactttttagataaaaggcaagatgaggttattaagcgaaaggactttgtccgttgatagataaaacccaatatataattgttgctggtattaacggagcaggaaaaagtacgctatacgatacatttcccatcttgtttgacaaaacaaaacggattaacgctgatgaacttttaagacaaatgggtggcgattggcataaagatagtgacaacttaaaagccatgaaagaagaaatcaaacaactacactatgctttagatcaccagcaaagtattcacgtagaaacaacactggcaggtagaggcaaagctcaactcaatttgattgacaaagctcacaaaaatggctttgaagtgactttattatatgttgctttgcgagatgaaaatttagctatccaaagggtcaacgaacgggtacaaaaaggtggccacggtgttccagtagcaacgatcaggaaacattatcagcaatccaaacataatttgccattagtggcctttaaatctgataaggtcatgatctatgataatagcgaaaagtttacctctgtttatgcaagagagaagggacaagtttttaagaacgatttgaggcattttccttggataaaccaaaatattacttatccagaaaaggtgcaaaagcagttacaaaattttgcagatcaaaacccagaagtaaagcctaaaaatgatccagaaaataaaaacgatcggcctagttattaggttgatcgttttttagtttattcggtttatgggcattaacgtaatcggcaaatgtctttaaaagctcttcggtttgttcgaccgagaggttatcagcttgaaagtatttttcgagcaaagcacctttttgaattaatcggcgagaacgggctttacgggcttgccgattttcatagtatttagattgccgtaatttaatatcttcccgctcaattttttgctttaaacgcgtttgttgctgaactagtttttcatatctattaggcatagttattaccacctaactattattggttattttgatcttgatttaaaaaggcggcaatttttttagcaatcattttaatttgtggagtggtcagcgttgcataattcaaattagatgatttaatgatttccttaccaaggttttgttcaattttatttttttcagctttaatcttttgattaagctgttttaatttagcttcttgtttctctaagttactttgctgcataactatccctccaatcatcttaaaaataatcaccgacactatatcatacaggaaacgctaagtcaaagtaaaagagttgaaatagcgaagcggaaggcatacattaaaagtaaattcaggagaatcagaagaccgagtgaaacgaggtcaatgcgcacttacacgtcatctttgatgacgttgtgctaaacccattaaaacctgtattagaagtcgccgatggcgacaacaaaataaaacccataaacccaaagaaaggtggtgatcgacatggcaatttttcacatgagctttagtaatattagtgctggaaaaggaagaagtgcaattgctggagcaagttatcgaagtggcgaaaaattattcgatcaaaaagaaggtcgaagttatttttatgctcggtcggttatgccagaaagctttattttgataccaaagaatgcgccagaatgggcgagtgatagagagaaattatggaacggagtagaaagaaaagaccgtcgagcaaactcacggtacgctaaagagtttaacgtggctctaccagttgaattgagtgaagatgaacagaaaaaattactgacaaaatatgtgcaagaaaattttgttgatgagggcatggtagccgacgtggcaattcatcgcgaccacccagataatccgcacgctcatgtgatgttaacaaatcgcccatttaaccccgatggtacttggggacagaaaacaaaaaccgaatacattttagatagtcatggtaataaaactaagacccctgcagggaatgtgagaaaccgaaaaatttggctagttgattgggataaaaaagaaaaaatcactgaatggcgtcacaattgggcggttagtgtcaatcaagttttagagcaaaaaaatattcccgatcggatcagcgaaaaatcatttatcgaggagggaatagatgatacaccaactcaacatgagggaattaatagtaagcggcatgaaagaaaagaatttaaccaaaaagttaaggactatcgcaaggccaaagccagttataaaaataaccaagaaaaagtaatcaatagaggtcatttagatagcctaagtaaacacttctcgtttaatgaaaaacgggtagttaaagagttaagccatgaactgaaaacttatatcagtttggagaacttagatgataagcggcgcatgctatttaattggaaaaacagcaccttaattaaacatgcggttggtgaagatgttactaaacaattattgacaattaaccaacaagaaagctcactcaaaaaagcagatgaactcttaaataaagtggttgatcgcacgactaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggaagttattaatgcaacaagaaaaggaagtcaaaatcgaactgaaatatacgctgatgattcatgacgataacttagaaagtctagaacacgtcgatcaagggttactagagaaatattcaccaaccgaacagcaaaagattactcgcgcagtcaaagatctacgggcaatcatggccgttaagcaagtcattaaaacgcaataccatgaagtattgaaaagggcctttcccaaaggtgatttagatggattgccattgattaaacaggaacaagcctatacagccgtgatgtactatgatcctgttttaaagccatgtcaggccgaaacgattgaacagtggcaagcaaatccaccacaggtgttcagtccccaagaacatcaacaaggacttgcttatttatcgggacagcttagcttagatcagttagaaaatcatcacttacaacgggttataaagcatgacagcactaaacaactctttttgggtgaatgtaaagtcgatccaacgattaagaacagtcagattgagaaaatccaaaaacagttaaaagagcaacaagctaaggacgatcaatatcgaaaatcccagctggcacattatcaaccattgaactacaagccagttagtccagaatattacctaaagacggcctttagtgacgcaatcatggctgctctatatgcccgtgatgaagattaccaacggcaaagacaggcgcaaggtttaaaagaggccgagtgggaaatgacgaaaaagcaacggcaacaccaaactcgaaatcggcatgaagatgggggcatgcacttgtaatcggaataaaaaatgcaccgttaaacctggttaaaagcggctgaacaaggcagaacagaattagaacagaagctcaatcataaggagtgaacgaacatgaccactgttatcttagctgaaaaacccagtcaagcgcgttcatacgtccaagcctttcaaaagagcacaaaaaaacagggttactatacggttagtgaccctgttttgcccaaaaatacgcttgtcacgtatggtctcggacatttagttgaactagccacaccggataaatatgatcagaaataccagcaatgggccttatctaatttaccgattttcccagacaaatacaagtttgaagtgtcaactagtaaaagagcgcaattcaagatcgttaaagacctgttaacgaaagccgataccattattgtggccactgatagtggacgagaagggtcaaatatcgcgtggtcgatcatgaaccaagcgcatattgatgttaagtcgaaaaagattaagcgcctttggttgaatagcctagaaaaagacgcgattattaccggattcaaaaatcttggtgattggcacaaagactatctggcttataaagaagcccaaactcgtcaaattatattatatactataagtaaaggagcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttcttaggctatcttccaaattgtacagcagaacaaattccattggttgccaagaaaactgtccctcgcagtagtgctccaaaggttttttggaatcattttgtgaatttcgttaatgaaaaactctaaaattttactgacagaaaacttgtcagaaaattaactcacaaaaaaagccgtcaatttactgatagctttttttattatcctttagattttacaattgcaagtaaaattgcacctgttacgaacagaacaatcccaattccaacataaaccaattcttttttggttttcttttcaccaaggaagagaattcctccaatagttgaaatgataacacctaattgtgagaatgaaaaggcaatcgcgttaccagcagcgcttgcagccataagcataaagatattacctacaccaaacattgctccattaatcatattttgataaacatatttttccattttaattttgaaacgacccatcacaagtgctccaaagatcattccaactgacattggcaagataattgtcagtgtatcaaaatgaacattgaaccaaagtactgctaagttattaaaaagaataacatagataacatatcccaaagttgagtaagttaaagcaatcaatcctttagtataattacgtccttcttcaacaactgcattttctgggtcacgtttagctgagaaatagaacccaactatcaaaacagccatcgcagtaaatccaagaataaattgaatttgttttgtccattcgtggaaagcaaaaaccccaagcaatccaccaattactaattgacttcctgatgaaagtggactcgctactgaaacacccatgtatttcattgaattaaactgaccaaattgtccaattgcccaaaacaatccaccaataaatccaattaagaaaatttgccatgtcaacgttggcatgcggaataagaaaacaataagtgcaaaaacaaaagcgcccaaagtcattccaagtgtttgttgattagcatcaccaccaattttattagctacaactccgatagaaccccaagcaaaaattggaacaagcgcgagaagaactccttgcatgtttatatttacctctttaaaataattttttacttaaaaaattaagcatatctctattttactcttttttcgattaacactaaaatcggtggcgtatgaatttggttaagaggtgcataagaagtcacttcccagtccttttgtggcaaactagaagtccacttaataacggcatctttttcttccatccccccctcatgaccgtaataaatcataatcgcaattctaccagattcagcagatacgagccaggttctaagacattttgaacctggcgtaaatgcatggcatgtaaagcgatcattgcactggcaccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaaggaagttaaagctgaacgtccttggtaagttcgccgagcaatgacaatttttttaaaacttgttccaataaagaatcagccgtaggttcagctttagttgactaaattttgtaatagttgtaaactgaccgccattctgggaaatcactgggaacttgacgccattggcaaccggttttcaagacatataggaccgcacagaagacctcgtagaggtcatattttcgaggcttagttcgcttacgaaaattttctaaagctggtcgaattaattcaaattgttgccgagtaatattgctgggataatttttcatagattaaactcgctttttacatagaagtatatcaaaaatcatagatcttggacagcttcttaggataatttgtccaaccagtggctttgtcatatgaaaggtcgttgacatcaaacgtgacgatcccatcatctggaatattagctgagtacatccgcactgtcgtatctgtccggggtgcataaacaccatatgtcccgattgtaatcgcacatgggaaaacatgacccccgttataatcagcatgttcaccgatcaagttgatgcgaccaggtgagaaaaagacccgttctggcttggtatcaaaggctttggtaaactcctgttttaagtcgctagtatttatgaaaaatccctccttaaatagttttactaaaattttatcaggtttgactataatgatttttttgattgttgtcaacaccccaaaagacctttagaacaagatttggtaacgctttacaaatttatcacgttatcgattcaaattcttcttatcgcccgttgtcgttgtcagtagtcgttgtcatttagttaaaatttaactataatgacatatataaatttaatatttttttatgataattgtaagcgttttttatttatgtaactttgaaaggagcttcctcatgcaagctaatcttcaatggttagatgacccagaagtcttccgggtcaaccaattacctgcacatagtgattaccattattatcacgacacagcagaattcaaaacgggtagtcgcttcatcaagagtctcaatggcgcttggcgttttaacttcgccaagacaccggctgaacgcccagttgatttttatcaacccgatttcgatgcaaccgactttgatacgattcaagttcccggtcatattgaactagccggctatggtcaaattcaatacattaacacgctatacccatgggaaggtaaaatttaccgtcgcccaccgtataccctcaatcaagatcaattaacaccaggcctattcagcgacgctgcggacaacaccgtcggctcgtacctcaaaaccttcgatctcgacgatgcttttaaagggcaacgtattatcattcagttccaaggggtagaagaagccctgtacgtctggttaaatggccattttattggctacgctgaagatagtttcaccccttcagaatttgatttgacgccgtatattcaggaccaaggtaacgttttagcggttcgggtctacaaacgcagtactgctgcctttattgaagaccaagatatgttccgtttctctggtattttccgtgacgtcaatatactggcggagcctgctagccatattactgatttggacatccgaccagttccaaatgccaatctcaaaagtggtgagctcaacatcactactaaagtaaccggcgaaccagccactttagcgctgaccgttaaagaccatgacgggcgagtactgacgagtcaaacgcaaaccggtagtggcagtgtaacctttgatactatgttattcgaccaactgcacttgtggtcaccacaaacgccgtatctctatcaattgacaattgaagtttacgatgctgatcaccaactcttggaagtcgtcccatatcagtttgggttccggacggtcgagctgcgcgatgacaaagtcatttacgtcaacaataaacggttggtgatcaacggagttaaccggcacgaatggaacgcccacaccggtcgcgttatcagtatggctgatatgcgcgctgatatccaaaccatgttagctaacaatatcaatgccgatcggacctgccattatcctgatcaattaccttggtatcaattatgtgacgaggccggtatctacctaatggccgaaaacaacctcgaatcgcacgggtcatggcaaaagatgggggctatcgagccttcttacaatgttcctggcgataatccacactggttagcagcggtgatcgaccgggcccgttcaaactacgaatggtttaaaaaccacccatcgatcattttttggtcacttggcaatgaatcgtatgctggcgaagatatcgcggcgatgcaggctttttataaagaacacgatgattcacgactcgtccactacgaaggcgttgtctacacaccagaattaaaagatcgcatttctgatgttgaaagtcggatgtacgaaaagccccaaaatattgtagcttacttggaagataacccaaccaaacctttcctagattgtgaatatatgcatgacatggggaattctctgggcggtatgcaatcatataatgatttgatcgacaagtatccaatgtatcaaggtggctttatttgggactttattgatcaagcactcttcgttcatgacccaatcaccgaccaagacgtgctccggtatggcggtgatttcgacgaccgccactccgattatgaattctccggtgacggcttaatgtttgccgaccggacaccaaaaccagcaatgcaagaggtgaaatattattatggcttacacaaataatcaactacacgttatttacggcgacgggagtttaggactacagggggctaatttcaactacctctttagctacgaacgtggcggacttgaatcactcgtcgtcaacgataaagagtggctctatcgtacacccacgcccatcttttggcgggcgacaaccgataatgatcacggtagcggcttttcagtcaaatccgcacagtggtacgcggccgataagttctcaacttgtcaagatatcgaattgacggttgacgaccaaccagtcacaccgttaccaatcgcgccactcaataacaaatacacggatcacgaaatcgccacgaaagtctctctggcttaccacttcgttaccacgaccgttcctagtaccatcgtcacagtgacttatatggtgacagcagacggtcagatcaatatcgccacccattatagcggtcagtctgatttgccagagctacccgcatttggtctgcggtttatcatgccaactaccgcgaccggcttcgactataccggtttgtccggtgagacttatcctgaccggctggctggcgcaacacacgggcaattccacgttgacagtctgccagtcacaccatacttggtcccacaagaatgcggcatgcacatgcaaactgaacaagtgacagtaacgcgatcaacaacacaaaataacgctgaccacgacaacacaccattcagtttgacatttagccaagccgatgcaccattcgccttcagctgccttccctataccgctgctgaactagaaaacgcaacacacatggaagaattaccattagcacggcgaacggtcttatcaatctacggtgccgttcgtggggtcggtggcattgatagttggggaacggacgtagaagccccatatcatatcctcgctgatcaagacattgacttcagctttaacattcatttctaaaaattaatttgatttcaaaagaacgctccggcaggttatttgccagagcgttcttttagattaacgatgattaagttttaatatgtttaatggctgagcttagtccttatccttgaagtaatgtacctgcgccgtatagtcactagtttgaacgggagtcgtgtagagtcctagttgcatcaattcatcgccaccgtacattttgtttgtgtcggtctcaacgtaggtctgctgagggtctaatcccgctaacttcgtaatatgcggttctggttgaactgcacctaaaataacgaaggtgaacagcaaagcttctttctgatccggactaacaaacatccacgcgaccgtattagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggccgcactgaaccatcgtcccagacgtattctgaactatcttcgcccatgcgattactaccgatgcatggcgtaacagactagaccactatcaagaattcgttatcatcgttgcacttgacttgaaaattgaggagtttacaaaaaacgaaaaccgacttgatggataaaaaagaagctatatcgcgcccagcagaatgctgtgcatcagatatagcttctttttagtaacgcgacttaatcgtcttcgtcttcgggttgagcttctgcttgggaacgcgtaagccgattgagtttggtaatcggaattttaccaagaaccagtggcacggtttcatcgatggtatccgcatattccaagccgaaccattgcgcgggtgaaactgcgatgtgctggagtcgtagccgcgcctgaatgatggccttctggaaacctttgatctgggtctgcggtgaaagctcttcgtgcagcaagacaaaagtccagtcgccaacttgtcgatccggaatggttgtgtatttttgcggttgcgttggtaattcaccttcacgcatcatgtcattgacaatttgccgtaagaacacgttgacctgttgttccatccggaagccgagatagagttggacgttgaccatataatcggtcccatacgtatccgttgtatattcggcagtatacggttcatccgtaacattgacagtaacaaaccagtaaacccgtgcgcgttttggccgtttgtccaaaattgagtagagaatttcctttttgatgtaatggtcattcgcaatttgggtcatgtaaaccaagttggtggtgtatgttggataatctggatcgttgcgaagttcggacagttgatttttataggcaaaaagcgaagccatttcggcccgataagtgttgtcgtcgcgaattctgccaccgtattgccagacatacatcacggccaaaatgataaacgcgatcatggcggtgacataaccaccgtgcaagaacttaaccgcgctggagatgaagaagactgtttcaatggcactaaagaagatcaatgtcccgatcgcaatcacagcaggcgcatgacgcgaacgcaggtattggtacaacagtagggtggtcatcagcatagtaatggtgatggccaagccataagcaccttccatttcagcactggttttgaagtagccaatgatcgctaagcaagccaaccataaaatggtgttgacgactggaatataaagctgcccctttaaccttgttgggtaaatgatgtgcagtcgtggcaagaagcgcagtttaatagcttcggaaaccagtgtataagagccggaaatcaatgcttgtgacgcgatgatcgccgccaaggttgctaaaataattgcgcctaaccggatgctttctggcaacatctgaaagaacgggttgaagtcggtaatcttgttgaacgccgttacttttgaattttgatccaaccagacagcttggccaaaatagttgagcactaaacagatattgacatatggccagctgagatagatgttaccgcgaccaacatggcccatgtcagaatacaacgcctcagcaccggtggttgctaggaaaatactgccaagaatgaagagccccattttattgtctggactgaccagtaaatggagtgcgtaataagggttcaaggcgcgcaacatggaccaatcctttgacaaggcaataaagccagcaacgcctaagaatgtaaaccagacaaacatgatcggaccaaacgccttaccaatcagatcggtaccaaatcgctgaatgaagaacaggaaggtaatgatcaaaatggtgacccaaatcacctgttgctgattgtcgattaagatgttgccgttaatatggacacccttcaaaccttcaatcgcggttgtgacggtcacagccggtgtcagcatcccatctgccagcagagcagcaccgccaaccatggcgggcagtaccaaccaacgagcacgctggcgaacaagcgtatacagcgcaaagatcccgccttcaccattgttatcagcccgtaatgcaatcaagacatatttaaccgtggtgataatgagcagggtccagaaaatcaaggacactgagccgaccaaaaagtcagtatcaaaatgtcccatgccgccgttgccagcaacgattgatttcattacgtatagtggtgacgtcccgatatcgccatagacgacaccgagggttaccagtaaagccgcggcagtaattttatgtcgcagtttcttattagcagtcaagcctgacgccatttttgagcctcctgaaaagtaataccgtcattgtagcagaatcacgacatattgtaaggcgaacttgcggcattcgttcgcctgaataataaatttagttatattgtcggccactaatgaataagaaacagcggcatgagttacgttatgttgtttttatttcattgatcagtttcgtaaaattcgttgaaataagtatcaagatcgagtggcccaagtttgaagggaatatggtgggctgctaaacccaacagtagttgattgaaatgctcacctggcaatttttggattggcagcaccaacataccgttggggtaatgttcccatggcatgcgtggtaggcggctggcgttttcttcagcaacttgcacatataaaggctgctgttcgtgttggtcgatggttttgatgatcttcccatcgcgcatgaagtagatgaggtcggcgtacccttgcagattgttcagcaagtgggagaccgtgataatcagcttaccttctgcgcgtaagccgcgcaaaacgcgagacattcgcgcaacattgatcgtgtcaagtccgttcataaattcatccaacagcatgattggggtgttggccgccatgaccatgccaaaacataatcgctgtttcatgcccattgaataggtacgcaccggttgattgatgtagtcccgcatgtcaagcacattgataatctgtttcacgctcttcgaacgattgtgccaaagcttggcataatactcgaggtgcgctttgccggataaatctggataaagatcatcttgaactgggaaaaggcacatctgccggtgcagcgcaaggctttgtttttgactaccataacttttaccatctaccagcactttgcctgcttgtggttttagatcattgagaatcaagcgcagcaaggtggttttgccggtaccattgggggcgacaatcccgacgattgatccgccattcatggtgaggctgatgtcgtgaatgacgttgggtttgtttttaaaacttaatgcaagattttgcagttgcaattccatgatgtaccctcctgtaaaatgcgtacgcatcacgctggtttctaaccgcgccagctcacgctctatttaaccgtcgcagcatgtcggcgatgtgtcacgatgaacagcatgatttctagcaggacaatgccactgccaatcacgatgaccccagataacggtgtcatttggccggtatcgtatctgaaattttgtaggccgttgacgatggctgctggattcatgtaactaggtagatagtaggctgtttggggtacggagaaggctagaccttgcatgaaatagagcggttcgccaaagagcagtagggcgctgagaaccagtccgatcaattcgttgtgaaagagcaattggcaaagcaagttaagtcgaatgaacagccacatgagcagtacagtcaaaccaagcatcatgagtaaagcagaaccaagtgccagtggctggacataagcgtaagacccgtttttggcaaagttagtgatggctgtggttagtgaaccaagaccatggaaggggatgacacatacagcagtcacaccaattagcagggtgactgccccggcgagggtaccaagtaccgtcagcgttttggtattgatggcatgccacggactaagtggcaaagaacgcgcaatactgcgatgacgttgctcgctggtcagcagatcattcgcaagcagaatggtgatgagcaacaacgctgtcagccagccacccagtgcgccgcggaaaagtgtctgccagaatgtttgctgatgaattgtcgatacatctggatgtgcttgttttgccaaaggtattagtgattgcgttaaaacaacgttagcgtaagcagcatcagcatcgggatattggcgattttcgtaataataggtgagcgggtaatggaacggactgctttgggcatcgggattagcagcatatcttcgcaaaaagccgagatagttgatagttgcgcgaacgtaagctttattttttccttgcttttgcgctgttaacatctgggtttcaatcttagcaaattcgcgtgttgatggcacccacacagcggtattaggcccgtgcgattcgttgacaaaggcaatatttttatcgcgatcacgggttaaaacagttgctgtcggtaactcgaccggtgtggtgttcggtgggaaaaagacaaattggcagatcagggcaactaaggcgataccaattaccgctagatttttccggttagtcagcagctggtggaactgaaaacgaaaataagccatcatgctgcctcctttttgacacgtaggccaaagataaagagattaacaaaggtccagagaaacagcaaaccagtgccaatgacgacgctagcaagtggctggttcaagcgatccactaaggtaccgcttaatgtcgcgtaactgtctagataaggcattggcaggaaccacagaaaatggaagagctgtggcagcatgactggcaataatccggctgccatgacgataaaggcggtcagataaacgttggtgatccaagtattgactagcatactaaaactgatgagccaaataccggctaagattgtcaggccgccaaacaaaagtatgtattgccacaatggcagtatggctgtacccatgacggcgatcggataattgaagtcacctaggccagctatcagggctggtgtcgcaaccatcaaagcaaaaccggcaagcagtgttaagatgtaaaacccggtaagcattagtaggcggctgctccccgcaaggccagctgtcaaaggacgagcagtgatgtgtgtccggtgtcgccgccgctcgatccaactgtcgcaactgagcaatatcgcagcagcgccagtgatccagccgagataaggtaacaccaaaacaatataaaaagcacttgtgctaacgcttgttgcagcaggccggccttcagattttaaaacgttcaggctccgcacatcgccagtaagctgatgcaacggtggcagcggcatcgtgttgagcgctttgtaatgatgttggcgcatggctagctgcgccgtacgtaaactaaccagcccattacgggtagtgtcaggctcatcaagctgcaggcccaagccaatgacgccggttgctgaattttgggcgtcaagattagccaataatggtttttgtgctgtactcaatgtatccagattatattcagcatagttggccaacgcggcgttggctgttgcttgtgatgtttgagtgacatcgagccgtttggtccaacttaaagcgaaaaacgccacgataaaagcggccatgaacaacccgagtacggccatgttttttcgtgaatgaatgatttggcgccagtcaaaggcgaattgtgtccccatacattgccctccaaagtgagcgttttctgagatgactccgatatcaaaaaacgcgtggttacgatgtgtcaccagaataccacatttttctgggtctacactttctggtgttgagaaataatcaacactgaacgtgtaggccctttttggataacgcaaaaagacaccccgcactgaaccatcgtcccagacgtattctgaactatcttcgcccatgcgattactaccgatgcatggcgtaacagcctagaccactatcaagaattcgttatcatcgttgcacttgacttgaaaattgaggcaataaaagcaaactaatggaggaacaaaaatgaaaaagacaaaacttctgacactatgcggtgtattagctataggggcatcactgcttggatcaacccaagtgtacgcttacgaaaatggccaaaatgatcctcatgctgctactaacacgctagaagtgaagaaaacagatagtgcaacgatttcggctgaaggaacgtttgaaccatttgatcctaccaaactacctgatccggctaaaccaacgcctaaaaaagatcataaagcatgggtcgatgtcaaaattccctccaaagttttgtttagtcaaaccgacgtcagtgaaggtattatttcaccgaattatgaaatccagaatctatcagccaaaggcgtcaaagtttccattaatgattttactgatggcgataatgctaataaattagagggtcgcttggatctaaatttaaactcagacggcaaaaaggttgctttgcgttcaactgacaaacaaaaagtaccttcttttcctactgagattggtacgatcacaagccaaaacgggaaaatccagttcactttggctggaagtgtcaaaaagggttttgacttcaccaaagagacagttaaagcaaattataaattagtccttaaattcgaagtacagtaaagatcatgatgaagaaaggacagcttagtttcttcttgatggccttgtttttctttatgaatatgccaccgcatataggccttgcggaaaccaatgcaagtattgaggtggagggcatcattggcaaccagccagttgatgtgactgacaaaaacgatgccagcaaaagcccgattgttcagcgcaaggaaccgaatgacaaaataaggcaggagatgcccgaactgggggcagatgccgcgcaagcgcaggtattcttgatgttggggttactgtgcctttccggtgcaattttcgtgtactggacaaggaaatatcaaggagaagatggcaatcagggaactgccagcaatgccaccaaaaaagtcgaaccttagcaatatgagaatcagcgtcataccagtcatcgaaaaaatttggtataacgctgattttttaaggagtaaagcaaatgaagaaaattttgaatctattgctagtcattgcccttgttataacttctgtggcattcccgcgtccagtagaggcggcccgatcttatccaaatctcgtgagaagtaaaactgaggcgcaatggaaagattttatcaagcgacttaaagcgacaaaggttggagtaaagcgggggaagaagtagaagtgtcattaaaaccatcgccaacttttaaagaagagagagtaagtggcaatcttgttattgaagtcggccaggttgcgagagagattgtcgaagtaaaatctagtgatccggagacattatcagctaaggtagtgaataaatcgactatacgactcaaaagaggcttcggcactaattctaaagttagtatttccgttaaatataaattagcttggaaatttgatttgagaatgggaagcatatccagttttcaatattatactgagaattcaaatggctatccggcaattgaaactgaattcagcgaatctatggaaatgaaaataccacttggctttcttctagcgcgcaacgctaaatatgttttaggtgaaaagtggaatacagcaagtcgttcaaggatgatggtgtcggcgacagatgccgatggtagccctgttaattacagtgacagcaggattggggcgaccatcccagatgagctttcaaagagaattaaaaatggcagaatagatgccaatattgattcgccagttggcctgttttttaagtcatcgggcgggcgcatagattcgcctggtaaagccacctcaagctatgggaatgccgttgttctacgggggtttgaagctcaaaatggggttgagtcgacacgagatgccgcaggagcgtttgcgctaattgaagaggatggccgtcctaaaatcattgccacttccggtgcagttaacgacaatgacaaaattcatcaagaatttcctggaaagttttatgttgagactgctttatttagcatgaataatgttaacgacttatcccttgcggatcaaaacccgacaaaggtgatcactgccaacggcgatgaaaagaaacaggattttttggatcggtgggggagtgcccgtgcgatgtcggtcaattatggggatgttttcaaggcaaaagaagcggaaggaaaaattggctatacgcaagcttcaaactacacttctttagacacctatcaacagcctaaagaaatcttttttgaggtgacaaaaaatgggtacaagccattagccatcaatcaattaagttctaaaaagatctcagtcactcaaaaagattcgcaaagtacaattgcgcaacaactgaaaaatactattgacactaaaggtaattcaaacatcaccattgaaaaattttcagagtatcctgacgtggatactgcaggtgaaaagacggctaaagtgctcgtgtcacaaaccttatcgagtggcaaaaaagtcagttatccttatgaagtgccagtaaccgtggtcgccaagccgggaaaatttaaaacacaggaggctttttataaacttggtgaaaagtggaacacagaaaatcgttcaaggatgatggtgtcagcgacagacactgatggcagtgatgtgccatacagtgacggcagagtcgggtcgagtaaccctgatgaagttaaaaaagcactcaaagatgaccgaatagataagctctttaaagcatccgttgaactcgtctttgcgtccatgggcggaacagtcacttctgtcagtccagttgaagcaaagtatgggaacgccattgtcttacgaggatatgaatatggccctcgtgattcagctggtgtgttcgctttgattgaggaaaatggtaacccgaaaatcatcgcgacttcggggaagtcaaccgataacgaagctattcattcctcgtttcccggaaagttttatgttgagactgctttgtatagcgtgaatcagcataccgagttagcacttgataaaagtacgccaacgatggtcattaaagcgaacggcgatgataagaagcaagactttttgaatcgttggggcgcttctcgtacgctgtccgttaattacggcgatgtttttaaagccaaagaagcagaagggaaaattggctatacgcaagattctacgtatacttccttaaaccgctatcagcaacctaaagaaatctttttcgaagttacaaaaaatggctatcgacctttgcaaattaaccaactgacttttaaagggttggtcgtcccaccagctgttaaaaaagaagcgattgaaaaggaagttaaaactgctattgataaaaacaagcaagcaacggtgacattcgaaaagataactgactatccggacactactcacgatgggtttcaagatgtaaaggtgcaagtgtctgaaaagcttacttcagggaataaggtgttcttcacatacacaattccagttgtcgtcaaagatacagacgatcaatcggatgatcaatttattctcacggcaaaaaacataaccgcttattctaatcaactagctaataaaacgtccgatcagttggcggcgtttattttgaagcaaagtcaagctcaggcttgggaaaagaataagcagaccccctccgagaaaatcaaggtgatcacaacggacctaaagcctgaatttggtacttatcaggcaacattagcgattggtaagcttcgaaaagagatttcaatcaatgtcttagcatcaaacaatatgatcgatttgacgattccgaaaagtatcgcctttggttcgactgatgttgatccaggccagattgtctcacccaactatgagatcaagaatcgttcaaagacaaaagtcaaagtggttttgcaacaagttaagaccgcaaccaaatcatcgattaagttagtgcatgttaatgatcctgatccagtaaacgcctcagaaagtgccagattatttttgaaaggcaacgaaaaatttgccgcaaataaaatcccgcttgatgattcaacagcgaatcaagagctaggaacgttagatgatcaggctaagaccagtgtgtcgttgtcaggccaatatttcggtgattattcgagtcggcaaaatctggccatggatttaacctttaagtttgaggtattacattaatcagcgaggcggaacgaaatcattcactctaggatttaaagaatgaacgctatgaagactttgccaatttagccgactttttcaaggatttgcatcctgatcgttaaatatactgcctacttttacgtggcaggctggctgcatgaagattttcgtgcagcttttttgattcgtttggtgaaattcaaaaagtggattaataaattctgtcgggaaaataatttattttatttttacaagcatcacgtcaatattaaaacgattgctggtgtataccaaaggctcacgatgattgcgcttccaattatgcgatgataagctctctgagattagatgttggctattttaggcagttgaacgatttagcggctatagctgaacggagcaacgtcttgattgatgatcacctatcatcgaaaatcattttaacagggggaagagcatgaaaaagtttttggtcagtataggcctattgggaatgatggtgctttcgaccgggacggttactgggtacgcgactgatgatagtgccagcgcggtcgcaacaccatcgtcggccacgtcgagttcagaaatactgaaggctgttaatgacgaaccagttgccacggaagttcctgtgcaaggggctaagcctatcgagaaggcagcaacagtaacaagccgtgctgagtatgtgacgatgcgcgcaagatggcgtgaccgcctgattgcgaccaaaccggatatgagtgatcccaatgttaaagcttacttgacggacttggcagcgcagagtcaaacgctatgggcgacgatggatcgaagtgctaatcgtagtcggctttggctaaagaaaagttcggacacgacctcggcggattatacctcgatgtttaccaatattaacctggattattcacctcggtattggggacatgaaatcgcatctggccggtctgaaagcaacgtttggagcgttgcgatgggttacttctgttcaattattgaggacgcgctaacagcaaagttcgtcatttggaggaaatgctgatcgattcgactatcattttatcgagaaatgatgatgactcatttactgcttgttctcaagttctttgatccgcttaaacatgcgaatcatgtagcgtgtttcatcaatgagcaacatggttgtcatcaacgtatcttgaccatgaaccatgataaaggtgacatccatttcagcaccgccagcttcttgacttagaagctgggtctgttggttgtgggcttcattgatatcctgttgggccttctcaaccaattcgtttgccttatcgaaatcgcctgcttcagcggcatcaagtgcatgcacagcagccgttcgagcatcgcctgcatacgccacaagtgcaaaaccaaccattgaaatttcttctttagtagccatcattttccctccgattcaatccttgctgtctaaatagccaaaaactttttaatccggaatgatgtgggtctcactcacagacttaaaccactcggcactttgtttgatataacgattttgtgttggaaaatcaacgaagaacagaccatatcgtttactgtaaccgtttgtccaagaaaactgatcttgaagtgaccagatgaagtaacctttgacatttgcgccatcatggatagcatcagccattgcggacagatatttctttacataatcaatccgttttggatcttcaatcacggtgtcaggggtcgcattttctggcaagctttctttaagaccaataccattttctgtcacgtaggtcactggcaccaacggatagtcattatgaatccgcatcagtatgtcatacattcctcgtggataaatcgaccaatcccaatctgtcgtctcaatgccctctgggagtttttcctcgccaacgccttgcagccgcgcgaccgaagagcctttggtgccgtcgccattatgaatggtctctgatttgccatgataggcacgcaaccacttgctgaaataattattgaccccaacaaagtctaactgatgggccgcttcatcaatagccttcatttcctgcggtgtcgattgaaacatcggttgatgattggcatccagaatttccttcacgagcgccaaagtttcttggtgatattcgccagctaatgtgccatccagatacaatcgattttccaaagcgtcctgcaactcggcggcatggtgatccacagcgctatcactgtagggataaacagtttgcaacgcatgaacaattccaatttggccacctaattgcattgacttatatagattaacgatacgggcatgcgccaccatttgattgtgttcagcttggaacgtcttatcaaaacgtccagactcggcaggcgggaatgtcccgcttgtatattgttgaacggccattgaggtcggttcattaatggtgatccaatacttcacttcggaaaattcttcaaagcaaaacttcgcataagccacaaagtcgtccaacatctcttgactcaaccaatcaccggcttcgtgcaagcgttcgggcgtatcaaaatgatgtagcgtaacaaacggttcgatatgatgggcggcacaatccgcgaagagcttgtggtaaaaagcaaccccgcgtggctcaacttccccggcaccatccggaaaaattcgcgaccaggcaattgacacccgaatcacttgatggccgtatttttccgctaatgccaaatcttcatcataacgatgataaaaatccgctgccgggtcgggcttgaaccgcccctgtttatccagaaaatcgtcccaaagcacgcgacctttaccgtcttccttggtggctccttcgacttgataggcggcggttgccccgcccattacaaaatcttgaggtagctgtttactcattgcttaataacctcctgttaagtgtctcaaagattggattcaacaaaatcaagtgccttgtcaccattgttggttaattcaatgtattgccgaccagttgttgtgaccagcttgacgccatacttatcggtgatcttttttaaattacctttcatgctttccatttgcggcgcaaggatgaccatgttcatatctttgatcaaatccatatcctgtccataagcgcgggcggcggccgagagctttaaaccgcgttccttagacagtttgtttagcgcgttggcaagaataccgcttgttccaccaccagcacacaacactaaaacattaacttcattttgtttgaaataggcttcgccgtgggcagatggggctgtttcaggcaacacatgggtcgcatcgtcgtctgtggcagtcgcaacagtcaaaccagtcgggatagaaggtgacactgtgtcactcgcctgaacagccatgccgtcgtcttcaatgacctcttccttagctttttcttcagctaagagtgtgctgtcataaacgcgaatgaatgggaagtatatcgcaacgtccagaaccaacgtcagtagaacaaaggcgaaagccaacggggcaaacccagtcgaaatcaaaatcccaatcggtcccggaactgtccatggcatggtgtacatcatactgttcatgccaagtacactcacaaagaatttgaataagcaaacgttcacgatcggggttgctaagaacggaatgaagaaaatgggattcatgataatcggcattccaaacaaaacaggttcattgaccccgaaagtgcatggcacaaaggaagccttaccaacggcttttaattgcgctgatcgggccgcaaacagcatgatgaaaggtaccaccaatgttgctccggttccaccaaaattcatgacgtagtccatcgtgttcatggccaaaacgtgcgagacatgttgccctgcctgatattgctgcaagttagctgctgtattcgcaatcataatcgggacaacagccggctgaacaattgatgggccttggacaccacagaaccagaagaaagccatcgcgccagcaatcagggctaagcctagataagaatcgctggcttggaaaagcggcgaaagtacttgaatgatccagcgtggcaatacagtacccgttgccgctttgaagccaacaccgaaaagccagaaggctgtcacagaaaggcccatcgggataaggtctttaaatgactgggcgatattacctggtacctgctctggtaatttaatcgtgacattgttcttaatacagacgtagtaaatatttggcacgatcaacccaacgatataagcgcagatcaatccctgagtccccatgtaagtcaggtcaacaccggttttaagcggcaagatcgacaaaatgacaaaagaaatttcagacgccacaatgacggccactggattaatttgatttgttttcggtaattcaaggttcttgctgtcagtcaagtttttagcagtcgttcccgccacaaacagtgccagcaagcccatggaatagttataagcaaccatcaacgtattcgttacgttgtctggccagtaaaacccccaagcgttcggaacataagcaaccatcataaagatacttgagaagatgatgatcggcatacatgcgataaagccatcacgaatcgcggaaatatatttgttagcagcgatggcttcaaaaaccggttttaatttatcaaaaaccttattcatgagtcttttcctcctgagcgcttggaagccaaagcataagcgtgcttgaagcaaactggcccaatctttggtagattgcttcaaagcccttatgtgtaggcttctacgactgcgagcgcgttataatgaatcgttttgtgaatgattctgggctggtgcttcgtttatcaatcgctgaatgtggatgatgaagtaaagtcgttcgtcctcactcatactgcgatagagttgatccttaatttcatcgaaaatttctgaggcaatcttgtaagactgcggatagttttgcttaagttcagtggcaacctcagggacaatggtaacggcatatgtatcaacacgctgcagtcggtcgatgagatactggagatgaatcataaatcggtcatagtagttgccatttgaatgagagcgagtaatgtgatgacgcttcaacacttcttgtacaagttgactaagtgaggcttcattgcttttaccaaaaacctgctcgccatcgtcttcgccggaagcgttgataaagtgcaacgccagattttttatttccgactgtggaaactgaacgccaaggttcgtggcaatgatttgcagtgcctgtttagccaccgcatattcggccggatattgaatatgaaaatctggtaccattgtttcttgataagtccctgcctgatagcgtttatatgcctcgtaaatatgatcactcaaggtaatgtagatataatcaagcactttcagtcgatattgtttctgggcaacatcaataatttcataggtagtcgtcaccacgtcaatcggaatattttttaagagaaagtacaaattttgtcgggaagtctcgttcgctagataaaagatcttctctatctgctttgtcggaataacatctcctcgcctcttctgaaaagcgatgccacgtccccttacaacggcttggccgcggttgtctagatcaaccaaggccacgttgttgttaaaaatctgagctatttttggcaagttgtcatcccctcccagtgcaaagaaaaaaccacaaatcacgcgctgcgatcagcactgcgatttgtggtctcgcctaattaaatagtcacaatccacattgaatattcctatcaacaaacaaattgtaccatatctgaacagaatgtaaacgttttattttattttttgtagcatctttagtttgctgttcttttttctttttcaacagtgtccatccagcaagccatcgtcagttttttaggacaattatctgtgttgccttttgttctttaatgatcagtgctagtcatgtctctacaaacgaatcactttatttgacgcctccgttaatttgacgataatgatcaaaacgagcttcaaggaggcaattacgtcgaacttagatttaaccatcgttgtgccaacttacaatttaggtcattatctgcctgagacattaaaaagtatccagcaacaaacaattgattttgaactttggctcatcgacgatgcctctactgatggtaccgctcagacagtggctgattttgttaaaggtatccctaattttcacgcgaccggttttaatgaccatcgtggcatcggtgctgcgcgaaactttggcattgatcatgccactggtcaagctgtggcgtttgtcaatggatttattataccgcaataatgcatatattagcttaactgcctgaattatagaatttttaagcagccactaagtaccgagttgaaaaggatcatcaggatattggggttctaatcccgcttgacgacgaagaacttaaacctttgatgactaaagccttgagacgctactttaacgttcttagaagcaatgcgaaacatatcaagaacgttgaaaactacttgtatggcaccatgcaaaacctatttggcgtttggtggaatcaacaagcggctagagaatatgctgccaaacatcccgaagaacagaacactgacaatgagcgctcttggaattaaacgtcacatggactcatttaagccgttttaagtgttacatgcataaattatattaaaatcgttttaaaatcgcttagaagcaaaaataggcaccttgagtggctgaattggcgatgactgaactaagggaatgtgaaaggagctttttaaatgaccaaatccagcaaagaagtcgaaacaattgatcaattgttggctgacccatgggcagtcgatattcaagacatttgggagcaagcagcccataatccagatcctgataaacgcaagctgtttgacgcgttacacacttacctcttagataaacgccaagaacaaatcatcaatgaaaagcatttcgtgatttaacatgagtgagctaaagagatacctcatcgtagctgggataaacggcgctggtaaaagcactttatatcgcgcgaggcccgaattatttactcactccaaacgattaaatgccgatgaaatcctacaaaaaatgggtggtgattggcataaagagcgtgataattttagggcaatgctcgaagaaataaaacaactccacgcggctttagataccgggcagagtattcatgttgaaacaaccttggctggccaaggtagggcgcaattgaatttaatcgatcgggcccacaagaatggctttgaagtaacgcttttatacgtggcgttaaaaaacgaaaaagtcgcaattaatcgggttcatgaacgagtcaaaaaaggtgggcacggagtaccagatgaagttgttaaaaaacgctataatcaatcaaaccataatttagcagcggttgcattcaaagctgataacgttgtgatctacgataatagccaaaaatttgtatcagtttacagacgagagcatgaccaggtgatcaaaaataatttgcgtgattttccttggataaatcccaaaattacctttgaagcagctatacagaaacaactaaatgactttgttaaaaacaatccagatttaaaagttagaaatcccatgaatgattcagaaaataaaaacgatcggcctagttattaggctgatcgtttttgagttcattcggtttatgggcattaacgtaatcggcaaatgtttttaaaagctcttcgatctgttcgaccgaaaggttatcagcttgaaagtatttttcgagcaaggcccctttttgaattaatcggcgagaacgggatttgcgagcttggcggctttcatagtatttagattgccgtaatttaaaatcttctcgctcaattttttgttttaaacgcgcttgttgctcaactaatttttcatattgattaggcatagtcattaccacctaactattattggttattttgagcttgatttaaaaaggcggcaacttttttagcaatcattttaatctgcggagtggtaaatgtcccataatccaaattggctgatctaatgatttgcttaccgaggttttgttcaatcttatttttttcatctttaatcttttgattaagctgttttaatttagcttcttgtttttctaagttactttgagacataatgatccctccaatcgtattaaaaataattaccgacactatatcattcagagaatgttaagtcaaaggatagaagttgaaatagcgaagcggaagtcatacactggaagtaaatttaggagaatcagcaggccgagtgaaacgaggtcaatgcgcacttacaccccaccaaattcttgtggggtaaatcgtgctaaaatcctgtattagaagtcgccgatggcgacaacaaggtcaaaacccatagaatcaaaggaagacggtgactgacatggcaatattccacatgagttttagtaatattagtgctggtaaaggacgaagtgcgattgccagtgccgcttatcgaagtggtgaaaagctatttgatgataaggaaggtcgccactatttttatgcccgatcgatcatgccagaaagctttattttgacgccaaaaaatgcacctgaatgggcgagtgatcgagagcagttgtggaatgaagttgaaaagaaagatcgtaaatcaaactcacggtatgcaaaagagtttaacgtggctttaccggtagaattaagtgaatccgaacagaaagaattactgacaaaatatgtgcaagaaaattttgttgatgagggcatggtagccgacgtggcaattcatcgcgaccacccagataatccgcacgctcatgtgatgttaactaatcggccgtttaatttagatggaacatggggaattaagagcaaaaagcaatatattttagatgataatggcaacaaaacatataccggaactagcaagtaccctaagagtagaaagatactgatggtcgattgggataaaaaagaaaaaataactgaatggcggcacaattgggcggcaagtgtaaatcaggctttagagcaaaaaaacattcctgatcggatcagtgaaaaatcatttgtggaacagggaatagctgacacaccaatgcaacacgagggaatcaatagcaaacggcatgaaagaaaggcatttaatcaacaagttaagaactatcgtaagtccaaagctggctataaaaatatgcaggagaaagtagttaatcgaggccacttggatagcctaagtaaacacttctcgtttaacgagaaaaaagtggtcaaagagttaagccacgaactgaaaacttatattagtttggaaagtttagatgataagcggcgcatgctatttaattggaaaaacagtaccttaattaagcacgctgttggtgaagatgtcactaagcaattattgacgattaaccaacaagaaagttcactaaaaaaagcagatgaactcttaaataaagtagttgatcgcacgactaaaaaactttatccagagcttgattttgaacagacaaccgcggctgaacgacaggaattgattaaagaaactaatagtgaacaaacgattttcaaaggcagtgaattaaacgaacgtttaatgaatattcgtgatgatttattggtccgacaattattgacctttaccaaacggccatacgttggctggaagttattaatgcaacaagaaaaggaagtcaaaatcgagcttaaatatacgctgatgattcatgatgatagcttagaaagtctagaacacgttgatcaaggtatactagaaaagtattcaccaaccgagcagcaaaagattactcgagcagtcaaagatctacgggcaatcatggccgttaagcaagtcattaaaacgcaataccatgaagtattgaaaagggcctttcccaaaggcgatttagatggattgccattgattaaacaggaacaagcctatacagccgtgatgtactatgatcctgttttaaagccatgtcaggccgaaacgattgaacagtggcaagcaaacccaccacaggttttcagccccccagaacatcaacaaggactagcttatttatcgggacagctgagcttagatcagttagaaaatcatcacttacaacgggttttaaagcatgatggtactaaacaactcttttttggcgaatgcaaagctgatccgacgattaagaacagtcagatcgagaaaatccaaatgcagttaaaagagcaacaagccaaggacgaccagtacagaaaagcaaatatcggacattatcaaccactgaactacaagccagttagtccagactattacttaaagacggcctttagtgacgcgatcatgactgttctatatgctcgtgatgaagattaccaacggcaaaaacaagaacgcggcctaaaagagaccgagtgggaaatgacgaaaaagcagcgggaacatcaaactcgaaaccggcatgaagatgggggcatgcacttgtaatcacaaaattagcgattggttaattggtattaatggtagcccataatgtattttatattgataaaaatttggtacgtagagcgtgctcgattagttacctatagctgccagccttgtgtatggtctatcaaagagaccaggcaatcaaaaactttaagccggaaccctattttgaactacatgctgaaattcttgctaatcagcaaaaatttgtcgcaaaattagacccctatcagcgatttaaagacgaaacagggctaatgacattcatgcaggctaaacacgttcagaaaggctcacaggacggttttatcaaggacgtccagaaacaaggcaaaaagcgtgctagtccccaaccattctcgctatccagtctccagagtgccatgaataaacgttatcacgctagcgccagccaaacctcagcggccattcaaagtttatatgaagccaagttgctgagttatccccgaacggattgtgcttatatcactgataaagaatttgagtatttagtggctaatctgacgaagtatctggggttagtctctaagcaagtcgctttaaccgagagtataaaatagtttgtgtaaatgaataaaggccgtgtgtttaacagatccatctggattatagacatcggatttctttaacgtcattacatcactcacccgcagcagggtggccttgccgacttgaaagatagtgtagttacggcgacccgcccgaaaactatctaataaggtgtcttgtaccatttttaagacgttagagtctttgataggcaggacaatttgttgaaccatagttaaattaccacctttcaaaggtcactttattgttagttaaatggctagtatttgtatctttttggtagattgtaaaattaatccgaacgctgttcggacaaaaaagatcagcttcctttaaaatggtgtttaccacaaacgtggacgaattagaagcattgttagctgcataaccttcaacataggatcaatagctggttagatggtcatctctcacactgtttgcaccagatccgattgcagtaataaagttaccacctggaaagaggcatgctcattgcttgcaagggtgtcgatgtgtaatagaaaagttggacaatatcgatttcgaatcatatagccatggcttgatctcagtgttctatcgggatcaagccatttttgtctctaaaaattctggcattattgaaccagtcaacgtaaccatttactaaattacgtagatcagtgaggtcgtcactcttagagtctgtttaaagtcttttgagcatgaaactgaagtatagctcaaaaggggcgtgactacaaaagtagctgatcacatcagtgatgatttgagaggaattttagaatgaagatattaaggtataaggtatatattagctttcgtgtataacttataccttaatatctataatacagacgcctgttttccagggattttttaatattaaaaagtataagttataccttttaatagaaagtataacttatactttactatcttcaaaaataaggtatattttaattggagaaaaaggaggtagcttgaatgctagcaaaaacttttaccgttggtaattttaagggcggtgtcgggaagacaaaaatcactacaatgttggcttatgataatgctaggattaacaaaaagaaaaccttagttattgatattgacccgcaagccaatgcgagtgatgcattggcgcgaactgcaaacttggatcatattgataagacaattgtagatggattgaatgacggagatttgacaacttgtattacttcgattttacctaaccttgatttaattgcttgtaacacgcagtttacaagttttgataagtatgtaattgaaggctttactgatgaaaaggatcgggtttcagttctggcaaagttgattaaacctttgaaacccttatacgaaacaatctatattgacgtgccaccgacaatatcagtctattccgataatgcgatggcggcctcggattattcaatcattgcttttcaaacggttgaagaatctttgtcaggtgttcgaaagtatgtcgggtatcaaaattttatggttgaagcgtatggaatcaacttgcaagtaattgatatactgccctgcatgttgacagcagatgataagttggactatgagatcttagacgaagcccggaaagaatttggtgatgcggtttcagccacggtgatcaactttcagaaacgtttgaaacgttattcgcgagatggtatttctttaaaaaggcacaaaaacggtaatattgatcagtgggattacaaagcacatgaaaagtttattgatattctccacgagattgaatcgcgtgatgcgtacatcaatagttcggtaggataagttggaaggtgatttttttgaaggacagaaaagagttccggagtgaagggcaagaggcaacgccatttaaaaagcttgtcaacagtccaaagaaaaaggtcaacatcaaaggcgaatatgactttacgggaggcggccttaaaattccaacggaaattgttcctaaaattcccctcgaaaaaagctcaaatcagccgactaagagcaaaagacgaggacgtcctattactataaaagaccctagattcaaagtccaagttcccaagaaaatctcccccgcacttaacacaaaattgtcagtacttgaagagtatattacggagcttcaaacagtaactggacgaatcacatttgaagaaatgataaatgcgttatgtgatgcctatgttgctaaatcactgggggtctctaaggaagaacactttcaagaggagcttcaagtggcaatggaaaaactaaaaaaatcttttaaatgaactgtttcaattaaggtataagatatactgggttttaggataaaaaggtatatcttatacctttttattttctatgatgctgttctttactgcgtagtttatatgagtaaaatagaaatggtataagttatacccaaaagaattaaggtatatcgtatactttaaatagatttaaggtataagttatccgcttaattaagcggtataacttataccttaaacgcaaaccttattgagtttccttgccgtaaatgctatattacaagcaacaaaaaaaagtctcaaccaactggcattggtttgagaccggcacatgtacccctttgagaaaaggtgattatggtttaaggacgatactatcctctttgaatgattttaattgtaaccgtaatccagttaaatttcaagaggtgcatggtctatttgagtacaccttttgaagaaacgggatacgtctattctcagctatgtattttgcgcttgttggttcagagcaattaggctaaagatcaagactaaaaaaataaacggcacacgtttataaaagcccatttccaaatctaaaggtggaaatggttttttttgtgcaaaaatgctagaggggactgggaaagatggacgtactgggaactcagaatgtttctgaagcagcaattgtctcaattttgcatcacggcttggctattagcagatttaagcacagtcgattgccggccgccgagcaacgtggtgatcgtccaacaggcgctgtcttcctcacacgcagtaaagaagcacttcaagaggccgttggttttgtgtcaacaagccaagaagctattttagataatgattcatgcagtcactggacacccaatattttccggttcggtacatacgaaaaccccaaccgtcacgtgatctctggtcattcagaggataatctgaaacagattaatacgtttgtcgttgatgctgatttcggtgatcgcaaacctagctattccgtggatttataccacaagtttatagtgaccttggatgacagtcggacggagatttggccaacgattctgcttgaaaccccacatggttatcaagcttactatgtgttggatcgaccagtctttgttagacgacacaacgatcagtttccggcgatcacagcggcaaagatggttagtgaagccattcgtactgctgtggctgagcagttgccacaggttgaccccggagccaatcacttcggtttctttcgcaagccgaatgagcaaaacgtctgcttttttgagccagccttgacacacgattttggcggtttgctggcgtgggctaaacgtctgcaggcgtctgcaggcgaaaaaaatcgggttcattttcgggtcaaacaagcggatcaaccatggtttattgctttaacaagagcacaagtttcccgtggtgacggcatgttagggcgaaacaataccttgttgacgctctgtttagctggctatagttcgggatggacggaaagggaagcttacgactacgcggatcaatggaattctggccaacgggaaccactcagtgatcgcgaggtacagcgaatcgttcacagcgccttttcgggcaaataccaaggcgccaatgcacattatattgccgaactgaccactgcgtacgcacctgacgcggccaaacctaccggaaatcaagtatggtgtaaatacgcaaaagtacgagaggatcgacagtacagtcatttacgtgaatgggccaaagacctggttaaatatgtcaacaacaaaactggtcgaaacgcagattatttacagatcacaacgagagagctacgtgcgcaactcggtatcagtagtcagatgctgacgcgcgtgttgcattatgtggcggagctcagccttctgaaggttgttcgaaagcttggtcggaatgggggcctgtctttagccacgcttcgaatgatggggcgaaccattcaacgaaaaaaacaagcaagcggagatgcttggcgattgttcttggatggtctgagcacatcaagacaatggactagtgagaagattgatcagttatcattgtggccagaaagccatgcgcgtagtggaccataaatgctctactttgccattacattatctagtttagtgtctgctttgcttttcgcgtaagaatctgtctagtatctgttgagtttggtaaaataataaacaaactgtttgaggtttccaccatgtcggagtatcaaagcaacatctctcgagaacaatttgaattgtttagacctgatctagaggacctctgaaaacgtatgaggtcgcgccattatgatcattatgacgtattcaatgctattctttactcgcttacaacgggttgcccatggcgtgaattgccacacgatttctctgaatggcatacagtttaccgttattatgatatgtggcgagacaagccagatcctacggttgattcgctattagaaaagctttaaaaaaaactgtcggtgcctatcgcttcgcgcaaggccgatcgacccgaacgtcgttcatcatcgttgacgcgcagacagtcatgggtactgacctagcaaaaaatagtggctacgatggcggtaaaaagatttcaggaatcaaacgccacatggttgttgatattaatgggttgccgcaggcaatccatatcaatcgcgccaatgtatcagatcgcgaaggtgcccttgctatgttcagtttatctaatcaaatgcttgactcagttcaacgtgtcatagttgatggtggctatactggacaagacttttcggatcaagtgaaacttattttggatgctagtacaacgctggctaagcgcaatgaacttcatacgttcaaagtattgccacaacgatggatcatcggacgttcatggagctggttagataaatgtagccggttatggaaaaactgtgagcgcaagcttaattccagcctccaaatggttctgctagattatttagtgctagcttttagaagatactagacgggttctaactgatgaagacagtggcttaccggttttcttagaaccagaagctgtgcaactacttagtttttggtgccgaactccgcaacaaatgcggcgcttcattggcattatcttaaatgctaagtagtggctgttgaactaggccaccatatcttcgacccttgtagtaaatttatagcgaatttgataggcctcaccccgcactgaaccatcgtcccagacgtattctgaactatcttcgcccatgcgattactaccgatgcatggcgtaacagcctagaccactatcaagaattcgttatcatcgttgcacttgacttgaaaattgaggtaaaaattttgagatgcttggacaaaggtttatcaggtattgattggagctcagggtgagtcacatcatgcaaaggatcatttgactatctgagtcaaaaatccgttgtgatcggtattagaccactgaacttagtttgcgagtgaatgccagataatcatgtcgttgatctgctgagactgttgaaggagcgataagcgtgacaattgatgaagttagtaaaaagtttaatctgacaaaggatacattgcgttactgggaaagaattgggttattgcctgaaattcaacggaatcagagtggttatcgtgactacgatgaacatgcggtcaactgggtttattacatcatggttctccgtaaggctgggatgtcgattgaatcgctttccgagtttgttaagcttttacgggaaggcgatcaaacaattgcagcccgaaagtctttgtttattgaacaacgcgatgctttgattgaacggcgcgataatattaacaagacccttcgctacctagactataaaattgatcattttgaagatcatatgctgggctacgaaaacgagaaactggcctatgaaggtaaattgaccgaagaaaagtaaaaatcgggtattttagccacaaaaaggcgatttttcggcaaaagaacacaaaagagacatgccctgaacgatttttggtactgcatggcgccacgatatggtatcctaagtgaaacataagatgggaatggtgacttcatgcaaacaaaaactttgacacggatgggactattgttggcagttttgattggcttggcctttgcgccaccgatcactgttggctttcttggtgtgccgattgtcttgcagaacatgggtgttatgttggttgcaatgttgttaccaacgcggccagcaacgatcacaattggtatgttattggcattggcagcattaggcttgccagtactgacaggcggtcgaggcggcattgctattttcttaggaccgactgctggtttcatgtatggctggttgttgacaccgatagcatatgcagccataacgcattatctgaaacctgatttttggttaaccaaagtactggggatgacatttggtggggtccttttgacggaatttctgggtgccgcgtggttagctgcgactaccagtttgggctttgtcccagcgcttgcgagtgtcttgatttatattcctggtgacttgctcaagatggcgctcagtgtgttggttgttcaacaattgacagctgtgatcccggccttgcgctagatagcagattcctgcttaaattgaaagtacgaaaaaaccgctgtcggggaaaacttcccgaacaacggtttttatttttccttaatcaacgaataaaagttcaaacgtctgattttttgtgttcagattgacgctgacgtgacgattgagatcactgacaaggttgcgagcaaatgccattttttcttcaaaatcctttaacttagcagtgtaagggattgagttgaaatcaaaattttcgccgatgaaggcggcatccgtgacatacttcagattattctgatcgtgccggctaccgggttttaagaccgcatccaagtagtggtaaagttccgatggtgagtagtgcaacggtttggttagatcggtggtaatggtgaagtcaggtgtatcatcggccatttcttcattgacctgcacctgagtgagtccttgatatagtttcaatataggcacctcgtattcttaagagtcattataacatgctcaatgttgggttaggtgatcaagtgcatcctgaaaggcgacttgcgcttctggcgtcgtttcttttgccaaggccgttttgagaaaagtctcgatttcaggattagacgatggctgtaattcaccaacggcccaagctgcagttgctcgaatcattggtcgcggatcatgctcaatgacctcgagcaagtgaggaatggcgctgcggtcatgcaggttgaccagtgcgataatggcattacgttgcagtggctttttgccgcgccaagcaccagccagtttgccaaagcgcgttttaaagtccttgttggtcagcgttaacattggaatcagttccggtaataccgtttccgggtcgggttccatttctggatggatatgaaaatctttgcctttattaaacggacaaacctgctggcagatatcgcagccgtataggacgttgcgaatcatgggccgaaattctggatccatgtagcctttagtctgggtttgataggaaagacagcgttggccattcatgcgaccgtcaccaagcaaggcttttggcgggcaaaaatcaatacagcgagtacaatcaccgcactgtgaggtcatcggttcgtcaggggcaaacttaatattggtaatgatctcaccgaggtacacatacgaaccaaattcaggggtgatgagtagaccgtttttgccgataaagccgaggccggcgcgttgcgcaacgacaacatcgattaattcacctgtatcgaccatgggtttgaaacgcaagttaggatcattttctgccgttcgtttaataaacttgataagtgacgccatttttcgatcaagcacagtgtgataatcaatgccccagctggcccgcgcaaatcggccacgtttgggtcctgttcgcggcggtcgttcatggattttagccggatacgctaacgcaattgcgattatactttgtggctggtcaaaaattttatcaggatataggcgttcatcgatattttgatgttcaaagccagtcgtatgaccggccgctttttgtgcgagcaagctaggtttaagcgcggcaaaattatcagcggtcgtaaagccgattttgtcgattcccaactctttagcatgggctttaatcatcatttttaaatccatcccggtcacctcttaacgtcattgatgtcattattctagccaagttagagtaggaacgcaaagatgccgattaaatttagctattttttgttgttatcagtatcgttaagaacgcagaaagtgatcacgcataatcaaaaaagaaaccgggactgaaacatcgcctgtcaaagaacaccgcgcttgcgggactcaacagaggtgttttcccagtttcttaatagatgtgctcaaagatattgtctgattgagccatcaactgttgtaactcattcgcgtagctttttactgtagataaagttcgcggagatcccgtttttcagcgggggtcagctttaattcatcttgcaaatagtcgcgcatgctaccatattcagcatcgatcgtggctgaggcgctgtcaagaaaggcacccgaaaccgtgccgagatcttggatgttggcaagaagagcatcagttgcgccatgcttacgagcagctgccaaattcttttcgaccatcggctgaatgagatcgtttgtcgcgaggtagtcttggcgaatggtatgaccatcaacaccgagggctgaaagtagatatactgcgcccatcccggttcgatctttaccggctgtgcaatggaaaagaacagcaccattttcgtcatcgttacttaagaggatgtcgaagaattgacgataagccttttgtgcagaaggcattttgacgatgtcggcgtaggttttaaccatgttttcaaaacctgcgtgcggatcacgtgagaagctcttttgcaaggcatccgcctgttcactactcttggtttcgtctgttgggaaaaccggcacaaaatggtaggtcgcgtgttctgggtatcgatcgggctcagctgcttgttcttcgggtgagcgaaagtcgacatcggcgatgagcccgtaatcggaaaggtattgcaaatcctggtcagataactcgctcaacttagcagagcgaatgactttctgaggtttgactaattgaccggattttgtcttatagccgccgaggtcgcgaaagttaagtccatttttaatgtcaagaacattgggttccaaatttaattcctccatcatgaaaacgtttgactccagtatacgcgaaagttgttggtaccggcaatgcatccttaagttttccagctagttgggcattaggctgtgcttttatgagtgagcgagaatgcattgctttcaagggttatacgtgtataaggcatgtcgactgagcgtatcagaagggacaaaaaaagccgtcaaatgacggctttccttgaagaataactttactcaggctgagcgataattaatccggcaatgaaagccgctaccagcgatttggtgcccgccgcaagcggaacaccattgtatgtcagaactgagttgttgcctaacaagtcctcaacacggattgatggaccatcaccgaccggttgttcgttttcttgcttctgagcatatttatccggataagccacactcaataattcgagcggatctgtattatagtattccgcaagtttgcgaatactccgttcactcggaattgtttgatcgttttcccacttagtaaaactagctggggaagtatgggttgcttttgcaacttcgacgattgattcgccgcgaccctttcggatctgtcgcagcacgctgccaacaccatttgtaatcatatttccaccacatttctttcaattttttttggcgccgaatccttaaattcaagaatgcaagctcactaactttaatatagcattaatgcgtattaaatcaatcataaacccacggaaataaaacatattttaataaataataaccgggttcgatcagattcagtacgcgcatcagtaaagcctgccgttgagtcttattttacagggtcttgggatagattactatgcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagcttacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatccctgccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttatacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtacaaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttgtccttaagactgcaagcatttcactcgctgtcagacttgctgcttgggcgcacatttccagccgtgcgctttccttagcctcctgcgtccctccatcgcttaaacaaaataaactagtgcaggaatctcaacctgcttgtcatcgactacgcctctcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcgatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcttactcattcgccctgttcagactcgctttcgctacggctccgacttttcatcttaacctcgcaagcaaacgtaactcgccggttcattctacaaaaggcacgccattacccattaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcgcttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcatcgccttggtgagccattacctcaccaactagctaatacgccgcgggtccatccaaaagcgatagcttacgccatctttcagccaagaaccatgcggttcttggatctatgcggtattagcatctgtttccaaatgttatcccccacttaagggcaggttacccacgtgttactcacccgtccgccactcgttccatgttgaatctcggtgcaagcaccgatcatcaacgagaactcgttcgacttgcatgtattaggcacgccgccagcgttcatcctgagccaggatcaaactctcatataaatatgagctgttcgaatagctcgatttgttgttctagcgaattgacttcgcaaatgttacttactttgcactaattataatctttactattctttgatgccaataaagcttgcagttatgctgctttcaccagccactaattaagagaggagcatttagtcatgaattattcaatcacacctaacagcaccttcccggttgtcaacatcacaatgggccaagatgaaacgattcaaattgaatccgggtccatgatttatcgcaatggcttggtcgaactcagcggtcatatgaatagtaatggtatgaaagggcttggcggtattatgagtgctatcggccgctcagtcactagcggcgaacgttttttcatcacaaccgccactggcactgccccagatgctgaattggccatcgcccccggtaatcccggcgttattaaagagttaacccttgatgacacccatcaatatcgtttgaacacgggtgcttttctggccatggacaccagcgccagctatcacatggtgagtcaaaaagtcagcggtgctttgtttggtgggactggcgggttcttcattatggaaactgccggaactgggacaatgctcgtctctgcttatggagacatcattccgatcaccttagatggcagtcatgaatatgtgattgataacagtcatgtcgttgcatgggacagcaagctaaattacaacattcaacctgccagcggtatcattggcttcacaactggtgaagggttggtcaaccgctttagtggctctggtactgtgtatattcaaacgcggaacattgaagctttggcaaatctggttcagccatttttgccaagtagcaaagactgattgaattgccctgatttaaggaaagccaatgcacatcaaaaacccgtcaatttttggcgggtttttgatgtatgcaaggaatatcaagcaaaaattgacgacactcgtgtcttgtttgccgaaaatacatgatttgactgtctacatctaaattaggcaaattcttggccattcggtagcattttccgaataccgccagcagggttaggatcatccccacggtatcgcgggatcaaatgcaggtggcaatgcatcactgtttgaccgccatacaggccgacattagcgccaacattataaccatcaggatgatattgctggtcaatcaacgttttgcctgcatgaatgagacgattgatggctaacagctcctcctcgcttaggtcgaagaagttgcttcgatgcgtccgcggaatcacaagcaagtgaccctggctcacaggatgaatatcccaaaaggccactgcgagatcattttcaagaacgatactggtttggggaagatggcaaaagatacagtcggcttgtggcatcatgatttcctttctaattaagtcttaaatcaaaaataagcacaaggcgcttgcagatctgaactgctgcatttgccttgtgcttattattcaatacgatggattatgcttcaagtttctctttacttgaatctgcaatataatgcggcacttcatcatcgatgaaatagaccttgtaccaaacaaggaaggtgtaaatcgtccaaactttccgacgatcatcgctttcctgccgatacgtacgatccaagatatcgagaatggcatcctgatcgaagaattccttgacccagtcttgttcaaacattttgcggaccgtcttgtagaacggttcgtcttccaaccactgcttgaccggcactgggaaaccgagcttttcacgactcgcccattcttccggtaagtgacggttagcagcttcacgcaatgcatacttcgagttgtgcgaattgatcagatacttggttgggataccagccgcgaccttagccacttccttatcaaggaacggtacccgcaattccatcgagttggccatcgacaacttgtcagctttcaaaagaatatcttttggcatgaactggtggatgtcgagatactgcatcttcttaacttcatcatcgtaatgacgtacctttttgtacgaagcggtcacgatgtcacgaacactctcactttgccgaaattccggttgtaagatcttgtcagcctggccctcatgaaaaaccagtgcttcgccgatgaagaattcttcggcaggggctgttgattcataaagatgcaagcggccatggaaattcggcatctttttcaggccatgggcgatcgtatacttaacaccttttggcaacttgcgtaaaccgtccgcaaagactcgaatggcgtggctgcgcgtatggaagccatagttcgcataaccagcaaagagttcatcagcaccttccccagacaaaataacggtcacgtctttgtgtgccagtttcgttaggaagtatagcggtacacaggaaggattggaatccggttcatccaaatgatattgaatcaacgggaagttatctaacgcttctttttcagtaacaatatcactagtgttatccaaaccgagtttgtcactgagttccttagcggcaacgccttcgtgatactttttgttgtcaaaaccaattgagaaggtatgctctggccgcaacaaggcggtgatataagaggaatcgacccctgatgaaagtaaagacccgacttcgacatcggaaatccggtgagcatcaactgactcagaaacactcttgtcaatagctgcaacagtatcttcaaagctcaaattgttcgccttgaaatccatgtcccaatacttcttaatggttaacttgttatccttcaaggtaaaatagtgcccttcaggaatccggtaaacccctttaaagaaagtctcgtccaaagccgagtattggaaagtcaaataaggcttcaatgcttccttattcaattgcttcttaaacttaggatgcttcaaaaatgctttgatttcactacccacaataaaggtatcgccatcgtgatagtaatacattggcttgatcccaaagaaatcacgcgcgccaaacatttccttcttattatcatcccagataaggaaggcgaacatcccgcgaatcttcttgagaagttcgtccatcccatattcctcataaccgtgaagcagaacctcggtatcggaatgggtcttgaacacatgcccagcagcaatcaaatccttgcgaatgctctggaagttataaatttcgccattaaagatgatcgcaactgtgccatcctcattcaggatcggctgcgaaccaccttttaagtcaatgatcgacaaccggcggaatccgagggcaacgttatcattgatatattcgccgctggaattaggaccccggtgtttgatcatatccatcatgttattaataactggctttttatttaaaattgtcttgtccgcaaacgcgatgattccgcacatacagttaaccccttttcgcgtgaatgacgatcattacttgtttcagtataaagatttagcgtcgcaagtcaattcaagagcgtgagcagaatgtttctgcgccagttcgctctcttcgggagaacagtcggaatacgaggcacgttaactagcaacacagaagttttttaaaggtaagcgaacgaatttgagttccatttaaaacgacttcgatattccttatactataaggagtaccgaagtcgctgtcttttaagtcagtttgattttgagcagtttgcttgaagcctgaaacgctcatggtaaataattctacaatgcttccgcatcaaccagaacggaaagatcagttaattcagtaacgctacttatagcaatcaagcctgttagcttcaggcgaacgcatgatgcttaaaataatctgctggttcgatgtccccttgaagctctgagaaaacagcaatttttgcatctactaacaggttctttgacaatttagtcacggttatttgacagacccaaacagccatccgacgacacagttaccatagttgctgtttggctgaacgtttaatgggaaaataagatttcgaacaattaggtagactaattgttcagcgaccactctcgataagctaacaataaacgcacgtgtaggcggccaaactgaagtggacgatgcaaaggacgatttcgtgtttaatctgtcggaaaataaacaagcgaattttgtcaacacctccgactaaagcctgaagcttgtgagagcggggccgaatactatcgcaaccataaatttacttagaacatgttcgagttctctaaaaagtgcggcaattagacatgttagccggataaattgacggtgaaatatcaatacaagtcaagctaggatgaagctttctagaaatcagctcaaaacgcgacgatctcttgaacattctaaacatggctttggcgtatcttcgcgatcgacttatggccgtgtaggattcggataaagcaaatgatcctagtcattagcagcccaaaatcaaatgcgcaaaccatgcgccaggcgtattatcaaagggcgttttggggcactttcgtttaccaccaataacgtgagctagctctttttcgtttaagagttccatgggtattccttctcgtatagttaatttttaagtctcccgacaactcattatgtcactcgtcctcgcatcatgcaatatctaatcgttttattaacatttgtctaatcttgtatttaaaaattttaatttaaggatggtcaggttgtacagtcagtgcttaatcatcaactaagataaatctggaaccatctacacgtatggccattacccaaaagtcgaatctagaacagcgtgttgggtttctttgacttggagattattttcaggtaaattgaattcaaaataaaggaattccttgcggttcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagactttgcactaattataatctttactattctttgatgccaataaagcttgcagttatgctgctttcaccagccactaaatagctaatgatttgaaattaattttgaaataggttaacagtaagcgcgcatatctcgtcatcagctaacctccctgaatcacaacacgttggatcgctattttcagctgcaagtgatagacaccaaataacgtggcaatatagaggctctgcatgaacaatgtcggccaaaagtcggcagcctgctgctgtgataacaactcaccaatcgcaccgaacgcgtattgaaatggcaaaaactgtgcgattgttttcaccgctgctgggtaaaaattcactggaaaaacatttcccgacacggccagcaaaacagcagctttaaacgtattgataccccaaatgctataggtgtaaaaagaaaataaccctatgatcgcctcgagttcaaaatacagtacatatccaagcataaccgccatcaccaacaacggtaacgtctgccacgcaagcgctgactgcctcaccgcgaccaataggatgacatcagggataccgataaaaatcaacttgccaaatgaataaccaacactttcccaaaaataatgggtcagtaacgacactggccgcaataacaggcgggcgatattacctgtacggatatcgtcgtggatagcaaagctagttttcggaaagacggccgtcaatagttgcatgaaaatcaaataagtgatcgtttcggcaaaaacagcacttggccgatgccgtaaaacactttgccacagaaaaaacatcacggcaatcgaaattaaattgccaaacaagtagaagccaaacgcatagcgattggcgacactccttttcaaaccaattcgaatcatcatcagtcttaacgtcattggccgccacctgttgtcagtcctgatgaaatgacatattctaagcgtttattcgcaatcgtcacagaagccagctcggttgtcgcgatgagtcgcctcataaaatcttgaacctctttagaagatagtcccgcgactctaaaatttccattgggtagtgtctgcaccccaacgtcagcaagagccgctggcagattagctgaatcaacgagtgaaaattcgatctgtgatggcgtcgcgatttttgccaaagcttgtgcggaaatgtctgtcaacagttttccgtgatcaagaattaaaatgcgtgagcaaattttttcaacatcctcaagatcgtgcgaggtgtacaacaaggtcttgccttcgacttgttgtaggaacttaacgattttattcttagtgaccacatcaaggccaatagttggttcatccaaaatgatcagctccggatcatgaagcagcgatgccatcacctccgctttcatccgctgacctaagcttaacgttctaaccggttgctgcaaaaagtcttttgcgtccagtaatgatgttaaatgctcaacccgcgctaaaaaatcttcttttgaaatacgataaatctctttatttaataaaaacgtatcataaaccgggagatcccacctaagctgactgcgctgcccgaacacgatgccaatgcgttgcgcatttcgctgccgatattttgtcggatctcccgaaaatgtagcaagtgtcccatcatctgcccgcaaaatccccaacatcatcttgatgagtgttgactttcccgaaccatttaagccgacaatgccaactttttcacctgcctcaatggcaaagctaatatcatcaactgccgtaaaaagtgtgcgtttctttttaacaacgccaatttttgctactttaacgtattgtttcgtaacatggtctacctcgataagcgccatgaagctccttctttcgttcaaatccatgtgtcctcaatgttagtgtcaataaagacatttgtccgtttttgctcagcttcatcgtgcttcctccttaggttttaaaagaataactcctgacatgtgtactttagtagattacagaacgttgtttacgccgtcaaacaaaatcactcgattaaaggtaaacattgtcggtttattatgcctagaatgtttttaacataaattaatcatattattcatatcaagacttttctgttgtataatcctaattctaatttttcaatgaaaaatactaaccgacttaaatgtcactcccatatttccgagtaaaaaattctaactactggaaaagtgttcactagaaccttcaccgccttattagaggtgattttgttagaaaccgatagcagcaagccatttctaactgacaaccaaacccaaacttggatagattggaccctcaagtatctgcaggtcgaaaccgattggcgcggttatgttccggtaaaaaggctgggcgcatggcattcattgcccacagcagtgatgtagccgctcatcctaagataaccacagcgcagcttcagcaggcgttggatgtcgtcgctaatgtcttagctcgacaaaaaaagcccttcctagacgatgaggaagagcggttagccatgatcgttttacgtgttagtcaaaatctaaaccaggcaactggcagcatcagacgcttttttaacgagaccgacattattcgctggactgattatacagagcattcgcataacaacgaagcttattatcgcgtctcgtcgtggatgcgcctgatgatgacgttgtattttatggcaccgtccatgcagccaacactgctgccgttggtgacaaagtattttcagaagatgggttatctcgattaggttatgggtttgtcccgtccgcgccggaacttgcctgcccgtctataccagtattacccgttgcactagatgattgattgccatcgtcagctccggttgacgccccttgatctgtcgctccagtgccagcaccactattgtcggcattcggcgtagttgttgttcctgcgccgctattgtctgtcactgaccccgagctaccgctgccagtattcggcgcataccaactattccaagggttgttatacccatatccgccagtgcttgtacctgtgcctgtctgcccgttaccaacgttacctgactggccggtttcagcagattgcccactagctgattggtcagtctgatcctgttggccttgcacctcagaagctgtattgctactctcagctggttgactagcctgaccttcatcctgcgtcatctgccgtaagcgttcagcatagcgttcactcagatgctgaatctcagtacttaaagtcttaaaattcttatcagtgtagacaatatctctctgtgtattaagcacatcggttaaagcatttaacccagcgagcttcgcctgaaggtctttcttcttgatgtctttcaattggtcatcagtcagcttatttttcttcaggctcttttgattcttgtcagtaaaataggccttttccttgttgatgagttccttataaagcgctatgaccggctgttttctatctgcacgcagcgaatacgcctcactacgcgtctcaagattcgccagtgcctgcaatcgtttggcatcatccttcagcgccacattctttttatgttgtgctcttatagcggttaatgtttgatcaaccttagcattgcgcgcttgaatcgcttgttcagcttgcgttttgttatgccttgcgaccccaaaaatgagtgccgcaatcacgacgaccacggccaaactaattaagaccagttttctccttttcatcactcaatcaaaatatgtagatcacacacggcgatctatctatttttcctccaaatttttatagtttaacgattccccaaatacggtggcgcaaaaaggctacaggcttatgcaccattctcctattaattctaccatgtgaagttttaaaatgttataggcgtccataaatcttgctttcagaaatcagcatgcttcagtgcttgccatagttgctgccctcgtgatacatttttgatgagtactagcatgagctttttcatttaacaaacagcacagtcattcttccttccacaaatggaacctcaaaatcgcacaactatttaaacaaataaatccgacaatccgaatgtgaggatactgatgaaagcgacttataaagatcaatccgccgaagtttgggaaattagtaaaaacaacgaattccctgactgggtcaaagaagcttttgaaaagaactaccttgtttggttggatgaccgacttcgtattttaatggccggtttgtttccgccaatgatcgaaagcttacaacgtgacaaagccagcatttttcacgctcaaggcgttcagtttggggtcgtgacaattggctatctaggtgactatttggacgtcacaaatcaccgcgtcgtctctaagcagcagtttgctaggcagtatcgaattgaaaaaacaggcaaccaattttaatcccacattaagtaaaaacgcatgtgaacagactagttcagactagatgatcacatgcgtttttttacgggtctacactttctggtgttgagaaataatcaacactgaacgtgtaggccctttttggataacgcaaaaagacaccaacacagaagttaagcttcttcacgccgagagtagttggtgggaaactgcctgcgagggtaggaagctgccacgctttttttattccggtttagctcagttggtagagcacctgactgttaatcaggttgtcgtcagttcgagcctgacaaccggagctcatgagacatcctgcaaagggtgtctttttttaatattatttgcaggtctttaaacaaggattaagaacaggctggaccagtcatgaataactggtttaacttgacccgctgtacgatcactctcataatatgtaccagccatcacaaatgaaagaagtgacagacatggacaatcgattacaattacgccaacaaaataaaaagcacgcccatcgtggacttaagatcttttcaattatcatgggtgtgttgatcttgctcattatcgcaggggttttctttttccctcaactgaataacacggttcgtaatgtgacgggtaatgacacgcctgttgattctgcagttaaagctcgtctcgtttccggcattacagctcaaaagactggtgatgcgacaaccgatgcagctatccaacgggctgccgatacgttgaaagcaaccaaaatgagtacgattatggctgccgctaaggatcaagatcaggctgcttcacttttacaaaaggcatctggtgttaatcatagtcaagcagaaatggctgctgcggcgctttttcaggagagttctgtaacgccaattcgccaagcgattgcatcaggcgattactatcaggcttatcaagatgctaaaacgctgcaacaacagggtggaacaagtgccttaactagtttcttgtcaggacaatgactcagagcatcgattaacctgcaacacaatcattcgaaagctgaatgttgtgttgcaggtttttttaataagaatgcgcctcgaatgtgtgaaaaggtaagaggcgcttttatgtaaaagaaaagccactcccgaagaaatggcttttgatcttaaatcttgttggggtgattttgtgagtgaacgcgatacgagaaaatgagttcgttatgtgcgcgaatcaatcggcccgatactgtctggtctgacatcaccatgccacctggcagtaatgcatggtggtactgataaccagggaaaaaaggtgccgttagttcgaactgatgacctgtctttgtgtgcaagacctgcacatcacgtaagtcttgttgatgttcatccacatatttaatcaccaatgttgctggtgtcggctgtgacgttaaagaggctgttgcgctgtaaataaagatcagttgttgttcatctttggtcatgactccgaccactgtaggatcgccaacctcactgccatctggtagaacagccttctgaaagttatagccaatcagagttggtgccgttagccgaaaacgctgacccaccgcgttcgttaaatggttctcaggtccaagcgacttgccggtctcatcaacataatgaatggttaattttacttgtgccaaaatgtcccttcctctgtgatgtccagaaaatgttgcggttaagcattgcgagctgtgaagcgtgcttgtttgatggtcgggttttcgagctcatctagcaaggcaacggaaagtgtgtcgctatttaagacagatttgccgctatcatctttcaacagctcgtctttaccacgtacgtaggctgtagctggtccaggctgaaagttagcgcttggcgaaataccaagccagtttacattatcggtccaccgtaacaactgcagttcccgaaattgattcaatggtgtattaataaaagcagcagcgtgtggatctttttttagtgtatcatacaatgtctggtcgccattctttagactgcctgcgccgagaataaaaatcacacgtggcttatcagtgttgcgtaactcatgaattaagtggtcggccagatcaatgtggagataagcttgctcaacagttgtcgcaaaagcatcaataacagcgtcataacccgtcaactgctcgcgcgtcaacgtgaacgcatcttgttgaatcagatctgcatccggtggcaagattccaacacttttatctggatggcgaacataaccggtcacttcatggcctcgtttgagggcctccttaaaaatagccgaacctgcatgtcctgtggcaccaataatcgcaatcttcgtctaaaacaacatcctttcatgacgattcgtttctttttcatgatacacttacaaaaagtagatggacaatcattttaacttagaaaatgattctgccaatgatctcatttaccatcaaaaaatgctttacagtgcgatagtgctcctgtataatcttatttgttgttcagcaatggcccgttggtcaagtggttaagacaccgccctttcacggcggtaacatgggttcaaatcccgtacgggtcagtatgccggcttagctcagttggtagagcatcggtatcgtaaaccgagggtcacaggttcgactcctgcagccggcatcttttcatgagtgattcttcgtggaacgtcactcgttgaacacgttagtccttccagttattaactggaaggatttttttgttcaatgtgtagcttcattcgagcgacatgccgccattaactcagcgtgaagaggtcaaaactgattcgtgacagacgtttgtcatcaacatttcttcggttaagcactgaactaaccaccacgctttacatctatcgctcgcgcactcatgctactttctatgatatcatcatacggtaacttaattgtttgaaggggtgcggcatgcatagacaggaaacaaaatcgaaaaagggactcatctggggtattgccatcttggccgttgtgttattgggcggcggtatttggtttggtgttcatcaacaggcacaagcaaaggcggcggccgcctctgcttcaagctctaaagcagcggttcgctcgcgagcttcggctaaaaagatgcgggaggcaacacaagcttctgagaaggccaaagatccagtttataaagactttgccgctgacggcctcagttttaatcaagtgcaagcggccaagcaactggatgtgacagcagtgggtgattcggtcatgctgggtagcgaatatttatacaaggaacttttcccgaagatttattttgatgctggtgtgagtcgacaaatttatgaagcaccggatttgttcaaatcattagcggcttcaggcaagcttgctgacacggtgattatcggcttgggaagcaatggcacatttaccgatgctgagttcgcgtcaattatgaatactcttggcagcaagcggcaggtatattggattaatgtccatgcagatacgacttggacagatgaagttaatcgcgatcttgtttcaatgagtcatcgttatcaaaatctgcacattgttgattggcacaaggcgtcagaaggccatgatgattggtttgtagcggacaaaacgcatccgaccacagagggccagccgcattatgtcgcaaccgttgcaaaagcggttttggcgaaagttaaataaagtcaattggagtcacgattggcgtctgtgcgcagtacttgagactgatcacagacgctttttcaaatcctatgagcaatgccatgtatgcaaaagtggcctgtcagattagcatttgtttgatttttttccttgctcgtgcgaaaacatgctatgctaccagtagcacaaaattggtgacgaaagcgggatgagcgcgatgcaggccttgatagatgtacgggaatcgggcgcttacttactgatgagcgttggtggcagtggcgctttgcggcggcatcttgccgaaatgggcttagtcgtgggcaaaaaagtgaccgtggttcagcctgcaagcaagttgtcaggcatggtgattttttttcaaggtcagcgattagcaattagcgatgaaattgcctcgttactcgtggttcgaccgtttgccatggatgctgatacccctgccattgccttggctgatctgccattgcggcaggcaggcttgatccgcacgattaaaggggatccaccgttgcgtcaccgcctaatggatatgggtctcaccaaaggcacgttggtcaaaattcatcagattgcgcctttgggtgatccgattgagctagcggtccgtggttacaaattgagcattcgcaagcaggatgcggcacatgtgctggtgacggaggtgacaagcgatggcgatacgtgaaacgttagcattggtaggcaatcctaacagcgggaaaaccacgttgttcaatgccttaaccggcgctaagcagcatattggtaactggccaggggtgacagttgagcgtaaatctggccggctgaaagcggataatgccttagaacctgtctagcatcttttaagaactatgttcaagaaggccaatacaaccatttgaagactgctgttaagggcgcgttcacagtttttccaaagtcgccgacatttgtctagccaactccatgaacgttcaatgatccatcgttgcggtaaccgcactgaaccatcgtcccagacgtattctgaactatcttcgcccatgcgattactaccgatgcatggcgtaacagcctagaccactatcaagaattcgttatcatcgttgcacttgacttgaaaattgaggtaggaaaaaacgcccatttcttgaaccgaaaagagagctttatgagcttaaatctttctcataagccccttaagctaagtcgctatttgatcttagctctcaattgacttttgacatgccattaatttatcaagtgtctctgtatacttttttctgtctgctgcattgaggccattgaaaacggtgatggggacagaagtattgtacttttgaattaggttagaaatatctttgactaactctgccagaacattactagacttagtgttttcgtaatatccacgttttggagaaaccaaacgaccggttgtccgaagtcgccgtaatacgccagcgatttgtccgtcagaaaattcttctttaaaagcagtgtaaatttcttccgctttaacaatacggtgcttttctccaacaaattttgtgatctgagacgctaaattatttgattccattttgattttccctcttgcgactaaaaagccagaagtataattcatgctacgaaccgattttatccccatgtgttcaacatgtcaaacgtttaaacaagcaacaatatcgactaaatcataaaatgccaaacattccaaaaatgaccatctaacttaccacgttcgcctctcccttttacttttcagcatcattagtacgaaccagtgctatcataaagtcatctgaaaggaagcgtggctatggatcagtttgtgaatcacctgagttgtacagcgttgcttgttggtaagaaggcgtcggttgatggatcgacgatgattgcgcgaaatgaggatgctagcggtgggattaatccgaagcgtttcattgttgtgcagccggctgatcagccgcaacggtacgtatcgacattgaatgggtttcagttggatttaccgcaaacaccgttgcagtatacttgcacgccggttgctgatcaaagtcatgggacttggggtgaagctggtatcaacagcgagaatgtggcgatgagtgcaactgaaactgagttcacaaacaccacaatgctgggattggactcgcttgagccggacggtattggtgaagaggccatgttgacggtggtattgccttatattcacaacgctcgcgaaggtgtcggacgcctgggcgagttggtcaccaagtatggtacctgcgaaagtaatggcatcgccttttctgatgctaacgaaatctggtattttgaaacagttggcggccatcactgggcggcggaacggattcctgatgatcgttatgtgctggctccgaatcaaactggtattcaggagattgattttcaggcaccggaacattacaagtacagtgctgatctcaaagactttgcagctaagtatcatttgaataaggcaaaggaagggttcaattttcgagacattttcggtgaagatacgcaggccgatcattattacaatacgccgcgggtttggtatgcccagaagatgctgaatcctgaaattgatcaagatcctgaaagccgaacgatgccgtttagtcgtgtcccgagtcacttgatttcagtcgaagatgtagcgatggtattgagcagtcattaccaagccaccgactttgatccttacgggcagaccggcatgcctgagacgcggcggcgctatcgtccgattggcatgaatcgcaatcaagaaatgcatattctacaaattcggccaaatatgccgaagagtcatgctgccattcactggcttgcggaaggcgttaatattttcaacagcccggtaccatttttcgccaattgcacaacgacaccggagaatttccagtacacgccgattgataaaagttcaaccgatagcttctattggctcaacaagctaatcgctatggtggctgatccgttgtttgcagaacatgactgggatgccgagttcgccgtatctgaaagtcgcaagtttggtttcgctgccggccgtgccgctgtggccaaaggggatgcggcttttgccgatgtcaaaccagaagatctgccagcgtggcatgatgcgttgaacgccgaaacggcagcgacgatcacgaatgacctacaatacctcttacaccagctggtttgcatccgcgcggagaaaatgacaccaagctttgaaaaaggcggggaactttaatcggactgcgaacttagcgcaggtgcgaccggtaaaagaagcagtatgtcaaaaaaataaacgctcagtcctactgacggattttcatcagcggggctgggcgtttataataggcaatatgcttttgacaagtatattgacagaaagaaggtcatcgcattaaaaatacgaaaacggaacgctggatcggtttgatggttggcttagttctgaacgctgccggaaatggcctttgtattgttggggctatgggcagtggcttatggacggcggccgccattaacttgaatgactggcaagggtggaatattggcgcggtactgtttacctttggggtactgaacgcgctatcgaatctgttgttaattcggcgctgggattggccgcggttgatcggcgaagtgatatatacactgttcttcagctattttgtcaatgtctttacttggctattcacatggctcggacttggcaactggccaatggtggcgcgcattttcgtctcctgcttcggggtcttctgtttttgtgtagcgatttcgctctatcaacgcgccaacatcatcatgcatccaaacgatgacaccaccaatatcctgcgatttctctattttcaaggcaacgccactgcttcccagattactgattttatccccccaatcatcgtgatcgtagttgcgtggatcgcgacaggtaagctcttaggcatcaatatcgcgacattgttctcatttctcggcaacggcatcatcattgcatgggcagacgagcatgtttggccgcggttggtacataactttaaggtgaagcctagcgaagcgaaatgatatgcctattttcctcaataatcgttccttgggatgcaaataaagctataaacgttttgcacaaaaaaggctccgcaactgacttgattgtctgcggaaccttcttttagtacatggttgatcgaatttaaacttaccgtgattttcgtgctgatgactgtaaaccagtcgattaaaagaaaatcttgggtaaataatacggcgttactgaacttgggatgccgttggtgacggctaggaaggtgaaaccatacaccaccatcaggaacataactagcataaacaagtagcattctttttgtcgctgcaagatggttggcgaagtccatagtaagtcttcgggtcgatggatgtcatcttcaatgagcgccagtaagcgggaatattgataccaccacgtcatgacaccaaaggaccccacgatgcttgccaaaatcagcagcaaattccgcgagccatctgattggcttaaggcccagaggcgagtcatgccaacgggaacgagattgaaaagcagtccaaactgaatacttactgcaccgacaaaaagtgtcgccgttatgatcaagaagatgcgcgaaataattcgcaatattctgagtagcagatgccgtgcgtaaattgttttcttataaaaaacacgcgcatggtagatttgttctcgggtcatctgcggaagtctttcctgctgaaaggaaatagctttctcatcttcgactcgaatgattcgtgctggcacaaagaaaattgcgaagatgactaatatgactatcagacgcaacatgaggaatcctttctgaggttgattttgagttgctgatagaaagcaaagtggcattaaggatgagtggcgatatctgaatgccaaaggtgagaactccagttcatgagttgggtattatggtttaggttgatgtcttgcttcttaacaacgctgtttttaaatatccaagtatgagttttagtgagtcgtgaattcgttgaggcgacgatatatggagccctagattgcaataataaagttaccacccagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccccgcactgaaccatcgtcccagacgtattctgaactatcttcgcccatgcgattactaccgatgcatggcgtaacagcctagaccactatcaagaattcgttatcatcgttgcacttgacttgaaaattgaggttgccaagatacttttgttaaatcgggatttgaaactatctagtaaggggctgagtaggttaatcaatccccagaacccttatatagttctcactactctagatggaagacttgactttacatttatctctatgtcaaatttaaaaaagctaaaatctgagttaatgtcacttgagattaagtctatggattaagctgataaagtccgaggaagtagctgaaatttcctaacgccagaattttgtgacgatgaagactgtaactgtatgtttctgtttgtaacaaaacaggcgtggttctgtgtgcagacgcgatgtcattgttttcaagccaccatttcttcaagaagtggtggctttttgtagacttcatgcgtaccgataagcacaccttaacatattggcaattatcaacgcagtgcgcaaatgtctggtaaacttgagccaagaaagaggggtggcgcaatgaatctagaagaaaaatttgctttcatggcaactggtaagccatacgacgacatggaccctttgttactggctgtgcgggatgaagcaactgccaaaactgatgcgcttaacaatgaacacgatccagccaaacgcaatgccttgtttagggaattggtaggccaaactggcgtcaaaccgtttgtgaatccaaactttcattgtgagtttggccggaatatccgcgtaggtgatcatttttatgccaattatgactgtaccattttggacggggcgccggtgaccattggcgatcacgttttgtttggcccgaaagtcggtttgtacaccagcaaccacctttttgatccacttgaacgacaacttggtggctgcattgctaaaccgattgtagtcggggatggctgttggctcgctgccaatgtgacggtgcgacccggcgtcacgattggtgcggggacgattatcggggcaggtagtgttgtcacccacgacatcccagcgcgcgtgattgcggcgggtaatccttgcgaagtgctgcgcgagatcacggctactgataaaacagggtttgcagggcatgacatgatctaaacgccaaatcgatacttgaaattaacaatcgacaagcgcatcctaacaatattcacaaagactaaggtgctccgagtgagcatgaattgccaagttaatcatcgaaaggaagtgcaggatgacagacaaacgtgaaactttaatgtcgatgctaagcaaggcatacgctaacccaacgatcaaagcagagccggcattacgggcgcttatcgaaaccaacgccaaaaaggttgatgaaggtgatgacgaaaaggcttatgtgacggctgtcactcagttgtcccacgacatttccaaatactatctgattcatcacgccgtaccagaagagctggtggccgtcttcaattacatcaaaaaagatgtacctgctgccgatattgatgcagcacgttatcgcgcgcaagccttggccgctggcttagttgccattcccattgtttgggggcattagccgatgtacaactgtgaattttaaacggtgaggctaaagttgatgatcaagcaatcagttatcatttgcaaaaaaacgtcgcagactaagatctgcggctattttttttgccatgaaacttgttgacaccagttaagaaaaaccgagtagcagatcgataaagagaaaatttggtcgatatttgacaaaaaagcgacgttaatcgggcaaaaccctacgtttaaaaaaagtttgcgctgttgtgtgaactatccagtatagtgtgcgtaaaagcatccgcgagaaaaagtcgaggttcatctggacggggggatacaagttggcgatgacgttgaataaagcaattcattatcttttactgataggcatcagtggtgtctttctttttacgctggctgccgccatgggctgggtcaaccaaggtgactttgcgctgccactactgcttttggcggcaggactcacgttgttgcgggaagctgatgccggatatgaaaaagcgaggcattgaattgggtctgcttagaaggcagaaaaacgtgaagccgaatttctgtacacaaggacaaactgattttaaaatgtaatcggttacgatgactcatatctaaaagagttcagatacaagacggtatcaagatccatcagtcgggctataaagccattgttttccggtgctttgcctaaaaaccatagcatcgatacttttcaaacatttctatagaaaaattgtcacgacatcaaaggaaatggtgacatatcatgaacatgattcagcgaaataaagtctattttattatgacagggctcaacgaaagctttcaaaaaactgcaaccgtcagtgtcatgaataccgatgcacaagaagtcatcaatgatgcgctccacattttggaaaaagaaaatgtgcttcaaaatagagccattgactacgcattagctcgcctgtattctcgctttgttcgcttaattgggttgcaggggatgaaattatcgccggaagctgatcaatggtggcaacaactgaaagatttcatggagaatgatattcatgaagagctgagtcaggttggcggaccgcaattcattacttgatcggtttgttcccaatattggcacacgcaaatgcgaagtcagaagtcgagtgttacgctgtttacactgtgacttaccactttatttagactggttggagaaggggcacgatgagatgcatcgaataaagaatgatgatttgcaacaaatgattgaagggatgacctggcgtaaattcctgacaatgctgattttaggattgattgtgatagatgcttggtcacacactgaccaaattattgcggggtttttgaagggatggcagggcatgtaggtgtttgtgaccggtgaagaattgcgccaattgcaagctccgcgactttttcaacactgcagcgtcacttcttcttggcttagcgtagcgtcgtttgccgagtgaagtggctttttttgtcaataaatgaccgctagcgaatttttgacggatgatcgccaacgttaaatggcgaaaacacgacgtttaaaattagttgactaaaagccattcattaaccggtatattgttcatagcaatgtcgtaaaaatgccggctttgtcaacttggatgaaggtgacggaatggaaaagaaacggcaacggttgttcacgcctgggttacgtgttttatacatttttatcttggatgaacttatagaagcatttgtgttcaccccatttttgaattttctacagctggatttttgggcagacattgtgctctataaagtacttagtttagttatcattctggggctcaatctgttgctgttaagacaaaagattatctttaggacgtcatttggctggccaagctggcagaaatttgtgttctgggatattgtgggctgccttgtggcttggcaaatccttaccaatcgaaacttcttagatattttacaagcaagtgtcattggtaccatcgccgctgttcctgaagagtacctgtatcgcggggttattttcggtggcttgctccgcgccttttaccttgctaaccgtggtggtaccaaacgtaactttctctattgcatgttactaagcagtctggcgttttcgcttgcacacttgagtaatctgccaagccaaggtgctgttgcaactgtgggtcagatgattcaagtcagcgggatgggcatgctgctggctgctctctacgttcgttatggcacattgctgatgccgatttttgttcatttcatgatcgacttcttggtaacgctgattcacggcccttatcccagcaaattaaatggggtaagtgacgaaacgacgctcataatcgtttcggtgatctgggcaggcatttacttggccatttccatgtggaccctatggcactgtcatgacaaagaagggttcatggcaaggttgtcaaaatgaggtttatgtcggaacagcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagagaccaatctcaccactgagcccatcgccgctccgccaactctctgctttctatcctagtattcgagctagattgcccatggcactgcctcttgaagcgtttaagacagtggcaggcgcctgcgaagttaacgcgaactaccgttagttcaccagctcccagaagaaagatgaacttgccagaatataacacaccttatcttgttgcacgtgaaaactaggtgttacacttactcatatcacattcaattggaggcataacatggctgatttgtggcggacaatttctgaacggcacggcgagttgcttagtgccttggggcaacatatcgaaatatccttaattgccttgatgatcgccgttgtgattgcgattccattggccgtttgggtccagacgcatcacaaaaccgcggcagggctgctgcaagtgactggtgttttgcaaaccattccttcgttggccttgttagggttgttgattccgtttgtgggtatcgggacactgccagcgattattgctttagtggtgtatgctttattgccgatttttcaaaatacatatatcggtttacgcgatattgatccttcctatgaagaagcagccgatgcgtttggcatgagtcgattgcggaagttgttcaaagttgaattgcccatcgccttaccggttatcttgtcgggtgtccggacggcaatggtcatgattattggaaccgcgacgctggcagctttgatcggcgccggtggcttaggtacgttcattttgctaggtattgatcgaaatgatgcggcgttaacgttaatgggtgctttggcagcagcgctattggcgattgtcttttcgtggctcttaaatgtcatgcaaaaagtcagttggaaggtcagtgtcggggttgtggcggttgccgtccttggtatggttggcagccaagtatacacttatgcgaccgcaccaaaggaaactatcacgattgcgggaaaactaggcagtgaaccggatattttgatcaatatgtacaaagaactcattcaaaaagttgatcctgatgtcggggtcacgttgaaatcgaactttggacagacgagcttcttgtacaatgcgttgagaaccgataagatcggcatataccctgagttttccgggacggttctggcaagtttgacgaaaccatctgccgctcagcaacaacaggtgacggctggtaaagataattatccacttgcaaagaaactgcttgctaaacaaggcctgagttatctcaaaccgatggcgtataacaacacctatgctttagtcgttaaggaaagttttgccaagcgttatgatctgcataccattagcgatcttggcaaaattgcaccatccattcgcgccggatttgatttagagttcattgaccggcaagatgggtataagggcatccaatcaaaatacggcttgcagtttaaggtggattcaatggatgcttccttgcgttaccaagctttagaccgcgggcagatcaatttgaccgatgggtatacgactgatgcgcaattgcggcaatatcatctggtggcgttgcaagatgataaggggttgtttccgatttatcgcggtgcaccattgatgcgaacggcctttgccgaaaaacacccgcaacttgtagctacattgaacaagttggctggtcaaattacggaaaaacagatgcagaccatgaattatgccgtgagtgtgaagaacgaaaaggccgcaactgtggctcaccgctatttggttcagcatggcttgctgaaggaggtgcgctgatggcattgatcagtcttgaacacgtcacaaaggaatatgacggcaagcccgtggtcaacgatcttagcctgaaggtcgatcaaggggagttgtttgtgctagtcggcacctccggcagcggcaaaaccacgacactgaaaatgatcaatcgtttggttgatccaacgagcggcgttatcgaatttgccgacaaaccgctcaccagttacaaaatgcgcgacttgcggtgggatctggggtatgtcctgcagcagatcgccttgtttccaaccatgacagtggcgcaaaatattgccgtgatccccgaaatgaagggctggtcgcgccaaaaaattcggacggcaacagacgagttactcacaacagttgatttgccgccagccgagtaccgcaatcgcatgccaagcgaattatccggcgggcagcagcaacgcatcggtattttgcgggccttagcatcacggcctaaggtggtcttgatggacgaaccgttctcagcattagatccgatttcccgcactcagcttcaggacatgctgctgcatttgcatcgtgccttgaagaccactatcatttttgtgacccacgatatggctgaagcgatgaaacttggtgatcggatcggcgtgatgcgcggtggcaaactcttgcaggttgatacgccggaagaaattgcgaccaatccggctaacgatttcgtggcggatttgttcaagggagcgcaagccaatcagggtctgcaggtcacgctcagtcagttagcaccatttgcagcggatgtgtcggcccggcatgcggttggcggcaacttgacgctggccgaggcgttgccgcttttagatgcgcatgaggcgttgcgcgtgaatagtgaacatggtgcgtttgtggtcaatacccatagtgttgtcgcttatctcgcaagtgcatttgtcgatcagaacacagagacgaaggagtgatcgtgatggcttatgattatggaacgattgtgattggtggcggcccaggcggcttagcagcagcttacggtttagcagcaaagcaaaaagtattagtcgttgaaaacgatttgtggggcggcacctgtcccaactatggctgcgatccgaaaaaaatgctgtatcgcggtgtcgaagttaaaaatgctgccttgcggatgaatggttttgggatcagcgggacggcgaagattgactggccatccttaatggccttcaagcgcagttacacaaccggcgtacctgctggcacattgaatggcctgactcatgctgggatcacgacgttgtatggtcatgctcagcttttgggcgaacatgctgtcaaagttggctcccaaaacgtgaccggtgaacatattgtgattgcaactgggcatacgcctcgttatccggacatccctggggccaatctgcttaaaacgagtcgggattttctggaccttgatcagttaccaaccagcattgccttcatcggagccggttatgtcagtgtcgaactggctaacatcgctgcagcggctggcgcggatgtgcatatcatcggtcattctgatcggttgttacgggcattccccaaagttgctaccgaagctttaaaaccattgcttgccaagaccgggattcattttcatcctaatgtcgaactgactaaaatcacgcccttaggtaccatgacccatctacatgctgataacttcgatttgaatgttgacatggcaatcactgccatgggtcgtatcgccaatgttgccgacctcgggctagccaatgctggtattaaggctgatacgcgtggtattccggttgacgaccatcttcgcaccgcagttgagacgatttatgcaatcggcgatgtcaatttgaagccacagcctaaattaacaccggtggccggcttcgaaggcagctatgttgccgagcagattttaggcgaccaagcacccattagctattcggccattccgactatcgtctttggcccaacggagttagccaaagtcggtgtgtcactggagacggcggaagcagcacctgatcaatacaccgtcaagcacaacgagacaacccactggtacacctataatcgaattcaggatcctgacgcacaagtttggaccattgtcgacaaaaagaccggccgacttgccggcgctgtcgtcttagccagcttggctgaggacttgatcaataccttcgcagcggccattgatgctggtgaaaagccgagtgatttaaacaagatctatgcttatccaagtgcgcagagtgatttgcagtatctcttttgatatgggatgatatgaccttaattggtatgtccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctaattattttcgacacaatagttaaatacgaaaaacaccttgatgatatttttgccaactggcaactcttttcatcaaggtgtttttcgtaagttattaatttttagtggttgacgtgtttgtcgtgaaggtcacgttaatgactttagcgggtaacttgttaacggttcgggcagggttgccgaccactgtggttttatcggccacgttattcaggacaattgcccctgcgccaactttactaaaggcgccgatcgtaatggtgccaagcaattgggcgttggcaccaatgaatgcacccttttttacatagggatgtcgccgaccttcaacggccctcctggcacccagcgtcacgccatgcaggatagtgacgtcatcttcaatcacggcagtggcaccgatcacaacgccaatcccgtgatcgataaaaacgcgcttaccgattttggcttccggcgaaattgaaatcccggttactttggcggcatattgacttaggaacccggcaattgtataaagtcgatgaaaagccataaagtgagcgattcggtaccaaaacagggcccgaatccccgggtaggttaagagaacttctaaaagactgtgggctgccggatcacgcttgagaatggaccttgctgtctgaaacatttttcttgctcctcttaagctcattgaagccgcgttccaaatcggctaacaaatccttttgatcttcaacgccgactgaaaggcgaattaactcgtctttgattccgtttttcaaccgaatgtcacgtggaattgagccgtgggtcatcaaggccggaatttcgatcaagctttccagtgcacccaaactctcggccaatgtgataacgtgcagttgttcaacaaattgttttggatccagtccgtcctgtaactcaaaggaaatcattgcgccaaagccgtgcatttgttttttggcgacttcgtaatcagggttgttcggatcgccagggtagtaaattttgctgacaagtggctggtttgatagataattgaagacggcttcggcattggccaaatgagcacgcattcgaagagacaacgttttaatcccacgttgcaatagccaactttcctgaggggccaaaataccaccaatggcattttgaaggtaaccaattttttcggccaattgatcatctttagtgacgaccagcccggcaatgacgtcgctgtgaccaccaagatacttggaagcactgtgaagaacaatatccactccctgttccagcggtcgctgaacgtaaggcgaggagaaagtgttgtcgataatgcttaaaatttggtgcgatttggcaatcttggcaaccgctgcaatatcggttactcgtaaaagcgggttggttggcgtttccaagtaaattgctttggtatttggcgtaatcgcttcttcaacagcggccaggtcgcgggtgtcaaccacggtaaaggtcatgccaaagcgttttaaaacggcgtcaatcaatcggaaggtaccaccgtagacatcattgccaatgacgaaatggtcgccggcggagaacattgagaagactgtgtcgattgcagttgaaccggaagcaaatgcaaatccggctgtgccgccttccaactcggcaattagtttttcaactgcttctcgagttgggtttccagaacgagaatactcatattgattttcaccgattttttgctgatgaaaagttgatgccatataaatcggcaccgaaactgctccggttgctttatcttcgctaataccaccatgaattaattttgtatcaaattccattttaataacctcactttatttttaatcataaatattttcactcatgtaacgttcactgctatctggaaaaattgtgacaatggtactattctcgggaagtgccttggcaacctttaagctggcagccaaagcagccccgcttgaactgccaatgaataatccctgcttcttggcaagctccttaacttgatgaaaggcgtcggcatcggcaattgttaacgttttgtcgatttgaacatctttaaaaaatggtgggacaaattcaacaccgatgccttcagtccgatggggatgggcaggcccaccatttagaattgagccttcaggttccacaacgatggtttgagtcgccggattctgctcctttaagtaacgagcgacgcctgcaaatgtcccaccactgcccgcaccggcaacaaaggcgtcaattgggtcattgaggtcgtcaagcaactctggtgccagagtgtgataataagtatcagggttggccggatttttgaattgcattggaacgaaactgttaggagtttgatcgtgaagcgcttctgctttttcaatggcgcccttgatgccctgatcactgggggtgttgattaattttgcccctaaggctttcatcaattgttgtttttcaaaactgaacttttccggtacgaccagaatggttggcaaatggtgttgttgagcggcaagggcaaccccaattccggtattgccggcagtaggttcgataattgttgttacaccttcagttacctgaccacgattaatcgcatcttgaatcatgtattggcccaggcggtctttgatgctgcctcctggattaaacatctccagtttggcgtaaatgtgactgtgatttggaatgttgatttgcagatcaatcagtggcgtatgaccgatcagttctgaaatggaatgaataagcataaataagatcctttctaatcatttggagcagtgtttagctggcgggatgctaggggaaatggccgcaatagatagaaaaagggcgcgaaattctgaaatccagaattttcgcgcccttagttcaactccagccaagtggacattgaactctttttaggtcatgatttcccaaaaaacgtcaatgctaacaggccgaacatcgccaaaaacgcgttgttcgacagcaacaattaatcgcattaaacattgattgactcatcatgacacctccgaaatttttattgtgattaatgtacacaatttcgagacatctgtcaatcatttttgagctaaaaaataaaaaagtcatgataaatagttgaaatttctagtagcttgaaaatattttttctctggtgttattttcaaattctgtttcgtgaatgttttaatttgcttttgttatattagttatattgttgataagattgaatgtcatcttattcagataagagcgagacatactgcaagcaagaacattgcgatatatttttttaatttacattatgaggttcatattaaatttattggaacagaggtttcgaatttaatggttagctcaatattagttttctattttttagttgtttatctttttcagctttattctatcccagctatattaaattatgaagtctaaacgccaagcggttcgcgtataataaactagtgagtaatttaaaagtgggggaaggactgtttttatgttggaactgtcgtttgaaaaagaagttgttaaaacagccggtttgcctttgcgcgaatatgagtgacgcaggtgcgcatctgtcaatgttgtctcaaataaacgactggtatattgactacccatatcgctatgcaccatcttaaaagtataaccttggtgaattaacgcttgaatcggtgcgaccgcgaggtcttgtgtcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgcccccttggataatctggcatgacaaactcctcagtcggttttccacaattctaccagattcagcagatactagacaggttctaagaggcatttcaccatactaacaagaaaaccaaaaatttccagatcattaatttaacatatcgtatcaaaccacgcctggaatattatctaggcgtttttttagtgtcatggtattttctggcagaaaggttgcattattgtgactacagttgtaaactaataagtgttaagagactacaaacgtaaacttataattcaattaatggaggaagccaattgaaggatgcaaagaatgtaaccatcaccgattctgaatggatggttatgagagcaatttggacaatgggacatgcgactagtcgtgaactaatcgatgctatgaacgaattagaaggctggtcagcttcaacaaccaaaacgctacttcacaggttgattcaaaaacaggcggttgcgcagcatggcggcagtcgaccattcacgtataagccggttgttggcgagaaggaatcaatggcggcagcggcagatgatttgtttgaccatatgtgtgcgatgcgggctggttcaacaattgccggcgttattcagtcaagggaactctcacgggcggatattgcgaacttacaggcgattctagctgaaaaggccaaaacagcgcccgaggaagttcagtgtaactgcttgccgggtgatcaaacgtgttaagactgtggtgttctgtttacttttaggattgctgcacaaaaatccagaatctgggatttctgatggcggaaacttatgaatttttgtcgtaattctcattcatatagtggcatggtgctccgcaaagcagaagcctaaatataagaacctggtggaaaaatcccgagcccggggatttccacacaaggaacttatattccggcttctaaccgctttgctacgcacacttatttttagggggtcgataatcatggcaaataaagaggaccatatgaacatgaaaaacatgagtgctaagaatatggaaaataatgaatcaaatatgagtcatatggatcacgatatgaccgaaacggatcataatcaaatgaacatggaccacgatatggccgaaatggatcacagccaaatgaacatgaatcacggtgatatggatatggctgggaccgacatgatgatgcacggtggctcaatgatgcatatggggaatttgaaagttaaattttgggtctccgttgtcttagcgattccagttttactgttagcaccaatcatgggtttaaacgtttccatccttagtttcagttcaccgctaattgttggcattatcatcgttttgtttgatacagcactttacttttatggcggaatgccatttttaaagggggctaaagcggaaattcagaataaatctcctgaaatgatgacgctagtaacccttggaatttccgtttcgtatttctacagtttgtacgcatttattgccaacaacttcttgaacccggcaaatcatgtaatggatttttcgttcgaacttgcaaccctgattttaattatgcttctaggacactggattgaaatgaatgcattgatgggggctggggctgccttacaaaagatggcggccctgttgcctaagacggcccatctagttacagataatggtgaaacaaaagaagtgccagtatctgatttaaaagttggtcaagttttccaagtgcgttcaggtgagagtattccagccgatggtgttattacggctggggagtcgaccgtgaatgaagcactggtaaccggtgaatctgctgccgttaccaagaacgttggcgataaggtcattggtggtacaaccaataataacgggacgctaacggttaaaattagtggtactggtgactccggctatctttctcaagtaatgaaaatggttcaaaatgcccagcaagctaaatctaaagcagaagataaagctgatttagttgccaagtatctattttacgcggcatttggtgttgggattattgctttctttgcctggttaccccagggattggcgactgcaatgacgatcatggtgaccgtcttcgtgattgcttgcccgcatgcattaggattagcgattccattagtggtttctcgttctactacgattggcgctcaaaatgggctattagttcgaaatcgccaagccattgaagcaagtcaacatgttagccacgttctcttggataaaactggcacgttaacagaaggtaaatttacggtgaatgcattgattccaaatgatgggattgacgaaacaacgttattaagccgactggccgcccttgaaaataattcgactcatccgctggcccaagcaatcattactgaagcccaagcgaaggacattgaagtcgttgcggctgaaaagtctcaaaatattccgggcgttggtatttccggtaatgttgatggcactgactatacgattgttaatggtaactatttaacgaagcaagggatcaggtttgacgaggccgctgctgataaatgggctgctaagggtaattccgtcagcttcctattgcagggcacccaagttcaaggaatggttgctgaaggcgacaccatcaaagcgggtgctaaggaattaattagtggtcttcagaggcgaggaattacccccgtaatgctcactggcgataatccaaaagccgcggaacacgttgctaacttactaggattgacggaattccatgcaggcctattaccagatgataagcaaaagattattgctgattatcaagcaaagggcaatcacgtcatcatggttggtgacggcgtaaatgacgcaccaagtcttgccgcggccgatattggaattgcaattggcgccggaaccgatgttgccattgattccgctgatgttgtgttggttaaatcagaacccagcgatattttacattttcttgatttggctaaaatcacaaatcggaaaatggttcaaaatctctggtggggagcaggctacaatattgtcgcaattccactcgctgccggtgtgttgtcatttattggaatcattctagacccagccgttggtgctgcggtcatggcgatgtcgacaattatcgtggcaattaatgcgatgggattgactggtgaaaagattaaaaacgtgtaattaagtgatgacaaaaagaggagaaagatcagctggtagtctggtctttctcctctttatgatcatcatgttaattacttatctggtttctcagttaatttcgccaatttttgatgcagcctaatgtcatattgcctggtaattggcattaacaccgcgaccaccccgcaaatggcagcaccgattcctgcaatcacaaataggcgttcaatgccaatcacatcagctaggggaccggcaaaaattaagccaattggtccagctagattcaacaaagaattcaaaacgcctagaatccgccctaactcttctgctggataactttgttgaatcattgccattaaaagcgttgtaaaaaatggggtcgcaattccttcaatgatgtttaaagctgcgaacgacgttcgggccgatcggccctgtgcaaagcgataggaagcaacagtttttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggtatgacaaactcctcagtcggtttttcacaattctaccagattcagcagatactagacaggttattaaagagttgctttcaattgatctaatcgccattggcaccatgaaataaaggctaattcgtcaatctttggaatgccatagattgttagcggcataggctacaaccactaaacacagtcactttgatctacgcttaaattcaactttgcaccagaaccccgacgtctgcgggtcgaatttggtccggccgacgacgatgattttgtcgtcctgccctacttcgatccagacataatggtattcaccgtttgctgtgtgcaggtctttgaactgatcaaggtcgaagttgcccttgtcgaggccctcaaaccagaaaatccggtcatgcgcgatataggcttgggcctccgctggcaggtctgccaagagccaattttttggctctgacatgttgagttgtgtgacaagtgcggacattgaagcaatggactttgcaggctgggatgtcatgatgcttgcctccttggcggggtcccctactggcgcgcgtcatcagaatgcgaacctttatctgctgaaaattggttgtgggtgctccgcccgactgagatatcggcagctgtgcattacagaatgcaataatactagaatactttaatacaataatacatttacgtaggtaaagccctaagccttatcgcgcttggtggcgacgccgttgatgatgtcgtaagtgcgctgctgatctgggcgcagtgactccagtttttgggtgataagctgatctaggagcgtgttcacagtgtcagcttcgccaagcgtcaccagcgaattgagggcgttgcgggttgtcaccgagatccgaattgaagtcgtcttttcggcaggcttctttttcggagcagcggtttccttgacgctttgaatgattgactcgcggtcgacctggttttcgacctcgacaccgcctggcgtgtggcgcaggagcgatttcccggtcttttgagctggctttttttcaagcattcccatactagttcgcctccagacgctggatcatttcttcggcgacggctttgtaggcgttgtgaaccttcttatcccacatgtccttcgggttgtcggtgatacccgtcatatcgtagcgcttgatgcgtgactgaatgaggatgtgatgctcgaagatgttctcggtgccaaattcggcgatggcggcttgtagcaccgcttcgtcgaccggcgcgcggcgttcggtcagcactggcaagatgccgaggatatcgagtggcgcgttgtagcggtcaatcatgaaggactgcatgtacttcacgaactgctcggccccagttaacgcgcgttcctgggtttggagcacgacaatcagctgatcgcaggcgtagaacgcggtatcgttggttggctgaagcgttggcggcacatcgatgaagatgaagtcgtaagcgtcgcgcagcgcgtcaacatacggccggaacgaggtcacctgctctttttccgttggatacttggaagttaaaaagttaccatagatggaaaagtcgaccgcattcggcactaggtcgaggttgtcgctgattgagatcatgatgtctttaagcggcttgtcttcggtgatggcagtcatcagcgaggttttgatggttgccggcatgtcattgtgcaggctcgcgtaggttttgatcatcagcgcggtcaggttggcttgcgggtcaaagtcgatcatgcagactttgtggccggctttagcaaggctccaagccacgagcgccgtggttgaagttttaccgacgccgcccttaaagttggcgaaagataagacagtagcagtcatttggttagtacctccgtttttgtattctgtaatacatccaaggagattataccatgcgtgttgctacttgggcgattgagttcaaactgtattctgtaatacatgtattccggaatacaataatacattgtctgaagacatcggtggaaaatctggttgtaaatctgaatccctatttgaaagcttcagtgtgccttcggctttgtattaaagtattccagaatacattaatacttgtagtattgtattccgcgtcactgagaatacatgtattcgataatacaggattccctaggctattgcgttatagcgttgtttcccagatactgatatgtgaatgaagacacaaaaaaacaccaccgacggcaatcggtagcgcccacaaaaatagttatcaagttattgtcattttaactccgtttgggatcgatggcaagggtgcgcggtgttttctgctttttgcgtacactcttcgcccaagggtccagtatacgcaaaagcggtactgggcctttgttgtatctcaacaacgggagcgagtaggatgcgcaagacggatgcagccgatgcaatcaagactattctaggcgaaaccttatctacccgacgctacaagcattcagtgttggtgccagacgggactgcccggaaaaacggggcggtttttgtgtgctggagcaaggacttgctacgggcagcgcaaggagtcgtgatgacttctcaagaggccgtactggatgcagatggcgcttcacactggacacctaatgtttttcgctgcggcacttacgagcagcgagggcccaagtttggcaccattcgcgggcacatggaaaggaacctcaaggcaatcactacatttgtcgttgatgtcgattatcctgccggtgaaaagcctgattacgctgattttgatagcagttgctttaccattcagcaaggtgaggcgttgtttgagccaacctatatcttgtcgactccgcatggctatcaggcttactacgtgatggcggcgccggtttggatccggcgtagtgaagatggacgatacccagctttggcttcggcaaaacgcgtctcacaagcgattcggactgcggtggctaatcagaatgtctatacggacactggggccaatgattttggtttctttcggctaccatcgagcgataacctggtcgaggttgatgaagatgctcggccgacgtttgctgcgctgcaagcatggtcgatggcagttggtgggcgacagcaagctgcgccagccaagcgggtcactgatcaggtacatacacagtggtttgaagcattgactcaggctcaggtgccatgcgcgcaggggagcggttacgggcgtaacaatacacttttgacgctatgtctggcccagtatgcttctggcgtatctgaagcggaagcattcgactacgccgatcagtggtccagttttcagcaccagccgttgcgtgacagtgaagtgcgggccatcgtgcgctctgcatattctgggcgttatcaaggcgcgaacatgagctacgtgcgggaactgtgcgagcggtatgcgcctgacaccatcattaagagtggggcgcaggcgtggtcgcattttcgcaagccacgcgcccagcggcagtactcccatcagcaagagtgggcccaggatctgctacggcttgctgaacggtcgactgaccgcgtgcttgggcatgcgcggtttacttatttgcagttgcagcaggcgcttggcatcagccggcagtcattagtgcggctgctgaacgagttagctaaccgtgcgcagatgagtattcgccgggtgcggggacgcaatggtggggtttatttggcgacggcgcggatgattgtgcagtatgttcagagtgagaaggggactgcgcagcataagccagaacggttggtgacgcaagctgagccggtgcagatgaacttgcagattgtagggatttttgacggggttatgcggcatattaaatggtctcaatcgccaatacatatatctagttaggctattttgggtgcctccgttagaacctgtctagtatctgctgaatctggtagaattgtggaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggagcaggaatccatcttaattcattatcaaattcacgtttcaggtagccgaaatgttgcctaattcaccagccactaaataaatgggctcgcagccttaaaaatgatggtccagaaaaaggtatgctattctcaatggccagatttaatttattggtgtatgggaattattgcggtaaaggcaacaacggcaaagcaccgattgatgatcttgatggcgcatgccaagcacatgatacatgttatgcgtggggcgggaacaatgagaagtgtaatcaagaatttcgtcaacgcttattaacaattatgcaggagacatcgctttttgattacaagcacattgttgccgctgctgcatataaactgtttggtggttgaaagttcaggatggataagtgccagaagaggactttcgtgtcatttaaggtttctgctagaaccatccttaatggagaaatgaaagatgaaagctaaatcgaaaatcgccattggtaatgtcggtatcttgactgtcatatttgccttaatgaccatcataactttctctggaataaagaacttcgttggcatcgagcttggcacagggttcattgggctattagtgattgccttgctgattatctgctggcaaatttaccttttattagaaaagtcagctcttggctggagctttaatattatcatcggtgtttacacattggttgttggagcagccatctctttcattgcctcatttttcattggttttgcgctattcccttgattttctcactcgcaaataacgttaaggaaaaagccctgaagacgaataaagtcttcagagccttttttcttaagccgaatgcttgcttcacaatttgcgttttgttggtatgacatcaaggccttacttagtgctaattttcttttttccaaccagccaaaagtgcctgaatgcccattaagaattgttcgtcactagtaaattgttgttctcgtattggttgcatgaattgattcaagagatctgattgcggatgtgctgcgcttagcaagtttggttcaagttcgctcatactttgaggattgacagcttcggtccagacaaaccctaatgtgtaagctgttaaggagttgattaaaaagactgttgttggctggatcgccaatccctttgttgtccaaatcgttaaaatcttttcgactaaagcaaattcagagtgtgttgataacggacgagttgaaattaacggtaatatgttgggatgtgctaaaagtgtttgacgtaaacgagacattaaaccagtcacttgatcttgccaagtcgcattggcagcatcctgatccaagactaaaacacgttgccatagcatctcaaccaaaccatcaaaaagtgcctcttgattaggaaaataacgatacacagccatgggcgagactgacatttcttgtcccaatttacgcatcgtgaatttttgaagatcctcttgatccaatagctcaagagcaacttgtaaaatataggaccgacttaacgttgttttggttggcttgacaggtttcacgttgagcttttccttcctttcaagagacaataaattaagaactaatcagtgaaaatatacccaatataggcacgacaatcaagagaatacagacatcgtggtgatctatttgacgccaaatttaaactttttcttgctaggcaagccttctttttttctgtaaaagccatgccatactcatgaaaatgatggtgtagagtgcaattacccctaaggcaaggctgtctttgctactgccatctagcgactttcctagatcagcaatgtaatgctgaggaaagaaatattgtaacgtttcttgcaaggttccttttttgactgtgaacaacccgcctgacagcatgagggttaggactgtcagaattgttccgatacccatagcgccttgcttggttcttgtgagcgttgcaatcatcaggccaaaagcagacgaaaagatgttgatgaggacgactgcagctaacaatccaactgatagtttaatgccaaatagtggcaaaatactgattgtagcgacgagacttatacagattagtacgaaaacattgaaagcaaaatgttggaataagtaagcgcgattggagataccactaagataaattcgctgatccataccatcacagtcatcaaagtagaacttgtacaagattaaggataacatcattgtactcatcaccaatatgctcaggaagattttgaacgtgtgcgttttgacgccaggttgctttgtatagacaccggtattcaaataggtgcttagttgtttttccagagccgaacttcgaatggtggttacttggtaactgccgtttctcttggtgacataggcgtcgtatttaccgagaatcaaattctgataagcattttgattgtgggttgcttgagtgaattcaattttctggctttttatgggtgtgactttcagcaatttcgcagcactagcggtcaccccgatttctgccgttggggttttcatcgtcacagcgaacgcggtagctgccgtcatggcaatgagcacaattgctgtgataagtaggtaggcaggttcctttatgaagcgagtcatattacttttgaaaattaataatttcattgttatccctcgaatttttccggacgatacatcacatgaataatcactaagaagataaacgaacccaataacagtatgccgatggtactggagagttcgtgaaaattatgatcataaatgatgccaaaaaagctatccgccattttggcaatgggtgacatatcagcgattgcagcaatttttttgccaaaaatagtcatcgggaaaaagagaccttaagcgatggcaaacacgttgatcaaaagatttaatagattggttgaaagatcttcgtttctgataatgacacaaaaggcaccaccaaacgtaatagcaaagatgacaaataccaggtccaacaacagcagaccaccaatgttcttaccgccaaaatcgactaatccaatggtgttgaatagcagcatgtaagcggccatgatgatgtaagcaaaaccgattgaaaccagcaatttggataagtagacttttgcacgcgcaatggttgcataaataatccgataattggcgtattttacatggctgccaaaaagcatttccggcaagatgatgaccgttgccatcgacagataaatcatcatagtgaccccataatagtcatacgaggtcaaaacatcatcgctgaagataccactaaagacaaagcctgttaccaaaatgagtaaaggcgggtaaagcactagataaatcataattggtttgtttttcaaaagcgtcaaaatatcttgatgcatgatcgtgagcataggattacctcctcttcaaaagcaacggtttatgcgcttcttaaacgcgatcactggcacagaaacttgcacataaggaccttgggtgcagtggctatgggcccagtcatcacacccaaggccgcttgcgctccggtttctaaccgcgccagcttacgctctaatcacgtaaccgtttgccggttaaggttaaaaatacatcttcaaggctgcgttcttgtttgacgatgtcagtcagagcaagcccgtgtttgtttaaaaagacgagcgagcggttaagggaaaatgtatcagtcattcgtaaaagcagatcatttctcccgaggcattctgcttggctaatacctgtcatgctttcaagaatctggacatcttttgtactgggtgtaccgactaaagtcagctccccagtttacaattcaagtgcaacaccctgacgactagaccataaaggccatgaagacctattcttgttagtgctagctaaacaagaaccttggaagcatcatttatttaagttagatacatattatatgtacgaaggcatttcatttacacaagattcttgacgctaccacgttattcataataaacctatatcagccagttatagttcattacactttttattactacatcaagttgtccggataacaagaattgccaagtaaatgtaaaaaataaactaacaaaaactaaagctgtaatagtaaccggtttatctcttctcctaacaactttcccataagtaaaaataacattggtataaacaatataattaaatataagaaaatttctatacactctgtaaaaatcaacatttacatttataagaggtaacacaaataaatacattaaattcatccagagaataaatcgcgccagatctgacagtttatattttaagatagcttttacatcgctatatttcccctcaatctctgtagaataggttaaacataattttagtataaaaatattcaaaaaaatgactacccaataaacagatccaccccacctagtactaattaccagataatgtgataaatcatctaccttatctcccaataagttatttacaaatgatgacaagttcaaagttaaagaaggaattaacccaacgataagcactatgatagttgttaatccaaccagacttttcattatcttctttaatttattattattaatagcataataaagaattactaaaggtatatatatatcagccagttgttgtatcgtaccagctaataatatcaatactacatatataactttgtcaatttttctatcattaaataataatggtagtgtaaaaactaatatacacattattaaaaagtttcttaattgaatagcatcaataaaaaaaggaaagacaaaataaagaatatatgtgaagctacgatattgtgctgggacatacctatgaattgtaatacttatcaataaaagtccagatactactaaaaacagacgtatggcattatatgaccatccttgtgctttaaaaaaaacaattatatgtgcaaaacctaagttcttagtataattcagtcccatattatatattgtgttatagacaggcgtatctggattaaaatcattaccacccataattaacataaaaaaaactactagcaccatcgagcttatagatagtttaatatttttacctgatgaaagtactatttttctatccggtaataacgatactaaatatataaccattataattaaaattagatatggcatgtatctctcctaaccaaacacgtatagacctatagttcttctaattccactctttctaataccattatttatataaaaaaataaccgccttatctttgtttgagatccaatagtagcatatctatacacaacatcatctatatcttctatatcgaatgatctaaccatacacatagcttgttttctagtactatttattcttttacgaatagaccttcccttttttaatcttctaaaaatatattcataattgtatttggtagttccaacactgttattaccatgttgacgataatcaattaatgattcatttaaaaagcttatatctccatatttcgcagcaactaaagccaaccaccaatcatgcattattacattagaagtatcttttaaatttttacatttatttaaaagaggttcattaatcataatagtacatccagttacagtattttcggctaaaaaatcagttatttttctcttatgaatgttaaatccttggtaatgcctcatagacgccgaaatctcatgtcgttcactatcaacaacatttaaatcggtatatactaaaagaggaatattaggtcctcttttctcttgaagcctcttcatttcgttgaaggtctttactatcttatcactatgccaataatcatcttggtcagaaaacattatataatctgcatctatcgaattcattaaaaagaaaaaattatttttcgcgcatccagtactatttccttctatattatggattttttctggatacttttggcaatactttttaattattcctaatgtcttatcttctgaacaatcatcatgtataaaaagtttccaacttttaaaatcctgttttaaaattgattctatttgttcttttaaatatttttctccattataagtagccattaagatagcaactttagcctcacaacgcataatcaagatctccattatctccattaataatagttaatacattctatttatttaaaaccatttgtaaccccattttttaaagtaataatgcattgacttaagatgataaaagaataattttatatatttatgcgaccctttgttccacttgtgaataacactaacgcttggatagtacattaaagaagaaatcatatttactcttttacataaatcagcatcttccatatacataaagtaattttcatcgaatcccttaagttcttttaataagtttgttctaattactaaaaagctcccttgagcaaaaggtacttgaaatggcttactataatccttatactgaagcgtatgtctcgcttgtctttttctaaataatgatctacaaaacattcttataaacatatccaatatagttaactctttacgatagacaggtaaacgttttcctttgctatctaccatatttggtataaccattccaaccgatgggttttgatctatataagatatgatagatgtaaagacatctttactaaagagaatgtctggattcataatacaatgatatttagaagtaagcttaggaattatatagttatttgctcgaccaaacccgacattcttccctaagtatatatataccacatcatcatattgattgataaaattactaaattttgaacatatatttttgcttatgctattatctactatatatattcgtttttttatatcactaggagtatataattctaaagtttcaactgctttttttatactatcataattataataagccactatacagatggttaagtccatcttactttattctcctaatctatattcagaattaaaattcaatttaggataattttggaattataatggcactttaataggagtcatttggattaaataaaattaaaactgttttacaaataatcaaacaatcgtagaagaaacttgatttttctatatattttaaatctagcctaaccatttcattaaatccaacactattccgctcagtagcctgccacaagccagtacatccaggcgcaacaaataatctttgcttatcataatccgtatactgttccacttctgatggtagcggtggccttggtcccaccaggctcatatccccctttaggacatttacaagttgcggtaattcatccaaactatgcttccgaataaaatgaccgatctgcttaatccggggatcagtcttcatcttaaacattgccccctcaacttcgttctggtccctgagatcgccaagcatttgatcagcattaaccaccattgaatgaaatttatacatttcaaaatgacgaccacctttacctacccggacctgcttataaaaaaccagcccgccgtcttcctttttaatcttataagcaattacggtagattgcaaatttaatccgaatttttggacaaatttgtcagcataacctgatacggtgtttgccagtcgagtattttaagcggtcgctggttaatttggaggaggccatcgatatcgcacttgatactgagcccaagctcaagcaaacctacgagacctacttagcgcttcatgatgctttgatggtgaagaaacatcccgcggaactggcaaacctgttagctacttacgagccaaacggtacggcaatggacatgacgatcgcgacgcttaagcgacacaaagtcgctgttctcgccgctgtcaccagcccttattccaacggtccgatcgaaggcgttaaccgcctcatcaagtcactcaaacgagcctgttttggcttcaagaatcagctgaacttcttcaaacgaatctaccaaatcacggcataacatgacaaagacggctccccaaatggagaaccgcctcaaatgataaatttattcttcaacaccagttgacgtagagccctaaaaagaccaccagaaccaataagttctagcggtctttaatgagtttcactaatcaataattaaaagctacgtcctttttttctaatatataatacagtcacacacgctattaaaattatccccagagcagaaattcccgccatcacgcgttcaccagtgcttggcaaaagattatggcctttagaccttatatctgaattcttgcctgactgagccatactagaaacattagtatcattagcgttgctattgctggaaggttctttgccactactgttagatgaactttggctgctgctatcattagagttttgaccatcatttccactatttgatataggaactaattgcttaagggcaccttgcaaagaattaacggaaacatctacttgatcctgtgtagcactatccttattcagaattgattttgattcagttagtttggtttgtaattcttgccaagacttgacagtatattgactgctatctaactgttcagcatagttgatcaagttttctagcaaagctttgttagtattcgatgaacttacagccttaatagttatttgagcatcagcgatgttgggtaaattagtagtcagagtcaatacttgttcttgggccgtagtaggaacgtcgaaattgaatttaccaccggccccgacgtctgcggtaataatgacctttccagttgagtccttaaccgataatggttctccaatttgccaatcactatcaacgactgtgccgctaactgttgcctttttgttgtcactgctgtaggaaacgttgtcaatctgaacctttttttgctgaagttgcgctttagctaacaaccctaacttgcgtttgagatcaagaatacggaaaacgtgttcattgatttctgattccttaatagttccattacttactgctgcatgaatctggggaatagcggtttcataatcattattcatgatgcaatcgtttcctgcttcaacagcaagaacatcaaccggaacttgatcatgttcttgagcaaattgcttaatggcccccatttccaatgcatcggtaattattaaaccattgtacccaaggtcattacgcaacaagtccgtaacgaccttccgtgataatgatgctggatatactgggtcaacagcttgcattactatatgtgcaatcattactgaatctgctcctgctgtaataccggacttaaagggaagcaaatcctctttttcaaaatcctccttagactttgtaacgactgcaaagtccgtatgcgtatcaatcgccgacccataaccaggaaaatgttttagagttgccgcgacaccagcattctgccacgcagggatcacattcgtaatatagtttgcagttgccaagtaatcttgaccaaaagttctgccataaataaaactagaggtatcagacgtgctgtcggctaccggtgcatagttccagttgatgcccagattttttagaatggttccgacctcactggcctcttttgttacattggccattccgccattagcataagacgtttgtggtgaaggaaaacttctaccgttggcaattagagggttttgtgataagcgtgagactgttcctccctcttgatcaacgccaatcaatagtggcaggcttgccgagctttgaaagctttgcatcttcgtcttgaaattattctgggcttctttagctgttgttcctccaacactagtgaaatcaacaccataaacaattagcccaccaagattatattttgctatatcagcacgagctttatcagtgtcttgtgaggttctcactacaaacatttgcccaattttttgatcaagtgtcatgttagaaatataggtattaatgtcggcatccgtaacagatgtactgtcagctttaacgatctttggaggtgaatagaacccaatcgagccgatcatggcactaacgcaaccaataatacaaagaacatttctgataatatttttcattattatcccccatttatgtatatattttacaagtacttaataaacggcttctttaataggggccaaaccagttaaccccaattactatcgttttgtccttacaacacgatagtaattatcatcacctccatattaccaatagaacatttccaaccacacgtttcaaaatagatttattctagctagttagtttgttttttggcggaaatatcaagcgctgagagcggactcgaaacgaccaatacaataaaaatgattctagttgagatactacgcttacatcccagtgaccaataagtctctttagttataagcaattcccaatggcttcaaatgatgccctcaacttggttaccttgcattgtattttgcgggaatcagccttgcttggtcaaaataattgtaagcgcattcaacggaccgtgtcaacacatatatgtgctgacactaattctttgcaatcggtatagttgcaaattatactataaatacatatgtaaggtctaaagtatataagcttaaataagcctgctcactgttcgcatcattattgacacgctaagatactgtttagatttttatgaataaatgctgttacgtgctgaatttcaatttatgaagctgagctgtaaagcttccaaaatagatacaagactttcccttcgttgttatcgtagtactggattgaagtcaatatttgagacagattttaagagacattcagaatcgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacatcttgtttagctagcactaacaagaataggtcttcatggcctttatggtctagtcgtcagggtgttgcacttgaattgtaaactggggaccttctttttcagcaattttatcgttttctatggccgcttcaacagctttgtcgttactttgcaaacttgcggctggatcggatttaggttgaatagcactatctttgcttgtcgtgaggtttgtgacagttggttcgtcgtcatcagttttattgcctttgtcctcattgactgtggtttctgttgcggtctcaactacttgactgtcaggtagtgaggtcgctgttggatcaacttccgacttagtgggtctctctttgttcgtcgccggatcagtgtcagtaggggcagcggttcctggtgtgttgtctttggtgtttgttgcttcagtggcttcggcgtcagaatcaacgcccttagcgtgattcggcatcgttgtggctgcattagcactgttatcaactggattttcatcaacacctgttgttactgatgctggtgtgtttgttgccgtgtcaccgtttccgtcactttgagcttcctttgatgtatctatttcgacaacggggttacttgtttcaaccttgctgtcttccggattgaccatcgttggttcggtgcttggcgtcacctcagttttttcatcgctggatgatgttgtgaccggtgcttcacctgcatcattcttgggtgtttgatcttgttgttcaggagtaatttctagttcatccaaggattcttccttgagaagttttggtatcttagtgacgttgaacgttttcgttaccatgttgccaacctgatcaactgcctgcagggtaatgatattgaggccatcggttaattgataggtttcgtcaaatgatgctgcaccatatgggttgtacccgtttgtaagttgattcggcgtggccgaagattgatgtgcattgaaacccgccagattttgctgcgtgaagatgttgttaccattgctatacaaacgatagccgccgatattgtcagtcacactccccctaattgaaaaagtgtcagcgtccgtggtgacaaggtaggttccatcatcgtcaattttcattgaatcagcatctgaaagctccagtgtcggcaaggttgtatccatataaagcaacaggaagccgccattggtcttctctttaccgtctttatcgagagttgtgaggacatagccaatattccgctcctcagtcgggttgcatggcatggtcatactgaaggaaccatctgctgcaaacgtcacttcattttgaggatcattttgtctcggggtgataaaaatgcgtaacttactgtttttcggatcagataccttgccacgaagcgtgatggtcttaagcttggcgtcatagaaagtgctggcgctgtcaatgcctaccattgttcgtttgttgttgttcaggtcaaggaatgcaatgccgttgatcatttttccttttgtgctagttagaggtgaacgtcctgtcaggtgggcagcaccagaaaagaacttagcgccttttatggcggtggcttcgtcagcaaacggtttcgtctgggtttttgcgtttgagtatgcagcggcgttcttcttgatgaaaatgatgaagtcctctgttttaggtgatttgatgaactccccaaagtcatctctagcaaaggctgagatagtcaggttagcatacggttgaccggtagcatcaatattgaaggtaacaatacctgtggctttatcgagcgtgccaatgtattgacggtcactcacgtagtctgtggcagtgacaatatagtcttgcccttttggtaccattgcctgggctgtaaaggtgctgtctttagtcaaagcttgataacgtccatcagatcgcgtcaaatttcctttggtgtcaggcattgaccaacgaacttgcggccaaataaaattggactcaatggttttgttttctccgacaacggccttaatgctgccttgatcactgttgcccgcggcatcagtgattgtcaaagttaccttaccctcacccgtcttcagattggcaagttgatcatcattcagttgataattgattgtgcctgaagttcctttgttgtcgtgatttaaaggaacaccataggttgcggaaccaatggtgagtttggcttgactatacgcggtgaaacccacgccttggtcgctatagtcagccgttagcttgccgtctgagtaagccaaattggatagcgtcggtttaatcgtatcgacggccactggtaagctcatggtttgcatgttattttcgcctggtgtataggtcataccgatcagacgataggtgtaaataccatcctttgcaggcaccattttaccggtggtttgatcatagacttgaccgtcccatttgagcttatcaggattcagaaacattgagattgatttggcaagatctgcattggtagtgctgccgacctcaaggaaagacttggtggtgtcagtttcttgatcaatgacccgcattactttgtcatcttgatctaaaatctgtgcaatcacttgtttaagattttgcttggtgaagacatagggggggtgatggtgtcagaaatgccatcgccatttggtgaaaaagcgactttgttgttctgaactttggccccaatcgtttgccaagtgaaaccattcgtcgggttattgactagctcgctcagcgatgttggatcggtaatgcctaatggattgtggttgttatcgacaaggtagccacctttaaagatactgccttcttcgtttgcgggcttgtcgaacacggcctcatcattggtggaaccgtaatatcccatgtagggaaccgaaatggattgacggtcatcggcggctttgaatttgataaagccttctaccacttgatttaatttaaccgtgtcatcaagcgaaagggtaaaggtgatctttttggatgccccggcatcaagcgtgaaagttggcgtagcagttgtgagggtggcaccaggcaatgtgcgatcatgaacggttttgttgttggcggtgtcaatcacttcggtagcaggttggccaagatcaagcgtgtacgtttgctgatcggtaccgcgattttccaacgtaatgatgaatgatttgctaccggtgaattgttccccagtttacaattcaagtgcaacaccctgacgactagaccataaaggccatgaagacctattcttgttagtgctagctaaacaagaattggtctcaacatagcgataactgtgcggtgttttgtttttcagcgtaatcgtgttgttcaactcggatgtgagcgtcttggtgtagctttgaacagtgccggtcgcgccatcgactgaatactggcgaacggcagtcggcttattgttcttgtacgtcgtcgcactggcatattcataagcattagcgtgttcggatgtcaatgttagtttgccatttttacgcttaaaactgccggtgtcgttgacgacaaatggatgcccatgaggatcgagaatgagcaggcgagtgtaggcttggtcatctgtcagcttaacatagacggttaagtcatgttgatcgcggtttagatcgatgaccgtgcccgaagccttataagtaccgctgttaaatgggtgcgtgacggcgaccgaagatgaaacactgctgctggaagatgtcaccgggccttgaactttagcaccgcgaagaacgagccacataaaaacagctacaaaaataaccgcggcaccaataccggtgagcgtgagataaagcgttcgacgattcttgcgaatacgttcacgtcgcatattgtgcctcctgaaataagatgaaaaaggttttttttaatataaggaatgtccagtagaaaggcaatcttttaccaaatgcttaacctaaccgttacacaatgacatccccattagcaagaatcaaggtttgaattggaacatcaaacggctccacaggccaagccacttgcggaaacgccatcacgggtggtaccagtgtgatcgtggtgccgcgataagttgtcaggaagcgatcataatagccgccaccaaaaccgatgcggtacttgtcagccagcgaaaagccaatgccaggcaccaaaatgagatcaggggcggcatgaatctgatcggcttgataaggcggctccgggataccaaaagcactggtgatcagcttgtctttgccaggatcaggtaggaaaaccatttgccgcttgggcatgacccgtggtaagtagacagctttattggcgtcgtgggccgcctgaataattggctcggttgggacttcaaacggtccgcttacggtaacaccgatgctgtgagcacgttgccacataggtgtttgaactagtgcggccaaaagcgctgcactggcagcctgagtcgctttctgggcggctttcagacgttttaactgaagcgggcgaaattcggctttgcttggcatagtgacctcactttgttttgagtagttcgcttagaacaacggcttggttatgcgtttcgtccttggcaccatagagcataatgactggctcttgttcgtgttgcttcaatgttttgatgaagtctggcaggtcaggattagctgctaactcagctaagtaccgcttcttgaattcagggtacttttcagggtcgtgaccaaaccacttccgcaactcagtggacggcgcaatggttttggcccataaatccaaagcagcgttaactttgctgatgccacgtggccaaactcggtcaacaaggacacggaatccggatgcttgcggtttttggtagatgcgttcaagtgttactttcaaaatcatcacctcactgactattctaccagccttggcaactagtggccgaagggggggatagatacgttataataaaagagaacgtgaactggcgcgtgtagcaatccgcgtgtgagcattttggacgggattggcatcgcggacaagggtgcatacagaacggcctctgcgccagtaaacgcgctttaatacggccaagaggtgttgaaatgattacgcgttatcagatccagccacgaggaaatatgcaggttaccacagacgatcaggccaactggattcgagtttcggcgccgttgcctcaagaactacagacgctggcgacgacatacgggctgccagcaacctatctggcggcagcaaccgatcaacatgaaaatgcgcgcgtggaaggtttaaatccggcagatcaggtgccaggattgattgttttgcgttacccggttgaaacaaccagtgaaacggggtttgatcaatacaataccgtacctatgaccatgattctactgaatgatcgtgtgatcacgattacccacgatcccttacaagctttcgatgatttagctcaacaaaaactttctcctaagcctgaagagtttgcactggaagtcctgtggttggtactgcatcaattcgtgattgcaatggacaagctgaatgatgaaaccaagcaaattgagcgcagcttaggtaaggcggccaaaaacacgcaactttatcagttgatggccatgcaaaaagggctggtgttttttgatgcggccttggatcattctggtacgctgcttaaagccttacgcgacggcgagcgcttttttaatacgaatgggtacttacggcggttgcatgatgttgaagttgaagtggtcgaggctcaaacgatggttcggatcaccgagaagttgctgacgcagtattcaactgccgtgagtgccattgtttcgaataatttaaatttgattatgaaggtgttaactagcatcacaattattttgacgattccaaccattgtgggtggtatatatggcatgaacgttcgcttaccgtttgccaacgcttactgggctttttggtggttaatcggcggcacagccatcttgtgcggcttggcggcatggtggctgtggcgtcaggattacttttagcattaggcactttgaaaatgggtgtacaaatccccgtgacgtatcgctatcgtcacggggattttgtgtgcgtccgtcagcctgagtagaaaccggcgcaagtacgaggaacgtgatggccggccttaatccttgcgatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcaattaatgatttatttgagctgtggaaggtaaacgcggttctgaatgtctcttaaaatctgtctcaaatattgacttcaatccaaaatattttacacaaactgatactacaagatgaggaaaaaggagagcgcctaatgggtaccgtttttcgccgtaccatcagcgacaaaatttttattactgctttagtttgcgcaggactgagttttttgattgggacgccacaatttaccgatattaactggaacacgattggaacgctcttatcacttatgattggagttcagttattacgaaccatgcatattttagatgcattaagtgactggcttttagtcaaatcacaacatactcgacagatgacgcaattttttattttactggcattcggtggatcaatgattttgaccaatgacattgctattctaactttagttcccacttttatgacattaaatcgtcatcagaagggagcaattgcttacccattgactctaatcgtgatggcggcaaatcttggaagttcatttacacctattgggaatcctcaaaatttgttccttgtgacatcttatcacattgatatattaacctttttcaaattatcggctcctctgatgattgccagtctgattcttctggtagcgttaagcttgtgggtaccacgaaagtccttaacgatggttcccgcaaaatcaactaccattcatgttagtcaaattggtattgcaacttccctgattgggtttattatgctcgtaatttttaacttgataccaatttcattagttattattgttactattattgttggtttgagaattgattggcacgtctttcaacatgttgattacgctttgctcttaacattcgtctgctttttcctttttgttagtgctattagtcacaactcctatattactctctggttaaatcagctaatgcaaacaccgccgagcgtttatattgctagcctaatgactagccaagcgattagtaacgttccagccgctatcttactggccaattttacaaagtacttaccagccttattcctaggtgttaacataggtggattgggatcaattgtggcctcccttgcaaatttgcttgcagtaaaacaattattgctgtttagcgaagaacagtcattgtggcatttccttaaagtgttcactgtgttaaatctgattggtttattaattttgggtgtttttggatggctttacttgttaatgtgagcacggtagccaccataaacaattaaagtttcttgaaaggtgctctttcaatctgaagttgaagtctcttaaccaagcaaactagacacaaaactcatgaaggtccattcacgagtttagcgtaagcttttcaatctacttcagtagaacgctctgatgctttacgtataatgacataaaatggagataaaatatgaattggcaaaaagtttgggcagtcaacaaatattgggtaatgtctaaatcacagcaacaatatgattacattcgtttactggcgaagaataatcaatggacgccacaaaagacacaagaactagggaacatcattgactcacttgaatcggtttcgccaacaaaacaaacattaacaacaacgtatcaacatatttggggatatttcaaaaaaaatgtaccgatgaagagttacatcagtatttaagattattagataatttgcaaccgaacaatgataaactaggaccttttttggcccaattaactaacaagtaccaaattgattacctttaaaagtctagaattataattgagcttaacgaaagaaaagactagtctgtttttacaaagtaaattttaaattctcccaaaattacagactcattatataatacaggacaacagatgaaatttaaggcttagcgtaaagtttaagtgggtaaattatcagaaacaaaaagggagcgatccctactcatgctagaatgttaatgacaaatcaaccagctagcaattaggaggaatcactcttgaactctatcttacaacaaatcatcacagaaatgatgacatcatttggaaactctgcctttgatttactgacaggaaagttagactttgccaatctagtcatcgaaactcaaaaaagttttggaaagactctttgtcaattacttggtgtcatgctggaacaacaagatcaggttttggcggattcttcctaccggaagcagttttttaaaatcaaagatatgcgtgaacgccatgtcgataccagcattggcactgtatcttttcgccgtcggtactatgaagatgttcgtaccaatgaacgcatctttttgcttgatgagcagatcggccttgaaaaaagtagtcggctcggtctcgacctcaaggccaagttattagaacctgtctagtatctgctgaatctggtagaattgtggaaaaccgactgaggagtttgtcatgccagattatccaagcaatatttctcgagcgcaatttgcgttaatacaacctgatttagaaaacttccgtaagcatacaagaccgcgtcgttatgatctttatgacgtattcaatgccatcctttactcgcttactacagggctatctgagatcgttcaattaaggttataatggccatgggacctgtccttctctctagatggtatgttatgcaaacaccattttagcaagaacggacaggtcttttttcacattttctgggtggtaactttaattatgcaatctaggactttaattatgcaatctaggtaaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttcttatcacaaacctatttttaggagccgatcttttttgtccgaacagcgtcggattaattttacaatctacctttcatgatgaagtgtttcgatgacaacgcggtcttcaaatgataaaatagtggtgcccataaaggtccttctttctagtggaatgttgtgatgacaccattaaagacctttatgggtttttctgtccactaatatgttcaacttaaattttacaatctatctttagtattcgccccaatatttagacattgtttgtttaccaacgccagggttgaaactattagttggatcatttttcttatagtgcttgattaaggccggtgctgccaaatatagatgcccaacattgtgttcggctggataaacagcgtgacgctcatccaaaattttaagcatttcttttttaagttcatgcccatcgacgccaggttttagaatataatcctggtgcataacgtgatcaagtaagtgaccataataaattttgtgttctattttgttttcaatctctttaggcaaatgctcgaaccacttataatcattacttgccaacgcgatatctagtggcaaaatgtcaatactatcctgttttaattcttgatatcgaatcgcaaccccagctgttacatagcggtgagttgccgctttactggtctcattggcatcggcttcaaagtagtcgccactggctttgtcaaaataagatttgagatactctcgcgcttcttcaataccattaccagccattttcaattgtaggtaatggtcgtacttttcgtaataatcatctaaccgctttggcatttgattaggaaataaattacttaatgtttgaagcaaacgatctgggaaataaggtttgaaaaacggaatgtgcttcaaaaagcgttcgccccatgcttttagcgcaaacatttggggcaaatgacccgtaccaattttttcaatcacaattagtgagtctttaccatatttcttggccaatttataagcatttttatgcatatattcaccagaaacaggcaattctttgaatgtcgtcataatatggcgacgaatatcttccaactcatcgggattattcgttccaatgtaaaacatttgtgtttttttatccattgggaatgtatctaagcggacagccaatgccgcaacgtgaccggacgatccagatacttcatacaattctttaggatttgcattgtatcgaataggcttatcagattcaacgtcacgcacaacctgttcatgatggaacattgaagcatgatgttcagtagctggtacttgattcaaatcaaaattgcggttctgcaaattagtaataatctcttcgggcgttttgcccaaatcaatgcctaaatggttaactaagtgcatttcgtcatgttcatcaatccaaacatacaatgatagctctgtataagctggacctcttctgatcaaagcaccaccagaattgttgttaataccaccaataaccgatgcacccaaattagatgagccaatgactgaatgtggttcacgtttaagtggtcgcaattcattttctaagtgaaacagtgtcgtaccggggaatgctagtacttgttccccattattgattaactgtaaatctttaattttcatgccgttcacaacaactgcagaacggtcataacctggggctggtacggatccctcagtcaaactagtgttggctgcttgcataataatgataatattgttatcatgcaaaacattaagcacacgccacattgccattaaagtggttggaaatacgactgcaactgcatcgcccttacctgagcggtaccctttcctaaaacgtaaagattttgctttgttagtaataacattttttttaccaacaacattgactagttcttcgactaagtccatattaacttctcccctctataacgtttgtaaaaaacgttttaatcattacgctttcaatgatacgcttttttttatgcgtatctggattgaagtcaatatttgagacagattttaagagacattcagaaccgcgtttaccttccacagctcaaataaatcatcaattgcgattaataacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggcactggataaacacaagacctagaccttcagagcgaccaggaaattgagacttacattgaacaactgaataatcgaccacgcaaggtcttaggctggaagacgtcatcagaagtcttcatgggtaaaaagttgcacttgagttgacaattcgtcgcaacaaaaaacctccagctacccaggctgaaggcatgcatgagggaagtaaatgtgattgcaagggtggcttgccttgcacgatcagtatagcagatgagtttatcaaatacgtaaagctctggtaccggatttgtacaggtttaaaaaagcaacaaaaaagccgacactttgccggccagttaattagtcttttttatctgtgctgagcttgcttttcacatcatctactgtgtctttaacagcatctttggcatcatcaagcttttccttggctttaccaagtatgccttctgctttgccctgtgtttcgcgagctttatcacctgttactttgccttcaacttcttttgctttaccggagatcttgtccttggtgctgtcgactttaccatctaaactcatagatattacctccttttaacatcaattatcatataagcttatacaaagtgcaacaaaaaagccctcagagaccagtccaagggccaaaaggatgaaaaaacgaaacgtatgtgtgaatagtagcaattgacttggaggagaacggctactgctcacgactacataatagcacattccttgtataagtatactaaaaaagccctcggttgggggccgagagctagaagattagggtagtaccgaggagtgaaaatgagtatttatctggaacaatttaattttagcttattgaaatcttttaagcaacaaaaaagctctcggggccgaatccgagagccacaggaacaacggaagttctttatcagaaagtagagcagcgtcatcaaactgctcacggccattatatttcgggaggcgagtagatgcaatggacagatgaacagatcggtgacattaggaagctcgcctctgaaggctttacaagacgcgagacagccgacaaacttggaattagctatgatgcgcttcagggaaaagcaagacggcttgggatcgagttccagaagccactgaaaaatgaatacgattcagacggcacaaatagggagacaccgtccgctgacagaaaagtcgctcttaatgctgatggtagtcaaacagtcacggccttaatgagactcaagcatgagccaaataaagacccacgaactttgatggagttgtgtggatacgatcctgataagttcgagatggtcttaggcgactacaaagtgtatgagcagcatagtaccgaagacggcacagttccgcagtatagcattcatattcgcgtaaagccgaaacaaggcttatcgataaatgaaatggctgaagcgttcaacgacaaaatcattccggtcaattacggcatgaagaaatcgggcgatcgcaacttagtcatcccattgcctgacctgcattttggctggacaacattcgccgatctaaaagacatggtgagtcaacttagagagataatcatggacggctacaacgagattgtgatcgagcaattgggagatctattccatagtgatcagattcatgtaacacaaacggttagaggaacgcaactagatcacgcaaacatgcgtcaggcattccatgatgctgtgaagttgtttgatcagattattccgctggcaattgaatatagcaatcacgtctcaatgacagcaatttggcaaccgactggcgctgtgcatacttgctagggcatgttggcattatgctcgcacacggagatgtagccaagaacaaactgacaggactttttccatttgagtacaaaaagatattcaatatggcaaaaacatacgaacttcactcaggccactatcatagcgagcggtttaaagatgatcgtggcattatgtggcgccagcttggaacagcaaagccaaatgatccctatgagattaagaatggcttcaccacgggcaaacatctgctgtatgcgttcgtttatgacgacacgcgattgaggtgtacttatgaactcaactaatgcgatgaagcgagtcgggtacggatatgtaagccacacagagcaagcaatcattgagaaactatcgagagaagagaaacacatgcaagcaatcatctacacaaagccacactgccaaaagtgtcggcgaacagtattcaagctgtcacgagtcatgccagtgcaaaccatcacagcagacgcggacgactacgagcggttccgcaagctaggctatcgttcaatgccagtcgtaacaatctacgaagcagacggcacacacgatgaatggtgcgatttaagggttgataagatcaagcagtacacggagggaaacatatgaacggaaaattaatttacttggttgataaggatgagtatatattcataacaactattaattggcaagaatgtcaatggctcctatgctgtaattacggacaaaaatagtttccccagtttacaattcaagtgcaacaccctgacgactagaccataaaggccatgaagacctattcttgttagtgctagctaaacaagagaggccatcgatatcgcacttgatactgagcccaagctcaagcaaacctacgagacctacttagcgcttcatgatgccttgatggtgaagaaacatcccacggaactggcaaacctgttagctacttacgaggcaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgtagagccgaaattagagaactccaatttcattacatcttcagggtgttgccaacttaatgtcacaagccgttattcgatgatatgaatgatgtgaattaaaagaaatagccgatcagagtcatcaaattgatagccaacgtggtcctcaatcaaagcgacgattctccctaaacttttgcccgcgttaggatattgcttcttcaactgacacagaagaaccgtatcgtcagtctcaacaagatcaacttttttaccgtcatgagtccttaacagaaggtagtagaggggtgtcgccatgcgcgaaactgccaaactactctccgaaaacttctcgccgtagtcttttcctaagatttcattgacgccggaaagaatatctaacgcctctgacacagattgtacagagctattcgtctctgtcagttcgtgttcaatgaaatgcatggcaatgaatcccgcctcatcatccgaaaaggaaacatcactaaacgaactgatcaatgccagtgcttcttgaccgacttgaaactcttttggaaaaagcctgcggatgtcaaacagcatcggattgctgacgactaagccgctcttaatcctctgaactgcaaagtagatatgatcggttaaaggaattaacaaatgaccatcaaattcaacgttgatgctattttgtgcgaggctaatgattgaatccgttaactcaaaatacgatcgaggtatctcacgtgctaactccttaaatgagtctacccattgactatcatctcgggatacagggagaaagacatggtcatcctcggttggaagatactcctcatctctcttaaggcggaaaccaatccccttaccccaaattatctgctgcttgtcattcccgtcctctacaagcaaaacattattgtttagaacttgtaggattttcaagatatacaccttaactggtaactacatgacatcgacaaagcttagagtaagcgcttacttagtatctagtataaccaagttgttttttttagtcaatatatttaaagtaaaataacgggttgtctcaaaatctgaagtaagacaaataacgtcaaagtgatgctatataacgtataaaaacttcaatgccttttttcctaatatatcaacaataatacttaaatactgtttgtttaaatcatcggttattaactaaaaaatatttataagcaacctgtatgacattctttgcatcgtttccaatccggggtataccatggccgcctaaaataatgtcaggatttagctttaatgcccagatttttgcgaaactttgtcttaatttctgtgaatcaaaattcaaatcccctttccatccggtataagcctgcgaacccgtttcaccatctgcaaaaaatgtgtctcccgtaaataataactgttcgttgtctaaattcaatgcatatataacgctgccattcgtgtgaccgggaaccatataggcaaaaactgttagatttccgatttttatcttgatatcagtatcaatggctacatcaggtgtgaatctaggcatgatgtggttggtaaaaggactttcttcacccaaatcacctcgttccaccatctcaacatcttgttttcctagatatactttggccccttgttgttggaagtaccctgcgcaacctgaatgatcgtcgtgcccatgagtcaataaaacgtgtgtaatttgagtctctggaatccgccaatatgtcaagttttttctgattgtatttaacccttccattcgactggaatctatcaaaatgtatccgttagagtattgaactatatatgcagatcctaaaaaaccgtaaactgctccagaaacttggtacagcttctttctgagacgcattctaagtcctccctatattgagaaagtaaaagtctcgcttttcagcgagactaatcagcttgggaacctgtatcgtttgccgtataaactgcctgccacgtgactacttttcccagaatagtaaggcaagaatgtcaatggtccggacaaaaattgtacggttctgccgaatgcgtatggttgtcacttaaattcacgcattatcagatcttttatcagcgtttaatcttgtttatcataagggaaggcattccctatttctatacaattcagaaatcttttatgcatttacacaagatattttacgctctcagaaatagagcctgatatagtattcgttggtataacctctcctaaaaaagaatatttaatcgaatatctacagaataaaggcataaaaagtgtttttatgggtgtaggtggaagttttgatgtaatatctagggcaattcctcgtgctcctaaatggatgcaaaataataatcttgagtggttatttagggttattcaagagccaaatcgcttatttaagcggtattttattggtaataacatctttattaaaaatattattaaagaaaaatttaaatagtaaagaggggatatagagatgtcccctttattatataatttgattgaaggtgagatatttgaaatatacatgcgaaatggggccgggtgaagattatccaggtggaatattaactgtgattaatgaactcgttaatagtaagtatttgagaaaatttaatgttaaacgtatagtaacggttagtaaaaaaaataagatactaaaatttttggaaagtatgttttattattttctcttgtgtgcaatgaaaagagttcaactatgtcatattcatatgtcagaaagaggaagttgtagcagggcaataatactaataaatgttagtagtttttttaatgttccagtaattgttcattcacatggtagtgagattattggttattataattcgcttagtacaaaaaaaagaacgtatttaaaaaagcgatgaattattcttctaaaattataattttgacacccggttggggggaattttggggaaatatagtaaataaaaataaattggtagtcattcctaatgctgttgagctgcataatataaatcgtaaagattataattatgataataaacttaatttgctatttttaagattcatcggtgatagaaagggaacctatgatttagtgagagcagttaaggtaattattgatgaatataagattaataatgtttcgcttaagattgcgggaaacggagaagaagataagtgtaaaaagtatgttaaaaaattgaaattagaaaataatattgatgttattggatgggcaaataaaaatagaaaacgtgaattattgcgtcatgctgatatattaatattaccatctcattttgaatcatttggaatagtagttttagaagccctatcgtataaagtgccggttgtttgtggtgatactggatttacaaaggagattattagtaatggaaaagatggatttattgcaaaaacaggtaacagtgaagatatagcaattaaaattatagccgttagtaaaaatttagagtcaatgggtgagtatggttataaaaaaatcaagagttgctattcaagaaagattgttgaaaataaagttaaaatgttatatgaggaggtaactaagcatgaataatattacttccccattagttagtctaatagtaccagtatataacgtggcaccatacttaaggacatgtgtagtttcacttattcatcaaacgtatgacaatttggaaatattactaattgacgatggctcaacagataacagtccaacgatttgtgaagatatggcgaaaacaaaaagttatattcatgtctttcataaacagaatggggggctgtcagaggcaagaaattttggcttaaaaaaggccaaaggtgagttcgttttttttgtggattctgatgattatgttagagattgcttagttcaggatatggtaacgattgcgaccaaaatgaagtctgatatagtgcaatttaattataagaaagtctcaccaaataatttcttaaaaacatggcctaaaaaaaacaatgaatatataaagttagggcatgataagggattagaaagttgtctagattataatgagataaacattatggcctggaataaaatgtatagaagaagtttatttaatgatatagagtttccgcctcaaaagattcacgaggatgaagcaattatgccttttattatagataaggctaaatcatatgtaatagttaaggatgtgtattatgcatatttacaaaggaatggaagtatcatgcatagtatttttaataaaaaggaactatattattatgatatctatgataaaaggctatctcatttcaataaaaaatacgactatcgatacaattcaataattttatatcatgcatttgtagcatcacaacgactgtatcttaatctaaaaaaagaatcagtaataagtaatgattcattatcaatggtaaataataagtctaaagaatatttcattaattttattaaaagtagaaataaaactttaaaaatgataataaaaatatttctatataaaactataggtagtggctggtgaattaggcaacatttcggctacctgaaacgtgaatttgataatgaattaagatggattcctgctttcttgtttagctagcactaacaagaataggtcttcatggcctttatggtctagtcgtcagggtgttgcacttgaattgtaaactggggacgctttttaattccagatttgttggcagataaaactgtgtacctgacgctatttgcccgccaagcaccgcaacggttagggcaatatgcaggtgagtcgcgtgtgacgttggttgacggcgactggaatcaagaagccgatattgaacaggttatgtcgaatcaagacatcgtttttctggcaagttccagtctcgtcggtaatcaaaatgttgtcacagtgatgaagcataccggtgtccaacggttgattgtcgcaggcggccttgggattgacgatgaagttgccggcaagtttggcaactggaatacgcggatgatgggagattacacaccatacaaacaggccgcaaaggtgatcttagacagcggtttgaataccacttatcttcgcatgacatggttatacgacgaaaacggcaacgaaaagtatcaaatcgtgccagaaggccagccattgcgcggaactcaggtaacacgtcaagcagtggcgaagttagtgactgccatcgtgagacagcctagcttataccagtacgcaaatattggcgttgttgaaccggggactgagtgggacaaaccctcgttttattaaagttgcatgattcatctgaaccaccgatcaattcgcaaattagaattgatcggtggttctttaattttccgtcaacatgtcccagaagagagctaggattcagattgtttgttcagttttctagttgttttctgtataatcgtaaccataagtaaataagccttgtgatgatttttgtcttgttgtggtcagattggcaaaattactgtcgggaatggcatttgggggattttggaggaaggaatgcaaattaaagcagggacggccgatcagggatgggctttagaagaaaaactggacgaatttaatcggcatcagcatcccttcaacggatcaggtgccgacgagtcatttgcgtacgtcatcaaaaaaggtgaccaagtggttggcggtgttgcggcgagttcggatgacaatgcgattggttatatcgagttgctctgggtagatgaaaccatgcggcgacaggggttagggcgtgccttgttagcaactgtcgaacaagccttgcaagctgctggttgcaaaagggtgagattagaaacttttgattatcaagcaccagcattttatcttgaaaacggctatcacgaatttggcaaacttaattacgactatgccggtgtgattgaatattttttcgtcaaaatgttatcgctgccaatcggctacaacataccaccggctttttcgattgaagcagctgaagacctagcgatggaagccattgagaataaacttcatgcctacaatgtgaaaatgaaaccactactgcaacaaaaaatgggtgtgacttttacttttttagcggaagaaaatggccaatgtattggcggcattttcggttacagcaccatgtataaaatcggctatattgaaagtctatgggtagctgaaacgaacagacatgcaggtgttggcacggctctcgttgatgttttagtaaatgccttaaaagattttggctgtccgattgttcacctcgataccatgtcgtatcaaggtgcggcgttttataaggcacttggctttgagcaatttggccagctgacctacccggaaattgacgcagcagaggtttttttcgtcaaacacttagtttcagttggagaaaggacaataaatgccaacaaataaaggtatcacagtcgctcgcgaagaagatccagatctaaagcaagcgattgtgcgggctgttttggccgatttgcccgaatggtttggcttgccggatgcaactaacacttatgttgaagaggctgcaaaactatctttatgggttgcttgctatgaaggtcaggcgattgggtttatcgattatcgccaaaccagcaaggcaagcggcgaaatcagttgtatgggcattaagaaacactttcatcatcaagggattggccatcagctggtaaaggcattagaagccgacgctaaacaacatgcccactacctgcaggtaaaaacggttgatgaaggtcattatcctgaatatgatcaaaccatccgtttttacgagtcagtgggatttgagcgattggaagttttcccgacattatgggatgcttggaatccgtgtttggtgttggtcaagaagctttaataagcggccaaatcgcccagaacaaaatcaataaaaatcgccatgcctgacagggatctggtgcaaacagtgtgagagatgaccatctaaccagctattgatcctatgttgaaggttatgcagctaacaatgcttctaattcgtccacgtaccccgcttatcttgagtctcgtcgcttaaagcatagcactagggaggcttagatgccttttttgttatcaaaaagagcctagtacttttggcatggaaatactttccaacaccaaaaattctagacccattatctccctttctttaattcttactaccacataaagcattaatataattatagcttctaaagttaagtctcgatagatttattatttattaagcattttaattattaaaccgtctaatttattgaaaaatttatatgtttttacatagaaaagtccggcaccatcatattgtgttaaataatacagtttactttcatcattaattctttttattttttgcaaggataagtttgtcgaaccttgttctgtatgtatatagttctcactggtaataataaaattactaactccaattttttttaatttacaataaagaatttcttcttcataatataagaaagtttcattgtcaaagtatccaatggttttaaatactctttgatttataccaaaaaaagcacctgaaacaacatcaaccctttgaaaatcattctttcttttataaaatttcctttcttctaaaccaagaagtttatatacaattctactaaatacaaacaaattaaaaatatatcctctaagtaaacctgtatgtttccatacgctacgcattgaattatttaccctagttgtaaccattccaatgttctttttactatatattttctgtgcaatttgattaaccgtatgcctattaactttaacatcaggattgactatataaacaacattatctaagccatacttactttcaatatatttcaatccaatattatttcctgaagcataacccttatttttcgacgaataaagtatatccacatttttattttcactcaaagcccgttttaaatatttataagaatcattattagagccattatcaacaatcactactttatccacatcagaagcaatcagcgtagtagtacaagaaattgtacttttataattattaaaattcaatacgactgctattttcattaattactacctcactcaatctttaaaacattttaaattttcacaaaatatttcaatacagcgtatagctaataataaattggtattattatttactcaacaatatttttccgaactctttaattgttctatcccatgtcctatcttgtattgattttacaccattatttgctattgaaatcctctttttatcgtctttaaacaatctcattatattttcagcaagccctttagaatcctttatgtctgttaaaagtgcattataattatcttcagcatattcaaatacccctttatattttgttgataccaaagcacacccagctgccatactctctgctccagttaatccaaagccttctttaatagaggcacacaaaaaaatagagcacttattatataataaattgacctctttactagaaatattagaataatattcataccatttgggtacattaggccttttaggagccccaaacatcattactaccaaatctggatatttttgatgaacaatattcaatgcatcaaaagcatatttaagccccttaaatttccctttgtgatatagcaatcctattgtatgtttagacctttgtgaagtaggaataatcggatagaacatattagtatcaatagcattagggataaaataggttttattatgatcataattttgaactattttttgtaaccagcgcgaaattactatatttttcatccctagagaataagttttattaacatataaattactataattccaattttcgtagccttgtactaaatagattttttctcccttttcattaggtaatttataaactggtaacgctgtatcaacagctgttgcaacaataaaatccgaatttttaaaattttcggcttcataactcgaaataacatcaacttttactttattagataaattaaaccatgacggtataagcttaatccttatagcaatcctataaattgctaaacgaaccattaatggtaattttgtctttttaaaaatatctctcgacatggcagcaatagtaacctcattaccattacttgataacctattggcaaattcataaataactttttcgccaccaacaggttttcttgagatacctggaacacaaaaagtgattttcatatataaatatcctcacttataaagtattactgctattataaaaacgttattgagagcgtaaaatatcttgtgtaaatgcataaaagatttctgaattgtatagaaatagggaatgccttcccttatgactatctgagatcgttcaattaaggttataatggccatgggacctgtccttctctctagatggtatgttatgcaaacaccattttagcaagaacggacaggtcttttttcacattttctgggtggtaactttaattatgcaatctaggcgtggtttacactttcaacgaggccaagctgcccaaacaaagttgattcgggtggtcactggtgccgtgttagatgtgattgtggatgtgcgggctggttcaccaacttacaagcagtgggaaggctacattctttcttcaagtaatcatcgtcaattgttggtgccacggggctttgcccatggtttcttgactttgacggataatgttaacttcctttataagtgtgataactactacaacgcagaggccgatggtggtatttcatttaagacaccggaattaaatattgactggccaatcgattttgataaggcgattacctctgaaaaagatgccgcgcaaccatcatttacggaattcgaaaaagacaatccgtttaagtacggcgaaatttaggagtagataactatgaaaaatattattgtaaccggtggagctgggtttatcggctctaactttgttcattacgtggtgaataaccatccagacattcatgtaacggtgctggataaattgacgtacgcgggcaacaaggctaatttagctggtcttcccgccgatcgggttgaactggtagttggcgatatttgtgacaaggagctggttgatcgcttagtttcgaagacggatgcggtcgtgcattatgcggctgaaagtcataatgataactcgttgattgacccaactccatttatccaaaccaacattgtcggtacgtcagtcttaatcagcgcctgcgtcaagtacggcgtacgttatcaccatagctcaacggatgaagtatatggtgacttaccactgcgtgaggacttaccaggacacggtgaaggcgtgggggagaagttcacccctgacgcaccttacaagccaagtagtccttttattaatgagaagtgaggtgtggtagttattaaaagagaaataacagtttattcttacggtgacggtaattctaaaaaaacatggtcaaatgttccctattttttaacaaaaacatttgaaaataaaggatatattgtcaataaggttaatacacagccgaataaaattattagtagaatatggaatgcattaattttaagagttatcaaaatttttatcaaagattccacgtacacgtacgataggacaccattttaccgcagttatgttaaaagattaatgaagaagacagtgaataaatataataatacagatatttttatatcgattagttttagctatcacccaaaagagtttacttcgcgtaaggtgttcatgttttgtgattggacttatgattattattttgaacattttaaaaaaaggacaccagatttttttgaaaggcaagaaattaccaatcaacacgagttgcaaaaaagtgttgatggcatgtttgtattatttcccgatgttgcaaagtatgtcagtcaacaagcattttgtaaaaatgtatattatttaggaaatgtaattaattctgaaaagtatgaaatgacttctgatactcttgtaagaaaaaacaagaataaaaatatcgtgttcataggttctatcaagtatattgaaggcttgaaagttttggttgaaacaattgaaaatttgtctaaaaaatattccgatattagactagatgtaattggtattactgaaaaacaattcaattttgacgaaaatactaatattcatttttggggctatttgaataaaagttttgatgaagataacaaaacatattatgatattgtgaataatgctagggtgtttgttaacactactccagaatgggcctcattttcagccattctggatgtaatgtatcactatacacctattattacatctagatatagaagttttgagcaaacatttgggcgagaaattaattttggctcttattgcgaaaacgacaaaatgcaattggaaaacaaaatagaagaagttataaaaatggattcaagtcaatatgaatctatttgtaaaaatgctagaaacgctgtgtctccctttagttgggataagtatgttgataaaatgatttcgaaaatagacaagaacatgtagcttagaatggggatctggtgcaaacagtgtgagagatgaccatctaaccagctattgatcctatgttgaaggttatgcagctaacaatgcttctaattcgtccacggtaagcgtcacatagtgcagtacctataattgtcaaaatcctccctctatacttggtctatcaagaagattggaggatttctttatgactcaaaccaatgatctggttccaatccaaatggtcaatcgcgacggtgccgccgtcgtggtgaaacccaaactaggagccaaaattaaactaaacgaagccgaagtccttttctacaatggcatcgataaggtgatggcccggattattttgcaggagttgatggcccatgatacccgacctgtccaaagctaacatttacatcatttgcggtcgcaccgatctgcgaaaaggcattgatggcttggcggccttggtcacggaggagtacaagatggatgtgttcgacaatgcgttattcatcttctgtggtacccgtaaggatcgtttcaaagcactgtattggaccaaaagtggttttctgcttttatacaagcgctttgaaaacggctatatgcaatggccgcgcgatcgcagtgaaattcgccgtttgaattatcgtcaaatgtcacgtctggtcaatggtttagccattgaagaacgccgtaccattcagcctgtaaccccggggtatgtgtactgattgtctgaaagaaagtcttttcttgaagctgacgaaaaggctttcttttcgtgtggccgcttgatatacttttttcaaccattttaacggagggcgcgagatgtcagcggaagcagtcgtgacgacagaacaattcgaatatctcaaacaagagaacgcgctgcttcgcgaacaagtcgagttcttaatgcggcgcctgtacggcactaagcgtgaaagtctcactgacggtcaggttgatctctttgatcaaaccaaaacctttgtggcgccaacagttcctgaaccagaagagcaagatgacaaacctgcaaaacgtaaaaaacaaaaaggcaggaaagcagcgcaactggctccttttcctgaagtggctgtgcaccacgaactaaccggagcggaacgccagtgcccacattgtgccgctgagatgcgtgaaattggggccacggcgaccagccgcgaaccggttcggattccggaacacgttgaagtccacgtccactatcagcacgcctatgaatgtcgccagtgttccaatcagttagatcacagcgtcatcaaaaaggcgatagtgccgaagccgttcattcctaacagctttgcctcaccaagcatcctaacccaaacgatgatcgaaaagtatcgtaaaaaggtcccagcctatcgccagataaaggattggggagacttggggctcgaactaacccgccaacaaatcaccaactggcacattcgggcttgtgactatgggttaggcaatctctacgaactgatgcatcaaacactgctcaaacaaaccgtcgtccacgccgatgaaaccagctatcgcgtgttggaaagcgagaaagtaaacacctatttctgggttttcgcctctggacgcgcggaagacgagcagattattctctatgagcacgccgattcccgcgccacggaagtcccgaagaacttcctcaacgggtatacacattatctccaaaccgatggctatcaagtgtacgacaaacttgatcaggtcacccgagtcgcctgtctttcccacatccgacgtaagttcttcgaggccatgggtaaacagggcaacacgcaaagcggtgccaagaaaggtgtgacatattgtgatcgcatgttcaagatggagcggccatggcggttattaacccctgatcagcgctatcaaaaacgccaaagtcaactgaaatcaactatgtccgatttcttcacttggtgtgaaagtgtccacgccttaccgcaatccaaattcggccgcgccatcgactatgcactcagtcaacgcgaagccatggaaaatgtgttgttggatggccgtttggagctttcaaataaccgcgttgagcgcgccgtcaaggaactcgttatcggtcgcaaaaactggctattctccacgagtttcaaaggggcccggtcaagcgggattatcttgagtgtcatgcgttcggctgaggccaacggtctcgactgccgcaaatacctcgaatacttatttactgaattacccaacctttccgttcctggcgattctaaagcgctgcaggattatttaccatggtcgtcgcaagtccgggcaatctgtgcaagataaacctcaataaaagacaacggcttcggcatttcctcaatcataagggaatccgaagccgttttaaatgtacctcacaatcgtgcgcttacgcggttttgccttcatgaaaggccctttgggcctttcattggtgcggactaaaacggtagccagcatcgcagtgacgattgatattgcgatcaatctatccaatctaaagatgctattaaggctttttaatggaccaattttgatttttgtaaaatataagcaggaatccatcttaattcactatcaaattcacgtttcaggtagccggaatgttgcctaattcaccagccactaaagtagcaatatcattgggcgaagcgggcagagatgcccgtttttttgtgctgacagacgcattctggtgcaagctgaacaagtgtaccttgaggtacgatcattctgggcaatataaatgggagtcgcaaatcacgaccccctctggtatttaatgcctgcttcgataatatcgaatcggctaacagagcccgaatttcgagccttgttgaccaggtatcaaattgatacttacttattcgaacgaggttataaatacttacccggttaggtaatccggaaattcgggattggctcaacaaaatccaattcgggtattcaagaacgaaccaacaaattgtgggttcgtcgggaataagcaggtgacaaattattattactacttagaactagccagaatgaatgtggctcccttaaccaattctgtattggtgttcggttgattgaagtaaaatgaaatgccgatctttcgtgtagattaccgcttataaacaataaataagcattatgaattgagttttgataaaagcgttgcgaaagaatttaatttgcttttagcctcagatcgagcttttttaattttgtcctccgttcatagtgtgcagatctttcattactatcaagattgttatattcataaatagcatccgagagatcttcaatactactaatggcaccatttacggtttctttttgcgtatcagagaataagtaatttctattatcaatgatttgcgaacaattttctgccatttcattgattttatcgatctttgattctggaacccttgatacttcaaaatcaaaatatgcttcatttaaccaagtataagcattctcaagctttgttagcaatctttcattttgtcgtatcttccttaacttactttggttgtaaaatacaatcccaatattcacaagaatgctcactattccaataacagcagaccacataataatttcctcccattatttccggatttgaaacgaactcattatagatcttatagaccaacaacaaatacaaaaaagccacctcataatgaagtggctattttgtgttagtcatgtagcttttcttgtagtttatctccagcattatcaatgcccttagctgcgaagactgtacctgcaactaaaacaccgccaacgatgagagtactagcaaccataaacttaaatgcagcttttaaagcgtccataaagatggcctcctatcagtcttttgatctgccaacaaagaaggagactacggcaacaacaataattgcgccgataattgaaggaatcaaagccattcctgccagttgtggcccccaatggcctaaaagtccctcaccaattgcagaacccactaatcctgcaatgatgttagcaaaccagcccatcgatttgcccttgctagtgatagcaccagcaattgcaccaataatagcaccaacaattaaagcccaaagaaaatgcatgataattcctcctttttggttatattgtctctatagacgaacacagtataacatacagtagcaacaatagataataaaatagccgcccataatggacggccaccgcctgccaagcagaaatgaactccgtggttttctcgtggttttcttttattgataatcaatgataaccaatgacaatctggttaaaataaaaaccagtaacgacgctgttttgacaacgtttgctactggttgataacgctattctgggtggtcaggggatcgaaccctggacccacggattaagagtccgttgctctgccagctgagctaaccacccatgctgcttatgtctgtcgcgcttcacgacttaaatataatatcatgtaccccttactggcgcaagtgttttgcaaatcttttttcaaagaatgtgacaaaaagctgactgctgcattgtgtcatcaagcggttaggcagcgatttcgtcggttactggcaatttgctgatggtcatttggtagattgtaaaattaatccgaacgctgttcggacaaaaaagatcagcttcctttaaaatggtgtttaccacaaacaagcccgcatcttcggcccggcgttttgaaggtttgggggatcgataacgataatactgagctctggaaacaccgaggattcggcacatcttggttacctggtggtgatggctttcttggtgaatgtaatcaaaaatattggttacttctgcgcaaggaagcccagggctttttttaggatttcgttctcctcagacagggaagccagccgcttttccatcgctttaatttcgtctggcgatttaccggattgagttttggcttggccctggatccacttatgaacggttgaatagccaatgccatattctctggccagttgagcggctgattcgccttgtttatataggttgatgatgttttgtatgaattctttgtcgtaacgagttggcatgtaaaaattccttccttttgagagacgatttattcattatacgctctcttaaaagttgtctcaggaatcagcttacatccaaattgtgtacaatctatatcacgaaaactaattttagagtacgataaagttgattaacaatttcgctaaaggcgatgatgggatgaaaagcacgacgaaatgggtaacagggtggcccgaacgaattagttacggcttaagtgacgccgccgataatttagtctttcaaatgatgacgacctatttgctattcttttacacggatgtttatggactgacaccaagcgcggtggccattttatttgtcgtggcgcgggtagctgacgttgttgaaagttttgtcatcgggatcatgattgatcacacacattcacggtttggcaagagccgaccgttcttcctctggtattcgttaccttacgttatttttgcggttctcacctttgtgacgcctaacttttcgtataatggtaaattaatctgggcatatgtgacgtatttaggccttggatttctgtatacggctgttaatctgccaatcacgtcaatcttaccaacgatgtcgcagaatactcgtgagttgacgttgttgggtgtcattcgtcaattctttggcagttcggttcaaattgtggtggcggtattcacattacccttggttgcgttcttcggccacggtaatcagcaaaaagggttcttgggcacaatcatcgtgtttagcctgatttcatttcttttgattatcaacacgtttgtccatgttcgcgaacggttcgcgaatcctgaaattgcccatcaaccgttaacaactgtcctaaaaatgttgaaacataatcagccatggatcgttatgtcaatcgtgattctcatgtactggctggtgacggcaattaagaatcagacaaccatttactattttaaatatacggtgggaaacgaaaacctggtgccactagctaacagttttaccctggcagcgttaattggggtattgctgatcattcgaattaccgaggttggcagtaagaagcaaacgatgcttcgcggtattttgatggcgctggttggtcaagccgtgattgcggttggggtttataccaaaatactgtggttcttgtttggcggtgtcttgattaactcgattggcaatgggatcattatcggcctcgtctcaatcatgattgctgacacaatccgttatggtgccagcatggggatccaagccgagggaattctggcttcaacggatgactttggcgttaacgtcggccttggtgttggcggcttgattacagctggtttgtttcacttttcgggttacgttgccaatcgaacccagaatgccgcaactctcaccatgattaatttgaattatgtttggattccgttggttatttatgtggggatgtattttgtattgcggctttatgatgaggggcggattgaacgagcaatagaagcaagaaaataagtccgaattatattctaaataatagtttttgatttgctaactaacaccggtgcggtgtgatattattacctttttgcgccaacggttattgcaattggccaaataatcttgcaacctcacttttgaaatgcaatagattgtgagtcgttccagttagcactatgctgaaactgagaggccatcgatatcgcacttgatactgagcccaagctcaagcaaacctacgagacctacttagcgcttcatgatgccttgatggtgaagaaacatcccacggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgagcctgttttggcttcaagaatcagctgaacttcttcaaacgaatctaccaaatcacggcataacatgacaaagacggctccccaaatggagaaccgcctcaaatgataaatttattcttcaacaccagttgacgcagagccagaaaaacttagaaataataatatgcgttaattatcgacaaagagtggaataaaccatccccaaaaacaagtgcctgttcgaaaatcaaattgattttcagacagacactctttttaccctgcgataaaaatctcaataggcaccagttggatgaaccacaaccaataccgtcttcagaagaatcttgagatccccaaagaaagacgcactgttgatataacgaatgtccaacgcaaccatctcagaaaagccaagctcatttcgacccgagatttgccacaaacctgtacatcccggaataacggcaagtcgttgaagatcgtaatcggtatacttaacaacttctcgaggtagcggtggccgaggtccaaccaaactcatatccccgaccaagacattatacagctgaggtaactcgtcaagactatacttccgaagaacacgaccaacacgtgtaatacgaggatcattcttaatcttaaacatggcacctttaatatcattacgtcgaagcaatttatcaaccagcttgtcagcgccactcaccatcgaacgaaacttccacatctgaaactctcggccatttttaccaagccgagtctgtgaatagaaaatccttccgtgtggatcatcaaccttaattaggattccaataatcagaaatacccagctgagtaatatcaaccctatcaaactagccaaaaaatcaaagcaacgcttcgagaatatgtagcccggtgtcacccccccaaggtcaacttgctcggcattgacttgcttacgactagatgttgtctccaaattcacccctccactactgccaagatatggctgaaccaatccccaaacactgataaatccttttcatattacaataattttaacatttaggcaagtaatatcaaacgactggaaagttacttttgccaacttcttatctgatgacgaaactggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctcttcctattatagaaaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctgaggccatcgatatcgcacttgatactgagcccaagctcaagcaaacctacgagacctacttagcgcttcatgatgctttgatggtgaagaaacatcccgcggagctggcaaacctgttagctacttacgagccaaacggtacggcaatggacatgacgatcgcgaagcttaagcgacacaaaatcgctgttctcgccgctgtcaccagcccttattccaacggtccgttcgaaggcgttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccaaattaactcagtaacttataacgccaagatctacttttagtaagtacgctctcatcagcggtgtaaatcttgactaagctacctttgtgaacaccttttaaaattaaacttggtgtgtcatactccatctcaacaacttctccacgtgcatattgtgcatattttttgtttggtgttcgttgctgtaaaatagaaacttttaagccaagcgactctaatacatcctttgcttccattgcctgcattcctaatacattggggactttaacgttgttgtccacggtcttttctacagcttctgtagtcttctgaacaattggagatattactgcgtgtacagtgtcgtcacttactaatgactgcctggccattttcccaagattctttattaatcccatcttgttaacccactttctagtgtcttctgttggtccactaagctagctcttattttattactttatgttagctttggaaattgttgaaaatagtttcatatatatttcaccttaagcgctttgtgttagcattggtagcatccatgggtggaagtaggtaattgctgatagttcccccttgccacaaaaaagtgactgtgggtggctcttcaccaccaattgcatacacagcctagttattaacccatgataatcacgttgctaataaccagcatccagttaccactctagtcctgcccagagtaccatgtgcatgagtttgagatttatttagctgttaactgtgcggtctaactcctgaaaacacctctaatacacatggccggatgacctcacagctcgttaaagctgtcaagacgttccacccctaccatttaccatttaaagtccggaaggccgtagacaccaaggatttgacgatagggaacctgactgggatttcttaccggctggactttatagcatcggctccagctgaccacctgactttatttcaaccgtgagcaggtatgctgtgacacgaacataacaatcatgatatacttattttgtcttgactagacaatcagtataatgacccattggcgtgggtgattattgcggatattcagttttgggtatctgttttgattgctacttcgcattggcgtgcggggtagtttttttattgtcttcaagaaattcctcaattttcaagtcaagtgcaacgatgataacgaattcttgatagtggtctaggctgttacgccatgcatcggtagtaatcgcatgggcgaagatagttcagaatacgtctgggacgatggttcagtgcggcctggattattcacctcggtattggggacatgaaatcgcatctggccggtctgaaagcaacgtttggagcgttgcgaatactgactgagcggagaagttggtgatcgatgcaccacgaacagaccgacccagttttcggctcgacgcacgacctattcagttattcagttcaggtcgccaactgatggacttcgtccatgagccgactaaaccagttcttgtaaacatagttagaagcaagatgaatcaccacacgacgggcgtgccaagtaatcctaccggcgatgtgaaagagactgaaccgtagcgaggagatggttgaacgacggtcttccgagacaaagagctgtttaaagagctgaaccaggttataggcaataccggtgatcaaggctcgtgcagtgttccgtgcaaaagttgagctgtctgttttgtcaaagccaaacccgcatttcagctccttaatttggttctcagcattgccccgctgtctataggtcttgaacaaagtctctggagcctcggaggccaggctggtcactacgaatgcgtggttccagggaactagctcatctgccgtatgagtagaacatacgataacacggcgagctttaccccatgacgcggcctgatacttgaattcgtggtagacgcatttgctctcttcatattttggagggcaatccactaaggccgtttctgccagcttcccaagctttgaatttgccttgagtcgaaccaaaaagtcgacgccatgtgtgtcgcacatctcgtaaaattttggcgcagcaaaccccgaatcgcctcgaatgatgacgctggtgctttgagggagcgccgataggcgcgaaaaagttatctcgacgaacttatcggcttccttgccggtgtactcattgccagggcgcatcaaggcgtctaagagcaacccggaatcttgatcaaatacaacctgagggtgatatccataggccatatagtgagcgttgaaggcggaccgttcttgattaccgaaagtatcacaatgcgttgagtctatatccagcacgaagcgggattgaccactaagacggaaagccaaggcggctacttgccagataagcttccgaaagtcatctaggtcggcgtcttcaaggcgcttgaaaaaccgtgaaagtgagggctgtgagactagccgagagctacccaaggtggccgccagtacgggatcacgttgccagtcattggcactactgtcatgtaaatacccggcaacgtcgagcaacaatttttccaagaagatgtcgatcatcgaggccttccagaatcgtcgttggtctggtaacttgaggcactgattggcaagttgcctaaagttgatacgatgaagaaactcttggaacaaaacgagcccggcgtcatttgaaagttgaccgccgtcggcggtcagagtcacattggtattgcattgcagggataagctggttaaagttgagatggtgtgaagcctcgctttcgtgatggttttcgttgactcaaccttagcatataggcgcacccaatgggtgaaacaccaaagcagcgcagtcccgtgtgaatcgtgggattgcgctgcttttttgaaattctatgaataatccaggaagtagtggctgttgaactaggccaccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagccaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggagcaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggacccactcattgttagagctaagtgggttacttaaaccggcaccaaaagattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactaaggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctacgtggtaactttattattgcaatctaggatattaagactagttttcaagaaaggaagccgtaacgtgcgtttatggcatcaggatttaattcagcaactcccaagacaacaattattgggacagcatcgtgaaattgcggcgcttcgcggtaatggatggggacggaaacacgctaccgttaattacgtatttgcacattccccatataaattatttcaatttcactgtattgtgttacgtgaaatggaaaaacgaggttatcatccagatcagaaatggtatgatcctctgtatcgaggtcaacattgcccagcatacaagcaactcaatcaggttgcactcacaatacccatctatcctgagcatgaccaacgatataaacatgtttgcttaaccaatttacaaaacaagggaatctttttaaaccttccgtgatcctagtctgcgatttttatcttaggacataggattgacaaaatagtatctcaacaatatatttactaaaagtaaataaatagccagtattacgttgataggagaaaatcaaatggtaaaccttacagaagaaatgaaaaatatgttaaagaatcagctcccctttctagcaacaacaggaaaagatggcaaacctcaagttggtcccaagggttcactacatgtcttagatgactcacatttaatttactttgagcacacctttaggcaggcctataataatctctcgaacaaccatttggcggcggttgcggttgctgatagaggcgctcaaaagggatttcgctttgagggaacggctcatattcatgaagcagatgactttgctaatcagattctagataaaactaacatctttgatcgtttcccacgcgctggcgtggtggtcattgatgttgaacgaatctataaattggataataccttagaagctggcattcaaattgcataagtgtctcaaaccaaattcagccaattaagcgggaagatcttcaaaagttcgacttgatacaagcaccatttcatctcattaagcattcgtttgcaagtaactttgttatactttttataagcaacggacatgcttcgaattttggctctaccctagattgcaataataaagttaccacgtagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccaggaatccatcttaattcattatcaaattcacgtttcaggtagccgaaatgttgcctaattcaccagccactaattatgcaatctaggcacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaaggtcattttgaatgctaagacgacggtagctaaatgcaacgagttgcatacgttcacggtgttaccgcaacgatagatcattgaacattcgtggagttggctagacaaatgtcggcgactttggaaaaactgtgaacgcgcccttaacagcagtcttcaaatggttgtattggccttcctgaagatagttcttaaaagatactagacaggttctaagaaagaactgtttgatggttctattaaggcggtcgctaagtactttaactgatttgtgagtgtcggcgtcaatgcaaataaacgacatggagccgtgcgtggaacggaattcatcaaagcatagattaatcggtaaccggcggctcgcgtgtggatgaatattagccgtcaaaatacgctgaactgagtttgtcgaaataccggtgagattggcgatagtcttagccgggagtgatttactggctagcttcagcacatgagtcactagtccgtgaccgatggcgtggttggttgataccactggagtggtggccgtacaagtgctatggcagttactacaacgccagcgttgcttgtttagctctagaattacgggccggtccatgggtcctgcaatgtggacatgagtgagcttgtgtccgttagggtgcaacgtattgtatccacagctgggacagcgcctgagtgtgtaggtaagctctgcctggatgaccaaatactttttgcgacccgatccccgaccatgaaattcatcacgagtaccgaacacctgaatgtttgtgtctgtaattcccagtaatttaagtgtattatctagttgagacatctattactaccccgcttatcttgagtctcgtcgcttaaagcatagcactagggaggcttagatgccttttttgttatcaaaaagggcctagtacttttggcatggaaatactttccaacaccaaaaattctagacccacaaacaacagcacatctttaacgccctgcttgatcaaggttcccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtgaggccatcgatatcgcacttgatactgagcccaagctcaagctcaagcaaacctacgagacctacttaggcttcatgatgccttgatggtgaggaaacatcccgcggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgagcctgttttggcttcaagaatcagctgaacttcttcaaacgaatctaccaaatcacggcataacatgacaaagacggctccccaaatggagaaccgcctcaaatgataaatttattcttcaacaccagttgacgtagagccaaaaaaatcacctcaccaagtttttgatgaggtaagcgtaacgtcgctgcgatcggattaaaatccgtcatttaaaagggggcttaaattataagtactgtactatgtgatgcttactactatcatttcttctacgatgaaatcacagtacaaaaaaatgcaagaaatccgacattttcaaaccgccgcttctctacattttatgaccaacttttgcataaacagttaaaatcggcttcttattcattattactgctaatgctttcgaattgtcatcatcatttttaacgtaaggttctttgttttttaattttattgcgtcataggaatggcttgttgcacaccctagatgtgataacactcaaattgtccttcaaatccaagctttttaagaacatctttgtatttttcaatttttattttatcatcgtaatcattgaagaaaaccttaagggtaaatgtgggcaaagatccaaatagtcgttgtaaatagtattgatccacctcagaaaaagaaaaaccaaagaaataaatggattcaattttagattctttcaatgtcaatgtgtgaaagaagtcttcgtgtttcttgtatgcctccgaagtattctttcgcaattctcgatcaatagaagctaatacgtcttctgcacctgttgcaaactcctggtagacattagtataatccgtgtcatcaccatgtccaaaaaacattcttgtttttaaatccccatgaatgtgacaaactttatttgagggtatccgataaatttcttctagagtttttgtataattaaaagtaagaaaatacgaatcatcaccgaaaagggcctctattcttgaattcgcttttgcctttccaatattaatagaatttatccagtcattgaaaaaacattttatccctcaattttcaagtcaagtgcaacgatgataacgaattcttgatagtggtctaggctgttacgccatgcatcggtagtaatcgcatgggcgaagatagttcagaatacgtctgggacgatggttcagtgcggggaggcagaaccttgagtttaaaagtgattccaaccaagttacaagatgtgaaattagtcgaaaccgatgtttttggtgacaatcgtgggttctttaccgagacctacacgcgtgataagtttgttgctgcaggcatcacaaatgattttaaccaagacaatcagtcactttcagccgaagccggcgttttacgcggcatgcattatcaaatggcgcctgatgcccagaccaagctggttcgggttgtgactggtgtggttgaagatgtgttggttgatattcgtaaaggctcaccgacctatggccagtgggaagggtacattttaagcgagttcaatcatcggcaactcttcgtgccaaagggttttgcccatgggtttattacgttgacgcctaatgtcaatttctgctacaaagttgaaggcttttatgctccgcaatctgatcgcgggatcgcgtttgatgatccggatatcgggattcaatggccaatgtcgacagatcacttaattatgtctgataaagacaagaagcatccgcaactcaaagatgctgaaaataattttgtttacggggagatttaataatgaaacttatgattacaggcggtgccggtttcatcggctccaattttgttcattttgtctataaaaatcatccagatgttcagatgattgtgcttgataagctgacttatgctggcaacaaggccaacattgccgatcttcttggtgaccgggtgcagttggtggttggcgatattgccgataaagaagtagttgataaatggatggcaaaagttgataccgtggttaactttgccgctgaaagtcacaatgacaattccttgattaaccccgatcccttcttgcatagtaatgtgatcggaacttatacgttgcttgaagcggccagaaaatacgatgtgcgcttccatcacatctcaacggatgaagtttatggtgacttgccgttgcgtgaggatttgcctggccatggcgaaggtcctggcgagaaattcacagttaacagccgttacaatccttctagcccatactcctcaacgaaggctgctagtgacatgttggtacatgcgtgggcacgctcattcggggtgcgggccacaatctcaaattgctcaaacaactatggtccctatcagcacattgaaaagttcattcctcggcaaattacgaacatcctgagtggtatcaaacccaagctttacggcaccggcaagaatgtccgtgattggattcacactaatgatcattcatctgccatttgggacattctgaccaaaggtaagattggcgaaacctacctcattggtgccaacggcgaaaaagacaataagacggtgcttgagctcatcttgaaattaatgggcaagccaaccgactattacgatcaggtgaaagatcgtccgggtcatgatatggaggcagaaccttgagtttaaaagtgattccaaccaagttacaagatgtgaaattagtcgaaaccgatgtttttggcgacaatcgcggcttctttaccgagacctacacacgcgataagtttgttgctgcaggcatcacaaatgattttaaccaggacaaccagtcactttcagccgaagccggcgttttgcgcggcatgcattatcaaatggcgcctgatgcccagaccaagctggttcgggttgtgactggtgtggttgaggatgtgttggttgatattcggaaaggttccccgacctatggccagtgggaagggtacattttaagcgaattcaatcatcggcaactcttcgtgccgaaaggctttgcccatgggtttattacgctgacgcctaatgtcaacttctgctataaagttgaaggcttttatgccccgcaatctgatcgcgggattgcatttgatgatccggatatcggaattcaatggccaatgtcgacagatcacttaattatgtctgataaagacaagaagcatccgcaacttaaagatgctgaaaataattttgtttacggggagatttaataatgaaacttatgattactggcggtgccggtttcatcggctccaactttgttcattttttctatcgtaaccatccggatgttcagattattgtgctcgataaactgacttatgccgggaataaggctaacattgccgatttgcttggtgaccgggtgcagttggtggttggcgatattgccgataaagaagtggttgataaatggatggcaaaagttgacacggtggttaactttgccgctgaaagccacaatgacaattctttgattaacccagatccattcctgcatagtaatgtgatcgggacttatacgttgcttgaagcggccagaaaatatgatgtgcgattccaccacatttcgactgatgaagtctatggtgacttgccattgcgcgaggatttgcccggccatggtgaaggccctggcgagaaattcacagtcaatagccgttacaatccttctagcccatactcctcaacgaaggctgctagtgacatgttggtacatgcgtgggcacgctcatttggggtgcgggccacaatctcaaattgctcaaacaactatggtccctatcagcacattgaaaagttcattcctcggcaaattacgaatatcctgagtggtatcaaacccaagctttacggcaccggcaagaatgtccgtgattggattcacaccaatgatcattcctcggccatttgggatattctgaccaaaggcaagattggcgaaacctatctcattggcgctaacggtgaaaaagacaataaaacggttcttgagctcatcttgaaattaatgggcaagccaaccgactattacgatcaggtgaaagatcgtccgggtcatgatatccaaaggtgagaaacctgagacaccgcgtttttcctccgagcctcagtgatgataaagctgtggcaaggcgtggcaaatggactggctgagatagtcaggcgggttcgattcccgcatgccacattgccaaactaaggcgtaaaatctgaactttggcaacccgacctgataaagaagtgccgcttaaaatatcaggaggtgcgttaaaagactaatgctaggatacccaaatgtgtgatatggcatttgtcgtctatgtctagcggcttggcatagaacgaggccgaagaaacgagatgttgtgggaccaaatcccaccggcctcattgtccagtttagcgaccggacacagcttgcgatgaccccatctgacactgggagagcgagcagcagacatatgaagcacagatatcacctcaatgtagtattccagttcacgctggggtactatttttttgaggtgattagaaatgagctttatttctggatttttgactaaagacttttgctcaattgtggcagatggaagaatgtctcaaggagcaaaaacggttggggaaaactataaaaaatttatgttagccgaatcaaacattttgattgcaactacaggaaacgctcaagttgctgacataataaaggacttcataaagcgattacatgttcaaagcaacggagctcagttaaactggcaactttacgtaaatgtgatccaacagtttgttaaggaaacgttaaaggaggcaaaagacatagatggaaattgtgtaaatcaaattgttgttatttgcggagttaatggtaacaaaatcatggctttggcatttggacaaactgacgcaggttatattcaacgtgagtacttgcctgaggaaaatgagcaaaagttctttactatgactcctccaggtgtgaatccagatgccgtcactaaggagttcatctcgattaccaacaaaatcgagattagaacatatagtgacatagttatagttcaaagcaaattgcaagattatgtggcagaaatcgattcgggaaaatcagttaatacacataagatggggatgggggcgaggatagacggaatcaacggaagatttaaagaatggtcctctggtaattaaactacccgagtttttagactcggccggggatcaatgcccagagatttcgggtgggaaagttgatattatttggctttgacgcttcggcgtctttttatttacacgagcactccgccaaacggtgaggtgctatttttatgcgacggatttacaattcaagtgcaacaaactagtcaaatagaaaagactcatagcctgagtccttgtaaaatggaatcaccataagaccaactacaaggagaactcgactatgagtccgtacacccatcttaccttaaaagaccgtgaatcgatactgct
